United States Patent 6,812,339 (POLYMORPHISMS IN KNOWN GENES ASSOCIATED WITH HUMAN DISEASE, METHODS OF DETECTION AND USES THEREOF) - sequence listing, part 9

SEQ ID NO: 11869 - DNA, 194714 bp, Human
tcactaataacaacccttcattaatgtgaagccaaactctcgtcacctttctgcgcctgctgtctagactaaacaattgcagtttcttgcactgttcatcaaagggtttattttaatgtctttagccatcttgattaaagttctctgaactcttgagtatctctacattatttaaaaataattattatagtaaagagaaatttagactaaattcaaagtaactgctttggagatctcatcaatgactttcaatgtggggaagcttgtggactatttttggtgaaaacaaaaatgactggtgttacagccaggtcattagacagggccatgggtgatacagtgcattttttgttgttcattaatgtgttaacagacataatccctttgtggtatacaaacacattttgggaatccttatgaacgtatatttgtgtgcctcctgccatgaaagttcaaaatatagtatacttttaaattataaatctagataatacaagacactatgccttatatcatccatgcctttctaatctgatcatctgggattatttcctctagtgtctcttagagtgccttgtccagagaatttgaaataatagacatgatgattactacaagtaactgtgagatcatatggcatttatttcctcataaaatggctttgtggtttatggagaagttagggagataatgggtaatagggaaaagctaaggcaagagagcaggggaatcaaattcaacatttgttaaatacctcctatgtgtaaagcacctgctagggatggtggatatatgaaaatgagtatgcacagcaaatcattatcgggggaaggaaaaaagaatggataggattgtcaaatccaggtatgcttatatgatgacacaaaggtacctgggaattggagaaggggctgcctaaggatgtattggttgtgaagatattccactgaaatcagtcatggggcattaatattttaggcagaaagaaaccgattcctccaaattagggctcagtaaaaaatgaggaataaaagtatcagtgacatgtgttttatttacaaatgagaaatcattataataatggttaacatttttgagctttgacaatgcctcaggcaaaggacttagaagtccttttacctgtattaattcgtttagctctcacaacaatgctgtgaggcagatgctgttttatctcatttaacatagatgcagccatggggagaagaaatctcatggaattacatggggtgctgggtctaactggcaaggaaggagttcacttggagatggtgccaataggatttggggggcactagattaggtgggtatgtgggtgtctcctagagattgggatggcactgggggatggtgtgatgaccaagaagaactgtaatgctgtgggtgttatttcagcatattctgaaaatagatgaatgcagagttagagaaatctgttggtgtgtcaggatttggtttgagtcgttaaaagatactgggtaaaatgcatgttcaaggattggccattcaagcagtgtgtttcacagggatcaaatccttcttcctttcatcagcccatgcccttctcctccatcctttccctttctcattgagagttttcccgcaagccctggcattggctctgcatggtggtggtgtagcccccatctggctaagtcctcctcatgcatcctacccttgagcatccatgtcactgtcagcctcccggtctcagcatcagacttttcctaattgatgactttgataccttcttctcataactggagatgccagcctcatgaccacattactattttcttatctctctgataaatctctgactaattttcatttctccccaatcttcagaactcctctgctatcctgtccctatcttcttgcagccatagccttatcctagcctcttcctctcttttgatgacagagacaagtgaatgtatgaggaatctgtatactgggtatatttctgtatgagttgagtttgaatctgcatgtcattgtgagtgaaagtgactatgtgagattacatttgctgtatgtatttttatgtttcccaagtgggaagaggcagttgggaataaatggattgaagttaaaaggatcccatggtggtcaaccttacttaaaataaggaaaaggtttattgcacaaagatatgcctatgagggtggttatccagtttttgtgaattgaaaacatcctaaattttcatgaagagggggttgattaaattttggttaataattcaatgaaagattatgaatttttaaaaatatattgcatatttgtgtgtgtatgtgtagagagagagattaaagtattgaatgaaaataaaacattacagcagttatgtataattgatatatatttctgttgtatttgcatattgatgcctagatgttttcatctgggaaagttgctaaaataataatgtgggttgtctctacaaagtgaaattattattatttttcttaactgcattttttcatttgctctaatgaacatatagcatgtgagtgataaaaaatataaagttgtgagctgacaatagtatttcaggaataacacaaatatgaagagtgggcatcagcaagaggtctctcattatgcccaaataagggaggggtttaaaggcctgttatcttttctttccctccttctctagctggccatatgggagtgaaatcacttaaagaaaagcccaacccttgcatacaatctttttctaaaaaccctccccaattagaaatttatttgaggtaataaacaagtatccctgggagcataaaaatgtagtggtgattcacaaaacagtttaacccacatggcacctttgcacaaattttttaacgtgtccattcctccaaacactttcctgccatgtgctgggaaattgacatcataaaaatgctatgaccgatgttcatgttatgatgaccctcttctaagtttgtgcagtgccctttctatacaaacttgtaagcaatgagttaatttggaatgcatagatttatttcttcctagtctgactgagactttagctgtaaggaatgggagtttgacaagcacataaacatgtggtatgacaggaagggagagcaaatgataacttaaaatttttaatgctggcctggggtctcctgtttgcatgagagccctggaaagccactctttaactcttgtggggtccgtctttatggggtatttggaagtgagttgaatccctggttataatggagctggctctcagggatggatagactttcactaattgtgtatggaccccccggagggcggattaatggaatctattcttgtgttcaaatcgtaatgcttatttaacagctgtgcttcctggtttagttgatagccacttatcacagtttcaatcctagatcttttcatttatcactgatacagagacattccctagtctactgaagtcaagagcataataaggccagaccagaaaaccaatcaatctctgagcaaacagatgccatgtacatgctctgactgctatgttctgttatgaagtcctccttggatctaggtagcacataaagttatcaaataaaaattaaataccttgagattccctctttaagggaaagatcctggtgaacatatttttaatcagtaaacttatgaatattttcacaattataattctgttactctggatgtgatggtagtagcttggaaggaatcaagctaaggtcctatgggaaatactttctgagaatgataatggaagaacaattacgtacatgaaagagatccataaattataaaacacttatacaaatcttaattaatgtgattatttgtcggcaaattgctgaagttctgttattgctgagattattcaaatgtagaaagaaaagacttcttggagtttgaattgacaaatactgatttgtgtagcaaagactcaacttacttggtagaggagttgcatatgaatttttcaacaggccttcaaggattcttctcacagctcttctgaacctctgctttgctttgtgtttgtcttttatccaaagaacactgaagtaaggctgtgttcaggaggattggtggagttcttgtctggatctttgagtgctatgcttgaagcaagccaaactgaactgacagcagtttaacacacattgtaatgcatagtcctgggcttcttgtgctagtcatccagtcttcatcatcaaaacaaaaccttccattgtgatcttgcctggatggtgcagttgtagttaattcagttagagcaggcactgcttgttgtagttggagggatgaaattagacatctactagaccaagaacactgtggtggcaggaactgtctgtttttttttcttttttttttttttttgtgccactgaatccctagtgcttcacacataatagttgcttggtaagtattagttaaatgaattttttgaatatgttacagagggagaccaatgtggtactttaggcagaagtcaaacaaaaagtattgctttgacaggattatgacaccccatgaatttttagtcttccaatctcaatttcataagtttcctagagttggtcagaatcaaggcaataaccaacctgatatggttaggctttgtgtccccacccaaatctcaccttgaattgtaatccccataatcctcataatcctcatgtgtcaagggagaggccaggtggaggtaactgaatcactggggtggttccctcgatgctgttcttgtgatagtgagtgagttctcttgagatccgacgttttataagtgtgtgttagttcttcctgtgtgcacttcttcttcctgctgccttgtgaagtaggtgcctcgtttccccttcaccttctgccacggttgtaagtttcctgagacctccccagccttgctgaattgtgagtcaattaaatctttttctttaaaaattacccagtcttgggaagttctttatagcagtatgaaaacagattaatacacctcaccaaactcatcaaagactgaaatgtaaaccagttatcatttagttacacagtttccattgtggatttttccatagcaaatcacctccaaacttattgtgttaagttaacaacacttatttatctgctaacaatttcacagtttaggaaggacccaacagggacagcttattttagctccaagtggcattagttagagtgtttgacgagggctggaggatccactcccaaggtggagtactcatatgcctggtagactggtactagctgtcacctgggagtcaccaggactcaattctcttccatgtgggcctttccacttggccactcggggttcctcaaacattgtgactagtgctgcctggcaagtatcacttctgctgtattctcttggtcaaagcagttacagcccaatccagagttaagggtagtgggggtatgggggaagatagaagtagactacctcttgatggagaaagtgatagagaaattgcagtcatttttaatgaactccaaacattcactgaaaaatatctattaaaaagatttgtcaatcacctcaagttggtttttcgttatgttctcattgtagtagaaaaattccacagttagcgaaattacataggccaagaggagggggatggtatttgacctccttaaaattgccatcagtttctctttcaaatcctggaaaataggaatacaatgagaataaaaccagtgtacttactgtgcagatgatgtctcaagaaaagtcccagggtactgacatctcccatcccacctccccacagacagacagcgtattactgcccttcagtcctcttttgttgaaattctggagctgcctctgcccagttacaataaaaagattccctggtaagtttagaaagagaaaaaggagtgaattacgtggtctgagggtctggtgtcactgaagttataatctttccatctcaactagattgttatctgccaaaggtatttatttagacaagaaaaaaaaaaaaaggctgggtgcggtggctcatgcctgtaatcccagcacttcgggaggctgaggtgggcggatcacaaggtcaggagttcaagaccagcctggccaatatggtgaaaccccatctctactaaaaatacaaaaattagctgggtgtggtggcagacacctgtagtcccagctacttgggaggctgaagcagaagaaatcacttgaacccaggaggcggaggttgcagtgagctgagataatgctacttcactccggcctggcaacagagcaagactccatctaaaaaaaaaaaaaattattttttttcctttcaggtaggtttctcctctccaaggtgctagaaaagtcacttttttatacattaattcttcttttgtaggttttcaacagacaagtttcctttgccaaccctatcttttttcagagatccctgttaaacaagtgatacatgttaattcttgtgattcttttgcagatttcttatactatttgtaataccttgataaaagttccaagcttgcttactgtacttccatttaggagaccctagtggtcaccatttattagttatctattagttccagaaagtgtatatgtcctactttgtagcacaacaatgcactgcaggtattggggagatgggacctcagagaagccaactttcccaaggcatataatacgtacacagcagcaatacgaaaatcagaacagaagaaagttcactgatattcccaccatcctaacataagtattttaatttactgtagcctttgaccttatgcatgcttacttttatatagttgtcatcatagcatgtgcctaatttttattctgcttttttagacaatgtttcaatggatggtcaccttcccaagtttctacatattataataataattttgatttggccgggtgcggtggctcacgcctgtaatgccagcactttgggaggctgaggcaggtggatcacctgaggtcaggagttcgagaccagcctgagcaacatggtgaaaccccatctctactaaaaatagaaaagttagcctggcatggtggtgcgcgcctgtagtcccagctgctcaggagcctgaggcaggatagttacttgaacccaggaggcagaggttgcagtgagccaggatcgtgccactgcactgcagcatgggtgacagagagaaactctgtctcaaaaaaataaaaataattttgatttgttatgtagtactgtatgcggatgatcaaagtagatcttctttggtttttaaaatatattttttctgtacataaaagtaatatatgtatacacattgtggaaatatttgaaacaattatataatacactgatttttatcacacacaaagatgtaatactgttatattttttgaatattttctgccaggcttttcaaaatctgttataaatatattttgtttattcagacacaagtcattttatcgtatacaaaattgaaattatactatcaaagcaacttcaactaatatttacttgtctccacaaaaggaacattttgagaaattccctactgtcttgcttttctataggggctctccttgtggagggtttcattgtttcaacaaggcagggatttgctgggatttggagacgttcctaaatgtaaaatcattccgctccccgcgccccgcgccccaactccaccgcatggtattgcatcagtatagaacagcatgcacgcgcatccctcagcagtgtgtgttatccactcattgcctcatcaaccttggagcacggcctgataatgatgtggggaggtgacctccagctgaatgccgaagctggaagaaatagtgctgttctgtgcaatggtagttgcatctgaataatgtcccagcttctcatttaagaaatgctacccaatggagaagagcaggtggggtctatttatcattctacatgtcagatgcaaaagtgatcttatctgtgactttggtgcaagttgcagtgtcacatgttggattgagcaaaatgcactctcaggatcaacattctctgcttaagtagtgaaacagtagtgttggtgcaggttaactgtttttgtgtgtgtgtgttttatacagtgaaacatttttaatgtgaaattcttgaaatgcacacaaaagtacagaaaatgctaacttggataccatgttttcacgcacagatttaatggatgaggttatattgcttctgatctctttaaaaggctctatttcattggtagggatattgtccctaagtgcaaccttggacaaaatgtttgggatgaggaacatggagtagagcctctttgctgaggctccttccagcccccgcactctagttcctgcttttggaatgtcactgtcaaataagaagtctccttctagtgactgtagcacctacataagagagaacaggggataagaatacaaggggagataaagtcaggtgttcccaaaagctagtagggtgacaagggagaaatggggtagggatacggactcagctagatgttagttgcaccatctgtgagtgtgtcagaagccctgatagactcaatagactgttctgtttttttttctaatcacatttagagacaagctgcttcctgaattggatgaattttaaggttatggttgcacatttaaaaagtgaaaattgaggcttttcccattctttgcctctctcctgagttgtgggagtaattcatggcaactcagaatttacatcttagagcaaacttgctgggtgatttgtcttcattgcattttgggggtgggggaataaacctcatcaagcagggcctgattttccaagagctcatcattcaggcacttattacccactttgtgcagtttctaggtcttttgcttttcaccctttcccctcctgctgggttttggtcattttgctgcttgttaggacttccaccagctgatatggagaagcataaagaacggctaaagcattattaagttctgcttcatgataggagctctgcaaagggcttggtgggggagaattttgaaccctttgcctacaataagttttggagttatctgttgattttggttaggtatgccctccctgtcctccattagtactgataatgaagagctcacttacaggaaaacaggatgaaagaggatggcaacatacagctgagaatcacagtgagccatgacttaaacatgttcctgtaatatgatgccgtaatgagagggagcccaagtccatatgagttcattgaagtatcaaattggtgtgcaatctttcttctcattcagcataggtctggcacatattggagtagaagtttttagtggcggtgagactgcatggtgcaggtagattctagcaacttttttattcctggggcaactttttcaaatgatatgcactgacatctctgagatttgagaggacatcagggtgtggactttggaataattactgaagcaatcatcttatatcccaccatgcaaaagagatgttggtgattttgagaaggctgaacaagaacaatgaagatagttaaagaactccaagctagtattctcatgtctgaagataggagggctcccaaggtagttacacaccttttgttacatatataaaagtttacttgtgggatgctgtttccctcacatcattctgtatactcatactagctcagtcttccaatgtgcaacatgattatgctgcaccccttcttggtcttcattaatgctccaggcttcctttccttcttgactcccaagcatttcttcttcctttgccaattttaataagaaccagtcagctcacctttgaccttgaagtcctaaggaggttgtagttatagtaagaaagatcataaatacaaggtgtcataccttgatagtgtcctgcagaggtcagagctatacttattctccctgcagtcacagggagcaattgatgcatttaaatccactacatttcacatgtcacatccatccactcttcacaatagtctcagattattctccagcatgcaatcatcatttccgctactggggttcaggtttgcattgtttcccttatctacactatgagccgcttaacttgtctttatgccaaccactatttttcttaacaacaatgaaaaaaattaattagaaaaattaattggatcacttatctgccctgtttgaaaactgttcttgggtacttatttataggaatacagcatcctgttcaaaagcttcacaattggccctgttttcagccttatttcttccattgcttctgcccaccctgactccgttattctctttcctccctcctgtcctgcagctataccttcatcattcccatactcttctttgtacctgacacactctctggactctccattcttctcttctttgccaagtagactactcgctctttcagacccagctaaaataactcccctggtgaagcctgaagcttgctccccaccagcttcttatgttcttacttctctataaaacaagcatagtctttaaaccattgttttcatggggttttcctctcctcagctttgctgccttgactcagttattgctaggtcatacacctgagagatatgacagtggcaggccagtgtttggcaaggtagaagggaaggaaggggataggtgagcgaaagatgtaggctttatgcactggtttcctatcctgtctgttttctatatgatggttaggatacaccccaaaatacaaattcctttattttcttgacaaagacttctttcacatcagttttctctctttggtgaattgagtgggacaatgtagaaagcttagagatccctttgcagctttccatagaacagcaaactccttgttccttgtcattgacaccactttaaatcctcttaattcttcagagtctgtcacttctaaagtaggagcacacatagcctcaagtcttatgaagagggaagaatgaaagaaaaggcaaatgaaggccataaaaaactttgtaatcctttacttcattcacagagacttttcttcactttccccagtcctggaaaaagtaatgtgagtagtgtctcatctcttctcagaagacacattctttttttgtctcatcatatttccatgtatccttggtgcctgtttgaggattaaaatagaggagaagagtggatatgtggtgaccaatattaattaatttatatatatatatatatatatatatatatatatatatatatatatatgacattttcttgcacaatagactgggaaggagctactgtagtggacttaatgaagtataattttggggtaaacctcaattttaattccagtctgtcacttactagctgtctgacttcaacaaaatgagtcaccttctgatccttagtttcctcatctgtaacatgggattatattaggtaacatacataagacacctgtaacacaatcagtgcttgagaagaatgatgacttttcttacttatccccatgttcacagtgcctgacacatcatagggttcaatgagcatttgctgcataaacttgacactgcctttgtcagatgcctcacctggttaatttcattttttatacaattattttgttttggaagagcttctccaaatatacagttgtataaatctaaaccagaaaatgatggtgttctcaaacagtacgagagctgagtgttgagctgtgtgatgttcaagggctcttttgacttatctttaatttttctggcaaggctatgatgtagggaagtacttctgtgcatggacaggagaaaaaagagtgtgcttatttctcattcaaaatttggctgtttattgcaccttaagacctaattactctcccttgctgactcggtcctctggtggaacctaggttctctttcttcctagttcccctctatcccttccacccagaatttataggagagtgcatctgagagcagactcctctagatggtagtagttggtgaccagaactggtctaactcatttttcagtgcagaaggacacttttctggtctcataagtgccctgggagcagctctctaacaggtgtgatgctgctgttccagaggcaaggaaaaggttcctcaccactgcttggcaaggcagagagtaggggagtcaccggagaaggggaaggagggatgtatgcttcctctgatggtttccatgcctgtctacacaagacaaccacccagggagatttaaaatgcatactatgaagcagggatattgaatccctgtctttcaagtgtggcccaggaatccatatttttaacaggctctccaggccaatgtcagggacccagctcagcctctggatgtaaacctgtgagaagcagccctgggttgcatgttatcatgggctctccacgagtgctgctggaaggcataaaaatactggagagcttgcggttcttatatgtgatgacctaaaggtgtagaggaagggctataaggtatatgccatgctttatagtttttccttcacatatatacatattttgatatttaaatataaaatatataaatgtgtatttactttatatttgctgggtaattttaaatgtcccaagaaacatgcaataagtcttcacttaacttcatcgatagggtcttggaaactgcaaccttaagcgaaatgatgtagaatgaaaccaatttgaccatcagctaattggtataaagacttaagttcctatagtatctctctggtcacaaaaacatcatcaaacttctaaataaagacctaacacacttctaatattaaacattaagataaatgtgagctatatgtatacttaagaaagattagaggctgggtgcagtggctcacgcctgtaatcctagcactctgggaggcctaggcaggcagatcacctgaggttgggagtttgggaccagcctgaccaacatggagcaaccccatctctactaaaaatacaaaattagccgggtgtggtggcaggcgcctgtaatcccagctactcgggaggctgaggcaggagaatcacttgaacccaggaggtggacgttgcagtgagctgagatggcaccattgcactccagcctgggcaacaagagcaaaactctgcctcaaaaaaaaaaaaaaaaaaaaaaaaagaaaagaaagattaatgaaaataagtaatgattactacccaactattcgagttcagggtctcgggtaaccagagactaccctaacagctgagggtcaaggtgaacactgacctaggacaggatggcatcccatcacagggcacattcacacacacccatacttgctcatgctggcaccatgtagacacggcagttcacctaacgtgcacagctttgagatgtgggaggaaaccagagtaactggagaaaacccacacagatgtggggaaaatgtgcaaactccacacagacaggggccccacccagccagaaatccatttttttctcatcaatgtaaggaaacaaattgaacaaaaatatgtcatttgaggacctgctgtatgtattctgagcacctatattctctagggacatcttgactatacttttaataggattctccctgtgttacagggatagatttcaccaatggacagcctggctccctaatgtatgaacttggtacctatcttcatagtttccattttacctgcccaataatgttttcatcaactttgttacccctcctgaagccacctggaaaataaaaaagtatattccttctgtgcaagttgctgaaaaaacttgggaaagtgagttaattgctacagggaaattatttacctcacttaatgatttttctcttggcttcaatcgggggctttttaagcctcattcatgtcatcctgagaccttcctgaatgatctggatttggcagcctcgacactttagacacattctcactcaaactagagctttgggtgtggttagaaaaacaaatgggaagaagagttaaattcacaaagataattcatctcctctaggtggtttttgcccattgctgagtgcttgtcttctctttccaccaacacctacttgcttggatcttgacttattttggcagttctctgtacatgtaatgtggttgccatggagatgttatccagcatgctgcatgctgtttcatctcctctccatctcttcatttctctctagtgtgtgcttgttctctcacatttctatctcttctacactcaccccaaccccctttgtaattgaagacatcaaacactgtatttcttcaagctattttgcttcctttccccaatcatatcgaatgtgtttttaacttaatataatcaaagcaacctggtaatgactggaaaagggggtaaagaaattgactgaaatgctaaattcctgtaggttatgctaggatgcccaagaatttgagggaattcaagcaagtggtaatcaaattaacttcctttgctttcacagggattaagtctttactgtggttcagagagacttattcataatacctttctgatttccacctgaactacttcatcatgtcctggtgttatctacaaacaagaaatttctgaactatcctcaactcttaatttcccagccatgaaatattcacttcaggcattatttgcatggacccacagggactctctgaagatactgacatcctgggttattaagagttgggccaaatgtagagaagatcttagtgtgaatatcaactattcaccctcaccttgctgtgatgtgtgtagggagtgaggagtgggaaggagtgagaatgggattttgtagttatgtgcacctaaccatgtgaagattgagaaaaagattattcctcttctccactgaggatattttaattttcctcaaaaattgaaaagtactagaaaaaaataatgaataaatgtcccttttgtttttctagtttctcttaaaagacctcctcatctcaatgttataagtaagatgaatttgatttcatttctttccaaactgacaaaatgatttacgttagtaaagaatattcacatattaattttaacatatatttcagattcccccaatgctttgagtttctaaactaaaaaaatcatagccagaaactgcaatatcaagaaattttatttatttttctttcttacggaataaaatatttcagaaacaaagagaaatcgcttttgatttctctaccgatcattaattatgttcactcctgtgtcagctctctccaagggcacaataccatggagagaataaggatttgggtagattacatgatcctcacaggcagatctatgtttttatggcagtgtaatgagaaaaacatcaaaagggagaagtttaaaaagagtctgggcaagaatgaagtcaatccaaactttcatctcattctttagaaaagaaagattatagataatatattctttagaatttattctttttttaaattaataattggaggaattactttcttccacagggaaccagtactcaatgccagttgcatgtgtgtgtgtgtgtgtgtgagagagagagagagagaggcaaaaaaaagtatttgtaaatagattgtgcgtgtgcatgtgtgtgtgtgtgtgtgtgtgtgtgtgtgtggtgtgacatagaaggggtgtgggtgggaatgagaagtgaggaagtagcatgggaggatttcaacactagtcttctgcaagtgaaaaacaaatcaataagtattattgaatacttaccacaagcaagatactagtttgggttctgcaaaggataacagaaggacgagatttgatttttacctttaaatagtatgttgtctatcatggaagacaagatacagacaagtaaaaaattaagtaataaaagggaacagaacaagtcaagtgaacaataaatgaaatgttgaaatgtggactggaggcaagataagacaagaggagagaagaggggagaaggcctcagattgataggaaagtgtagagagaggataagatttgatctgagtccataagcatgagcaagagttggattatgctcaattgagagaaaatggaagaggcagaaagtgtaaataatgtttgtcaggggacagcaaagatggttcttggcttcagcaagagttcatgtaaagatgagagaattccaaacaggtagaagggaccagggtgtagagatcctttgctgagagcagactttggctctaggcagtgcggagccattggagatgtttgagcaagtagtgatgtggcactaagaaatctcacggtaagattaaatggggatagtattggggagggtggcaatgatataaggcaaagggcccaggaggaggctgttgcaagtatctgggtatgagtggatatatgcctggtctagggtaaacatttagggagtagaaaagaagggacaaatgtaagaatcattttgtaaagaaagggaagttttggaggatggattgggcatgggaaattaaaagaaaaatgttggagacagctggaagatttcaagactaaaggaataaggctagttaatatttactgagtgcctactatgtgccaggcacctttccaagtgcttcataagttttaactcattgagagagaggaagaattgaaagtcagctattttgagagcaaagataaagccaatcaatttcaggcactaagagtttgtaatagggataaatgcaagtggagatgactggcaaaggatggaaatggggaataagaggtcagacctggaggagaagaattggactaatccacttagaagaagagtttgtgccatgggaatggctgatatctgcataaaatgagaaataaacagcctgttttgaatttcctttaaaaagtaaaataagagaaaagataaaggcatccagtaaagaaggagaaatcacagatgaaggaggagaactaagataacatagcatggtagtatctagacagaaagcaatttcaaaggaaggagctattctacggtgtgaatctgtggagagatcaaacagggtaagtactgagactaatttatgtatttgattgtccagatcataagtgaagatcagcctgtcctattgagggcaattgagagttgactatagctccaaagaaatactttaatattgtatttttaagtccagagagaatttggatattctgtgccaaagcaggataagtttttgtcactattaaccaaaccaaataaatattctagctcttattgtctgcctttaacaagaactccaagaattcagtcttagactttcataactgacttccttccagagcacgatctaagaattaattcctctataagtccagtcaagcttactgctgtgtggtttttctcctgtttttttataaggcaaattcattcaatttcttcacttttttgggttagtgcttgtgaaatatgacagattgacagcccttagagactggggttctctaattatcctatgaacatagctccttaccagtaatgtgcctctggtctctcttagggctgtaaaaagcctgtgtgtttagttgactttcctgtaggcctctttatggtgatggcatcagggacaatttaaaacaactgatggaccactggttggtgtataaatcataatcaagagcctagggcttggagccattcagatctggatttgaattttagttctaccatcttagaagtttgtggcttctttcttttcttctctactgaccattgcttctcttgacaacattgttcttagcgtggggcattggaaggaaaatgggctttagaatcattcagaagtggatggattcaactcccagtgctcccaaccttgggccttcattatagtatttacctattattttatatcattgatgtgagaatgtaaaataatgtaaagcaccaaaaacaaggctaggcatgtgctcaataaatggtaacattgttgggttttttaaaaaattgagcagccagagcagaaataagacttccaagcaacttcacttatagatcagaaagctatgagattcatttaccttgtggagacaaagttctgaaactatgtgctgaagaggggaaaaatgtcagtcagcatattttgtacatgaagctaaactacagttgacttttaattgatttgattcatcctgggaatccagtgcctaagagcagccagctaattcttcctttcattcatgtgttaaagatgaaattataacagaaagagagaagacaaagctgtaacagttttaaagctgtaagtgtggtggtctcattgtctaaagacacaggggaacctggcttggacttggtcatgttaagtttgatctgagcattcaagtagaacattccaatcagaaatattgagctgaaggtcagggaattggtggaacctatgatagggattttggagaccttggcatgattgttgatgttatggctgtgaatgcatctcagagggagacaatatgggctcaaaactgaaccttggcatacccccaaattggggagtttcaagtcaaagtggagaaaaaatggagagatgactagcctgagttgtataaggagaaccaagatattatcctactttaaataataaagtacaaaaaagggacttgctaaaaaaaactgggagtatcaactgttagagactatagaacacttaggagaatgatgatacagcaaaggctactgattttatttttgttgatctttgtcttagtttattttgtgttgctataaagaaaactcaaggctggtaatttgtaaaggaaaaaggtttactttttgatgatgctgatggctggaaagttcaatattgggcatctgcctctgatgggggcctcagtctgcttctactcgtgggggaaggtgaaagagacactgcatgttgagagatcacatggtgagagaagaagcaaggtcggggaggggggtgcacccagactctttttaacaactggttctcatgggacctgataaaaaaggaacttatccccaagggagggcattaatcttttcatgacccaaacagcttccattaggctccacctccaatattggggttcaaatttcaacatgaggtttggaggggacacacatccttgcttggatggacagacagccaaatcatatcaaccttgtttgattattgatgattttgcagctgtgatagtttcagtagaaaagagaggcaaaagcaaagattacaagggttaaggagtgaagtctggggaggaaatagggtcatcaggcgccaattacttttttaaaaagttcccagtaagaagagatagaaaataaaattactttttcataggggttgaaaaatctctttgtgatttgccctggtcaaaaaagagttaatggtataaatgcacagtaatttcagaagcattaaagagcatgtttccatggaaacatcaacctacagagggagagaaagagctaggatcccctgacaaagaaggaacagcagagttctagcccccacacagtacagcagggagagatgattacacgtttctttcagcttcccagtgaagatgcaattggggttcatggtgctgtcctcttgaggatgagaaaagaaggaaatggggtttggtttgaagaaactcttggcctcatcttgcttgaaattctgactcaagggtcaatctcattttagaatattggaaaagatcaatggatatctttaactaaatacataaataaatttgatcttccccaacctctttattctaacctggtctagaaacagtgccataatgtactgcgttagagtgaaacttaaagaaactctagaaatataagatgtgggtttgactgataacttttgaccagcacttttgcattgtggtttttctcatctagatgtattttctttgattatgtacacatttggcttcacagttttcagatccataatatccctttcactgccatctagtacaaatttcctgtacccttaaaaccaaccctactgttagagactgttcatctcactgaactgtagcccagaaagctgttctccagaatgtgctacaggaaccacattaacaaactccttattgcaaacaaatcttcctgtcagttcactttctccattcccagattatattccactttgcatctctctcattactctggtctttccttgggagaaatgatttcgttccctatgtgaaaggattttatctgtatggtaggtgtggtttatgactgggttttctgaagtcagagatatgtttttgaatgagtcaacagcttccaccactctctctgtctcacatacatagcatgacatgcctgtctcccctaaagacataatcttcacccaggcatcttgagtcttctctctgttggaaatgtccccttgaccctggaagatcctccctcctttgaccctctcctcctcccaattcaacataatcacttctataaatcttcacttgaagaactctgccaaccattactggaaaactaaattataaccttctttttccatgagtgacaattcttcataacttccactctccagccctgtaagtgaagccatcaccaactcatcatatattcatctaccattttgccccctttggcagagctgttagagggaattgtgaagtcaaaaatatggtagctacagatggggcaggaactgtgtgtatggagatatttcctgtgtgttgattttgttgaccacccaatgtgtaagaggaagtagagagaggctacagaaaggacaaattgaggaaatggagaaagatcaaaagggagagaaaagccttcttattcttttccgttgatatcatacctaggtcactttaggttcttacccaagggcttcttgagtacatatgctcagtaggccttgagtacattctttcagtaggcctgaaagttcacaggaaggaaagtcttcctgccatagttgaatgtcctagagaaatctttgccagtcattgtttacatagcccctgaatagtttttccagcctgtgagctaaaatggatgtcagaaagacaagccttcaccttaaaattattaatagtcacaaaaaagagataacgtagtcagtgatcagctagcctttgatctgccttggtattttctctgggaaggtctcaccacttagttttgatagcctacctactctgggctgcattccaacatactgaacacctaatctctggaagaagaaaggaattttattcagtgttttaagaaagtgattttaacttatatacagcatggaaatatgaactaaaaggaaaaataatccagtgacagtaacattatgcagaaaagctacttggtttcttctctctggggatttctacctttctaacattgtctaataagtctggctttcctgtagcaccttaccaggtctcacctatagtagaggtgactaagagtcgtgagcatgagcacaaagaggaatttcatttttcatcactgagttctgtgcatagagctaaatgagaagcaactttggtattctgcacatttgattaattggcatcaaaaggcagcctcactagttccctaaggaagtgtggtaccttcacacataatcaagaatgtgttctctccaaagggattttaaagagaattacatagtgttcaaagcagggatctgggaggtcagaagggggatcattttgaggaatcatttattctagactaaaattatggaggtatgagcacatcttttgccttccttggaaagtgaactttatattgaagtggtatgatttagtgactgcccactgcaaaaaaacctcacaggggtaactaatcatagtaagaacaaaacaaatattcccaagccttaatagttttggatgttataggaatgagagagaatatactgaactggtagtattatggaaaaacagagatccaggaattaggagacccagactcaactaaatgggccaaagcatgacatcattgtcccaagcttcagagtgttcagctctaaatatgaacagttagactgtgatccaaaagtcccttcaaatgctaactcccctgacacccaggcaatgtaaaaaataggtaataataataacaactaatacataatgcttactctgtgatagggagaattctaagtcctttatatatgttgagagcttgtttggaggttctagaatggaagcccagctactcacatacccttgaccgaagaccggtcctcctttattgggaatggtcatcctcttccactgagcctgcagcttagggacggatgcacatggagtagtgagggaggaaggggacacccgcctagccagccagatcagctgaatcaaccctggcaatcgatggagtgacagatgccgcagccagatcaccctcacatcccctttatatatatcgaaacacaacaatcctatgagataggtaatattattatttatattttttatggtgaagaaaataaggaaagagaggttaaataacttgcaagaccacacagcttcagaactggtgggtgcaggatttgaatggagactgtgactattacactgtttaagaactgtgcccttgttcttaaacacctcgctacactgcctgttgcagtatgagtgtgtacgtgtgttatatacactgtattctttccctctttagttactgtttctcccctttattttctttctattcacctctcaccactaagcattttggggcattgtccagatttttttcattcatttgaatgagaatatcttactaatgagaatgagttcctccatttcatcccagatggacccgtaggtaagtctagagagcattgttccctagccatggcctgccacattgaccctgcttggtgaaaggtggcatagataggaggttatcacagctggtgacagaactccttaaaattctcattgctttgataattggccaaagacagcatctttctggagggaggttaatgttctctaccttcttatatcagtcctcctctgttttctttcattgcagattaaactaattcatggtattcagttgtgaaacagaatccaggtaatagctctctgaaattttttattgttaggccaagggggctgaaagcactttttcttcataatagatggtgaatttacacattgccacttacacctctcatgaattcagttcagcccaaactactaaggggctaaagcacatttctcaccaccagtaggagataagaggtatattaaatttgtatcaatcactgttcaagatactttaatatctcattaacttaacaccactaatttagaatttaagatactttaatatatctcattaacttaacaccactaatttagaatttaaataactgtgatatgaactagcccaaacttgaacattttatgatttgtgaagaatggtttgcaaaataaattaatggtataaacaccatttcagagaaaatgtgttatccactggaagacaaactatttttaacccatctcaagtaaacataaactaatattacagtctgctctttaaattagttattcctgagcttctctacaaggtatcattttgcctaaaagaacagcttaggaaactggcatttctaattatattgtccaaccacagagtttaatatttttatatatgacatatctcaaaggaatcatttaaaacttcttcaaatccttcttccttaaaaagaggacattgttgaccagattgtaataatcttgcctgccatgttgaccacgctaaactggattaatcattttggatttattttgataattatgaatttcttagctgggaaaaattcagaaatttctgtttagtctatctaaactagaacactgaaaatctaatttttaaatatctttgcctcttttctccaataccagtctgtaattaggtagcttttaaaagttttaagtccactatttctaatcctttgggaaattgtttctactatttctagaggtactgtgtataaataatcataatttctaaaaagaaactctagtctttcaaaagaattgtgttttttccattcacatggtagagagtaataacagcagctaataataacagaattatagcaatattactaagaacagtattaatcagatgaaatgtgaggtgataagttaatttgcttcactagagtaatcttttttactatctatatgtatcccataaaatcatgttggataccttacatatacacactaaaaactatgtttaaaaaagaagaaaagaaatgtagagataaacaacaggtcaaaggatcctccctgtagcttctcacaccagacaagtaagatggtatgaaccacctgttttatagatgaggaagctgaaggctttagaaggtgacacatgcatgatacaaagttacagagttacagcttttcagagccagaaaattgcaaaaaaagagggggtcaagaatttgtcccttgcctggaactgtgttcttttatcactttacttttaatagctagagaaggaaaatgagagatatgaaaaaccgccactttttaaaagcatggtggcacatggaaagaacaccggactaggggttaggacacctgggtcctattctcagccttgtcatctaatcacaaaagccctgctgggctttgtctgtttcatctgaagatgaaaagattggatgaaatgagatgctatctcttctctgattgacacattagcagatattaattttaaaaatctagtgcttgtaaagacatgcggggtaaagtaagtactgtagttctagggctgttggttggctgggaaaattctggtagagctccttcgagtgcctcccactcaaggtatgccgctaaatcattgctgtgggtatcaacgtggtgcagtagatgagcttggagtggcatggccagagtcagagaggcagaagggctctttaaccttagcctgatcccattaagctcactgtggtgtgactttggccatataaagcaaatgtattggctctgagcccatcaggattctgaggctctttctcaacaagcaggcaagcaggtagattaatcatctaagatagattttgttttatgcagtctgtattagggatctatatagtccaggatgtgccatgtgattcaagaatgctaaaatgcacatctggagctctgtggaactgattttacttcacttggtgatcatggaaggaccctgagctgagagtcagaagacttaagctccagtcctgaacaggcaggtcaccttggcaaagttgttttgcatcttgggacctattttctcctctctaaaatgaaggttctctatggataatttctaagttctctcctagttttagcaatgtgagattctgtgtaatattagaactatatgaggcagaccatctggtttcttaaggttcaaactacattctagagacaaatcaagcaatttaaaatacacacacacacacacacacacacacacacacacacacacacacacacaaccttgatgggacttccaggggatttgagtctcatgggcagaacttctgcatttggctgccacttgaagcaaagctttttgactgtgtacttgaggatgacatgtttggagagaaatagaatagctatggcatctcttaattataatttaatcctttacccaggattcacacatgaacgtttcgaggttctaattaatattaaaaatcgacaaagtacagccagatccaagggtagttggatattttcaggtcttatggaaagttaaattgattaatatagccatttgatctagtttagcctccatatgtagaagccaatctccatttttcagatgtatttcattgataattgagtcttgttaaaatgtggttatcacacttattcactgaggtttaaaatcaagcaactttcttgcctttagactctcaaattatgctaatatattctttttctgaatttttcctattaaataaccttatatttgtatcatattttatatagttttcctatccactctttcatttggtcatcacaacagacttctctgataagctggaagtaaaatgatgtctccattttagagaagaataactgagattcaggtgccaagatcacatgtctagaagtgaccacacccccaattattttttcacacttttcattaccagtgaatggatgggtttgttctgctattcaaagggcatcttgctcaaggctgatgtatatttgcatgctcctcagtaatggctaaatgttctcacaccacaagaaattactcatgaaaacacagtgtgaatgattaatctatatgctgctgacagatatgaatgatgaaaggatactttggagaagaatattttgtatattgtcataaaattttactaatgtttttgataagtgtaaaatatgtgaggagtgcttaggtagataaaatgaacttagagctggaagaggaggagcaccccagaaagagaacaatttctaaggaaaatcagaaggcgctggaacaggaatagccagaaaaatttacagaccaattacattgctcatgagtgtgatttattttctgcaagttcaaatttctcaacttgtacacctaattcaatgctgtccccttcaaagaagtcatcttgagaggctatatagttattccattgatgttgcttattaattgaattatttttggaacttctcttttgtaattgccttctgaaatagatactttcctttaaatattcttaatggtgttttagctaaaggcagaattattcagcacagtgtctgataacaaggtggatgcttacaccagataatttatttccctcctatccttcttcttccttacccctctctcctccatctctctcttccttcctccttttcctctctttctttccttcctctttccttttcttcctttttccttctttccttcctctttccttttcttcctttttccttctttccttcctcctttcaaaatagatgagaccaaattgttttacatgtctcataaactttatttgaagactccagaaattgttcagggtctttgtagtaagaatacattttcaagtatattatattagtgcttatattctagtttgttggtttaaaatatcctgtctcatggttttgtaattatattctatgcaatgaattcttcagggcctttggttggagtgttagagtcattgcaaactataagagacctgaatattaccttcacactaatgatgggcttgggtgagccgctctgggctgagagctgaggaacagggcaagaagtggagcagattgagcattgagttgtgttggggatgctacatgtcactgagtggaggtgtctggagagagcagccaaggtgggatggtagaaaacacgaagccatggcatatgaggaatatgtaaaggccttgggatgctaagtctgatgttgtatatgagaatcaggctggtgtcaggaaaggacatgaaactggagatattgcttaaaatgttacttctgctcccaattagctgtgtaactgtcatactggacccttgttgactccaatagcgatggcaccatatctgaaaggcctaagaagagacccagagataatgaatgagacataggatttactggggaaacttacatacaaggacaatccagtggtggtgggctggacaggagaactgctaccatttgtaaaatgcatgcagtttatatagcattttcacttagcaatgttcacctaaacgttcatttaacccaaaacaaagggctctgattccctgtatggcctgcattccagcagatgaactgggggtttagatgtccttcatagataaaaagtgaatctctgggttggctattccaagatttcttagcttaggactctgaacatttttcttagacagtagggtcattctcagggtatgcataagttattgctgtcaggtgcatctgccatacaataacattggaaaataatttaacctccttgtgcttgttttttaatccatcaagttaaaattacggaactaaaagagtttaacaggtctttaaagagtaaaattgatttcataagggatgtatgataaatgtcttcaaatacttgagaaactctcatgtagaagaaggattagactaagactgtagaatctctaaagaggaaacatgtatcaaagggttgcaggggaggaggtttcagctttaagtaagaaagaactaagtagccaacaccgagatgcctaccttgagcccagaaggtgccattaaaagttccccatcagtgaaagaattcaagaagagctaagaagaccaatattatgatatagaagggaagcataaactgtaagaagtggtaggctagttgattgtgaaaatctctttcaattctaagattctaggaatcgctactcctttgggatcttctgtgttcttgattgcatttgtgaagctacacaggaccagggaatgacaggcttaaacatcccaggtagttctggaaatgagaagtgatccatgagggtttgattcatgctgcataagcatcattagaatcaccagaagaatatgcatcctagcaacctggttgtttaacctaatgttacctggaagaatcaaagaagacctcccagtttcattgaatgagaggagttaaaaaaagagtcttcaagctgcctcctttagcatcctcactgcagttacaagataccccttttgcttcttagcagggacatggtctcacaagaaacattaagcccaaggctccagagtaacatgtcatatgaacacagagctaatcattattgattccttgggccattatggtaaaaagacattaattaccatcagtgcagttgcactaatgcagttgtaatgagcatgcctttgggaattcccagtgaagggactgctcatcagatgacagcagccagaggggaaaagggtgggctgaggtgaaggtgtccgggaggaagacagtttcattggtctgactctagttacctccagagtttctgctaatctatgcacaagtaaccagagcactctgtgaaatccctttcccaccttttcccattccttagtattttctgttccctatacatagtgtaatagccctgatttccagatgcatcctgtcatatcagatccctgcttactgtactcatctcacaactcttagaagtatgggcttggcaagaccttagcaagagttaaagagtatgtgcatatctctgggatagagggagactctaggctcctacatgccacctctgttagcagaaagttgtcttggtacactcctactttcatttcttatctccaccacttccaacctttaatccacctttgttttttgatagcaattgttagcacttaatgagactctactatgcaccaggccgcatggtaagtggttaacctaagttatcccctttaagccttacaaacctaatgaagtaggtccctttattaacctagttttcactgatagggaaaaacacagaggctcaaaaaggctgagtaatttgctcaaagtcatacctctaggctgaacttaaaccaaacacctttttaaaaatttttatttttaattttaagttctggggtacatgtgcaggatgtgcaggttcattttataggtaaacttgtgacatggtgatttgctgcacctatcaacccatcacctaaatattaagcccagcatgcatttgctgtttttcctgatgctctccctctccccacttccctgcctacaggccccagtgtgtcttgttcccctccctgtgtctatgtgttcacattgttcagctcccacttgtaagtgagaacatgcggtgaccaaacatcttttatttaaaatttttatattactttttcatgtgattcctactatgtgaaaacttggatgactctattgcataatcaaatgcgagttcaagaagtaccaaatttgataatggtatctgtatttctatttacttgtctgtctccagccagctttctctctatatacctgactgccttgttcatggtataccctcttcatacttttaatcttccttttattttatctttacaggtatctgatcaatgtcacttttgaggggaggaatttgtccttcagtgaagatggctaccagatgcacccgaaactggtgataattcttctgaacaaggagaggaagtgggaaagggtaagacatgtctttgacaattcttgagcaaagtagagtagaaatgtgaaattttgcaacacaatgaaggaaagtagtcctttggcttttgtccctagacctgtggagcaagggatcaataccttgatacacaggagaagccatttctcaaacttgcatgttcatttacttgctattttggttaatcaagggattgttttctttgtgtattaccatttattgttgataattgcattgctgtctgaatcttgactttgtttttgtgggagagtatgtgtgtacaatataacataatttggtgaagaaactgaattagtggtatagttcaggagttgtgtcctagagagcatctgggaagcttataaagatgaatttatgagaagaaaggtttagacttattgtgattgaaggattcccatgcaaggctctgctcaatctctcccactgccagttgatcacagtgtttgaaattctaccatcagaaattaatttctgtgggcaccagactgtctaggtccaattcccagctctatgtaggatcttagacaaatctcttcactacttgatgcctcagttttctcatctagagaaggaaaataataataatagtaccaacaggtataaggatgaagtatacgtaaagtatttagaaagttgcctggttcatagtaagcactcaattagtattacaattttttattattccagattcccagttgaatacaagtattcctgagagtaatgtcatcactgatttttctccaaatatgttctgcagtgctcttgtctctcaagacattttgctgaaaaatagctttacagatacataaggttgggagatgctacctactgtttctcactctaggagagtcttggaacatactaacccttggaagttcagaggtgtcttatagcaaagaaacatctttacttttatttagaatggaatttcctaaaattattctaccttgagacccctttgttcatgatattcatattctgtgaaaacatgttgggaaactgatttaagacaacttccacagattccatggaccaattggctgagaatgggcttcaaaatgttagcatagttctgcctagaatggaaatccagctatatatttctagagagagttaccagaaaatgaggccagagataaacttcttgaaattcacaacctcatcacagagagccctggacagctagttatgtgaatgtgtgaatgctcacccgagaaactaggcatgtgtggctcaggcagtagaatccaggatctaattcttcaagttgaaagacctcaatctatcatgcattttctcttatcagatagggcacaattataaggcttaaattatgccagctttttatttaatcttattcttttgagacagggtctcattctgtcactcagactagagtgcagtggtgctgtcatagctcactgcaacctcaaaatcctgggctcaacctgtccttccagctcagcctcccaagtagctgggactataggtgtgtatcaccatgcctggccaactttcaaatttttggtagaaatgaggtctcactatgttgcccaggctggtcttgaactcctggcctcaagtgatccttctgcctcagcctcccaaagcactggaattacaggtgtgtgccactgcgcttggcctgcctgatgttcttgattaaagttgccctccctccactgagttatcatttgttcagaaatggttgttccctgggcttctgcttttcactacaatcaagctgctttcactgctgctgtagagatgtcataatttaagaaatgttctgggttcttcatgtataacaggcacttctgtctgtctctagaagaggaactattaataactgaggcttcataggtagctcataagatgtacagagggggcagctttctttgcagtaggctcacaattactgtctcaagcaggaggaggcatctcacaacagccttttcttaaagagacaccactcaccatcaggtcatattgactcctcttcttgagtccagaatctgaggcctgcatcccctacccctttctagaactagaccctacttcctagggtttggatcccttccctcaccaattctatttttattctagctcttgaatttattctttactttatatatgatccagggactatgtgacaattttttaaatgggcctccttgtccctggtacctgcctttactccttcagattagtccaaaatatggctgccagaatgagcttcctgaagcacaattctgactgtgatgttccttctctgcccaaagccaacttgagccttctatggtttatggactggggctagacttgatctgttcttgcattcaaggctctggtctgccttccaagcctttattctcctcctcatgatttcctgtctcacaattaagctaccctgggcttcttcttgttctgagaatgtgcctttgtaggtcccgtcccctgtacatgtcatgatgtgtcttcctagaatgaattatccaattatataatcataaccatcctttgaaacccaattaaaatgttgcagcttcctcccctcatctttgactgagataaaatctcacactcccttgtcccctatagattttgtccatacgtctgtggtagcacccatcacatctgcctcttgttagagttgtccatatgcaagcttccaaagggcagaggctgtgtctttagctcaattgtgtcctcacagcaacctgtaagggcgtatttcatagagcagttcaataaatatttgtagcatgtatgagaatcattacataataaaagaatcccaaaatctaccattaagaatccaagtttatgttgttgcccttgatacggtagctgttgtttcatggggaggggcaggagaaaatatttgtgtagattgaatttttgtagatcatactttacatgtactaaaggaagttgctgtttaaaggaattctgtggttaatctttttgtagggcatttgggaggggttgagataatagaatagaacattttcatatcgactcaattaacccagggaacactttggaagatagatgtctagtgttcattgaggtcatagagccatgtagctccccaacttgaaggcttctattagggctcacctgtgggcagggaggatggcaggagccaggtgtggctccagggaatggctgggttgtggtgagattgcatcatggaaagttgtattggtccttccactgttatcctcgtccccaggacgtcatcctcaagacgcctaatgctgcttcagaaagtccccttggtccagggaggatttagtgtcagtggactccagggaggcaggcaccagggtgaagattctacagggaggatttgaacactggacagataagcaggggaggaatgtgggtttgtggaagaaatatgggctacagataggactgtcagccactggtcaggccactaactagccataggacctgcttttttcacttttctacatttttcttttctcatctctaaaatgatggcatgggactaagaagacttcttgggtcctttctagtgctaacttctgggactgcaaaatctccttgcaaataaatagcagattggaaaagaaattgggtgagggatggaacacacaggaacctgagcttgttttgaagggcatagctcctaggacatatttgtcattcctgtcatttaagtaaatatttctccagaaaggccctcctaatgacccatgatgaggtagtcaccccgtcacactgtctaacagtagattttaattttcctgaatacactcattatctggcgttttgcttacttgcttgcttgtttgtttattgcctgcctcttcacaccaggatggatgcttcctgggggcaaggaccttgctcacctctgtaattctgacccttcagaagagtgcttgccttcagtgtctggaccactcaaaagataattgctaaataaatgaagaatctgtatgcttaggagaactagaatattgacaagctatttcacttctaccctgaaaatctcccatttagacatagaagtttactggagacagcatgggaacaggtaacttcccctcctctggagtgagcaccccagtgccagggaaggacttggggggaattgtcagggaggcccaactcccagtggagtcatacatgtgtgaccagcttttaacaaggcatctcgggtcaaggaagattaagttgttggtgtgaaccatgtgatacgacttcccaatgttcctttaggttcctaaaagtagtcccaatgctacagtcttacacattttgttcccttgggaagacttgaagtcaacacaacatagtctgtggttttggaaatcagaactgagttcagttctccatgttgccatttatcagctagtgatggatactacctgagtttgtaacatagggttttacataaggctgttgtaaagattcaaagaggttttacagtcaaacatcagtgaatagtcactgaaacagtcagtctccaacaaatgtcaattggtagtcaatacccttcttgtgtaatttttaaggtaatatttgcacatggtaaaaaatcaaatggcacaaaagagtatccagtaaaaagaaagtcctcttctcatctatgaccctttgcttccctctccagagcaatgctgttcccagtctctggaatcctccccagagcaattgttattgccaatttcttatgtactcctctgaaaatactccaaacatttacagatttgatacatttacccaactactttaataaaaaaatgaacagtatctgctcttgtgaacctttaatgggatcctatgtaaggaacctcttggaggcttagggggctagaatagcaaagagatctctggatcagaatttgattcacagaaagccaagaacatctccctggtatgtaggaatgtggagaaggacatttaaaaagaaatattttacacacacatatgcatgcagacatagcatggtgagttggaaagggtagaaatggtgaaaaaaaaaatcattgtgtgcagactgggctcatttgtaaggctcctaagtgggggacagctgcataaacttgctttaaaaatagtctggcacagagatgcagttccaacaagctttaaggcttctgtctctatcagagcctctcatgatttgcttcattgctactgctctctgcttccatttaatcgttcctaaaatggtgataataaaaatgaaatgcagtgggggtgtgctctgagtaatgacttcaagaaatgatgatggtgcatttttgggctctgagatgtaaacagaccttaaagggactgtctgggtcagaattaaaggagaatatgtaagatttgcatctctgcttatctttttcagaaagagacaagagggtgttttataagcccactccctcttccctgcctccacctaccagaaaactcccttccttatgtagattaaaaacattttcagtttgtgtagatcgttctctggactccccaaacctgtttccatctatggctttcaactctgagatgtcacagccacatccaccagtaaaggagagactagaaatgaaagtgcatggcacacagttttgaacccatgatagtactcaggaattaatggatggatcaactggagggaaggagtgcaaccaaaccgagaaaagggagacccccacaagagctgaagcaatgaaaatgtagtaaaacagaatgctctgccagtatctgcagcctggaataaataagacaggctaagggacgctgtgtctctggtgacctcatgtccaggaggtagcaccaactccagggtgtgggggctctgtgatcctagcccctaaggactatggtgatcatagtccacaatgatcaaatcagtgtttatacaatagaggtcaatcactacctctattgatattacttgaaagcttttgactggcaaaataaaacagctcctccatccccgctcatacatattcactcactcagaagaaactggcacatctgtgtgcctctccactatacctctgtgcctagcatggtgtgagacatcactgagcaggccagtaagtgcagtgttggtgactgcttgggcacagctggacagactttgttccacctcccagcctcagaggagaggccaggggatattcatgctctctccaggctctacagaaggcatctaagggggtgaaacagaagctcctcatggcaagcgtgtttattcaggatctcctgataccaccgtttgacaacatgctatttttactgactttgaactgagtactaatatgcatcattggattaagggattagaagacaggatccatggagaaaggctatgggaattggggttgttaagggaaagaaaaaaaaggcaatgaggtgatgacttattctctttaaatgtgtgaagaataattgtaccaagtgtggagatcagctgttcactttctcctctgagacacaaccagagtgagtgggcttaagatcaagcagagagggtttatattagctaaagggagaatttcttaacagagagaagtgttgagtactggaactgttaacaacaccaggggatgactttgaaagtcctcaaaattgtatatgtccttgtctctctgtaatgtacagtcccgtgcaagcaacaatgcgtgaactaaatggcttatcctccctatctccccacctcccctccctcccctccccacctcccctccattccctctccacctcctctccctccccttccaaccgcccctctcttcctttttacttctccttctttctctttccttttccttcttcattccttctttccttctcacacataattattaagcacctatcatgagccaaggactgcccccacaaatttgtatcatagctttcctggtggctgggaaaaacaaaacaagtacattgcaataaaaaaagtgcttgttgtgatgtttaacatttctataaactaaggtgatttttaaatcttactatttgataccatctaacattgggttgatgttcattagtaaagactccattaatgtgtgttttacttacgacaatgacacggggccactggattacatattttgttgtgtttttctgagttgtgattagtgcagaccctcacatccagatgtttccttgttcactgagctccaagagccctggcccatcctgtttgactacaccattctccagggttccagaaagagattacaggaggcagccatggagaggaggaggtagaggtgtgctgttaatccctaaagtctcaacactgctgtaggctcagtccaaaatgtcaagctgctactcccatgcacatttatgaaataattcaaagagaagagcaggatgtattgggggaatagactttggaatatcatttcagaaaggctggttgccttccagtgcttgtcaacagccactgaatgaaaaggataaaagaacaagataaccttggttgactttacttttgaaacctgtacatgctgatggacagagaaagcagaattgaattcagagactgaagaagtgctggcctaaccttggcttcaggaaaaacagtgaaaaggaaagtgttcccaaagccaaaagatggctttcatccatctcatttaaatgttattgagatttttgtttcatgacagttatctgtggtttgtccctgagtcctctaaacaattttttctaatttttattttacaatgcttttccagtactggtgttgaagaagaaagagtggtagagagatgagaaaattctatgtttatatctaggttaaaaacaacatttatgattttcttattatgtaggtaattaatgtttattaaagacatttgaagggataaaataaaatttacccatatctgcacctacaaagaattagcagttatattttaaaatttctttccagtgttttttttctgtgcattctgtgtgtacactgtaatacaatacagaataatacaacagaattggcatcttaatgtatggataatttgcaatctacttttttctcttcctaggatattgaggacatgttccctttttattaaatgtttttcaaaagcatgaaacttaatgccgaatattacactgtgagaatataacatgcttcttcaaactggttccctatgattagacattcatatgcatgttaaatagaaactctggttctcatatgaaaataatttcagagttggtggtctaactgtgatgccataagattgctttttaaagtgagaagatttgtccccttttttttgtatccaatgtccctaaatgttaaaaatgaaaacccttaatttgggaattggtttgtttatatcgattctgcaacaatcaggggacacatatgcagtctggtggaaggctgtcctttgttatttcgggtctgctaggagtcccagagggttttctctttttgatcttctcatacagtgcgctgccttctaactttgttgagatatgtatttcttatctttggtagttacatcacagagaatggggttgtccatgtgttccatgtctgtctgcatttttcatcatgttggtttcattttcttgaaagttgagggcttgtaaaattcagactcacgttcccaaggagtcatatgactactgctcagtatgagaccctttccagcgctgtttctattctgtggttcatacatgacccagaagggagagagcaatgcccttctttcaccagtagggatagaacatacctgacttgctgctatagcagtatattataaaaatacctttacatatttttcaccaaacaagctactttgtgcctatattaatagcatattgactttagctaagacctgaagtttggcattaaagctaaaatacctgattgtccttcatatgcaaacatgcctttattgatctagcacccgaagatcttatgcgttgagtttttcctgcagtgatgatggatttgtaccagccatgcacaggctgtatctccacaatacctatttatgagagctggccagaaacagggtagaaataattcatgtatacaggaagagaagctctgaccttggcatgttaactctgccaagcagcctgtggtacaaacattttaaaggaagtaatagccaacaacaacaaaaaaataaaatttaaaaataataaaagctcttaataaaaaccatgaacataaatttcccacagcagccatagcattcagattattcagggtgattttataattttctctgttagggttatttctgctcataatttggtgaaccttttagtttatcctgacagagatgtcttaaggtggcttgcttaggagcttttctactttccttccaccctccctctctcttctgtggccaggtgtccttcgctgtcatagaggtggcccattgctggttttacaggcgttccaggtcttagttctgtcagctagctgttctgaaggtttaaacttaaagcaaatctgtgccaggggaatggtgagaaagaaagtatgaccctggaaggagaagagtgcacatagaaggcagtcactggggagggagtgatggacctcgaggggaaagaagcccgtgctccactgccctattctccaggtgcacaccacattcctgctcacaccaaacttctggtggatgcctttccatgtttttctagctcaagcgtttgctgtcagatgtcttctgaggtcatcatctttgactcttcctgaaataatatgtactcgtttttcttcattcatcccataggaaaggaagtttgctggcaaaggaacagaatattccctttgaggtaaaattcatagtgaatatttaaggcacctcagcattctctttatagaaaagtgaacacaaaattccattttccctataggatctgggaaagacatataaatgatcagacagtctagcctggaattaagggacattaggaagatttggccatgaatacatctgacttttatgtaacatgttattagcaatgttattaatggacaaatttagcatatatgatcccattttgattcctattaaaatgttgagaaatacttgtacatgtaagtaaattgaggatcagaggtcacatgattttcccaaagtcacatagctaaggagtggcagagctgggtgtagacatttacatccagctccatttgtgtccagtgtgctttttgcctcaatacatggagtataagagtacaactagactaatgggatccaaatgtagcaatgtcaatggggataaattcatagacaagaggacaagtcacactatagaaatgtgcagaccctgctacttgagttttaaaactacgtgttaagaaatggtccagcatctggggtggagctggaggtgtggaggctggttagcccagactgtgactggctatttcagtgtaacatttttctgtgattagcaaaaatagaaggaagaaaggaaggaaaggagagagggaaagaaagataaaggggggagaaagctttcttgtatctttctatacttataattcctgttatcacacacacacacacacacacacaaacacacacacacacacacaaacacacacacaccctctcttttcagttaggaactcagaacctatctcctcaaactgtgaggaaagaacatgtttctttgaattacaaaggccataactacctacagaaacagctgtctaggtcctcattgcatggaagggattttcgaggaaatagtcatcttctgaattaaaagcttttctaaaatcaaccatcatggcagtggcaccgtatccctgcagccccattgatcagacatctgttggaggtgcagagaaatgtcaaaacactgaggggaatttaaaatagctgacctacaaaaacagctcttaaaccttagtgggacagtaacatgaaaatttaactgctttatttgaaacacaagcaaccaaatattttatgaactcaactagctaagggagaggagttttgagatcttacataaaatgagataaattaaactcaattaagttaaaaaaaagtataagaaagaaaaagtaggaataaaattcaacaataagaacactgatcttcaaattcatcattgctgcatcagtgtttcctcacatgtggctgtgaatttcaactgtagtatttgagttaattcagaagggatgagtatttttttgtttaaataatcatctatttttatagttatcttctacttttgggaagtggcacaacttacatttatagtaatgatacgaattttttgatacatatattcttaaagattatttcaaaaattagtataggtggtatacagatgtggcaaaattgttacagtactacttgaatgaatgaaatttgggaaacatttccacagggcaaagtgttcttctcccccaccccagccccaaaatcatggtgtttgaggttgacccaccttcccttccttttccctcctcacctctctgcattcagcctccatgcccaataattgcaactaactattctccagcacctcttgtgcttttatgccttaagccctgtcttatgcttttctcttgaccttggattcttgaacttgtcttttgacacacagttcaaaaaccaagagaaaccatattttggtcacctctgcccagtgcagtgatttatctaaataaatttaaataaatattattccccctttctgtgcctttgtttcttcatctgtaaaatggggattataatagcacctacctcaaactgtaaagttttaattttgttaaaactaaaattataattcatgtaaaattcttagcacaatatctgacatgtagcaagtgctactctcgtgttcactatcattttacttgaacacattttaaaccaatgataatacaaatgaaattagattctagaaaacaggaaaatggaaaaattgaccatacttaactacacaaagacacacacaaactagttgggttttggccttagtcactaacaggaagaaactagaaaacagtatatagatttttgatgtgcctagttataaatttgaaatgagcaagcttttttccttcattctaaaatgactttttgcacagggatttttaaaaggtgagtcttaattaataataaaatactgacaaagtctacagcatagcacagcagcccatgctgggcctatcactcagaaatcaggcaattagaaacccctcagttttgatatagcacattgtgggttctcagtaaccattaaattacaaccaaaacacattaagcaataatcacagtttatgaaaccttatagtgtgtccttgtgctatttgatctacttgggtgttgtttcactgtaataaaccaccatgttgtggttgatcttaaagaattgccaattttccctttatgtcttccttattctgcagcagatagattagctcataaccattaaaaaaaattccttctgcaagggaaagtggtttaatgtcaaaagacatgcccatagtcatggttagtcatagttgaacataaaggggatggcggtgaaatggtaggtgaggggagtggtgaatggtcttaacaacagacaactgaatagcgtttcacagtttacatcagaggttctcaaagtgtggcccctggaccaacagcattagcatcaccggggaacctactagaagtacagattctcagcttctacaccagaagctctagggatgaggcccagtaatctgagttttgacctataaaacataagggccgctgatcacagacatttccttttcacaaggagaagtatctgcttaatagatatttaaggctgccactctgtcattgttctctgttctcattttattttccagccattaattttataataaaactgaatctttatcctttcataaagtggaggacagagccagtagcccagtaagaaaaagttaaagcctgccctactcactccagaagattcttaattacctgatatcttcatgtagttgctcaagacattccctgacacgaggccgattgggtttatgcatttggcgaatattttcccgagcccctactaagggctgggcactattctaggtgctggggaaacagtattgaacaagaccaacaagttcccttcctcaaggagcctgtgtcttggtgagtggggccagacaacaaacatataaacaaatcaatacatatgatcatttcagatagtgccatatacgcttaaggtggtaagacagggtgcagtggctgtcagactcttaaggccagtctcaaaggggcttttgatagatttatcattttaaataagttgctagttaaatttcttcagagtatgttcagcagctgtcataagaaatttcactagcaacttatgtaagaactttccaaattatgtccacaagtcctctgcctaaattgtatacagattctgtgttgaggctacaggcccactttgaggccacaggagaaatatgagtagtattttatctcccatttttttctcgctgctagattttagagaatgggtatggatttatataatctgtcacatcaggctatgaacattacaatatttatgcttgatttttccaaaaaatcaagaagcattaaccttcattgtttaataagaactgcatttagtgagttacctactctagcctactgttctaagtgagcatggcatcttttggctttctttcacagctgttacggaaattacttcacttccttgtctccagttgaccctgtaccatcgaatgtgacacaacatgggacctggtgagggtgtataggaaaggtcataaactggcagtcaacagactacttttgggccatcgacatgttctatacggcctaaaaggtatatttaaagattaaattggtttctaaaatttaaaaattcagattcccatagaactccagattctggatttcctgaaaaatcagaagatgggcaacactgcgttcacattctgcggggccgcctttggttggaatacatgctgtccagttcatctcagccccctgcaagtgtcccacctctttcattaattatctacctagcccctgcagacactggagtttgcaactcctagaacacggatgagttcgaaaaagagtcattccctgcttaaaatctaaaatggataccttagaaatgggtagatttaggattaagggattgggcatttatggagctgacacagccttttgattgctcctgcagtttaccttggagtctctagggggcagctgcgaattctgagcactgccttggaaatgcaagcacacggagcaattacagttctgtgttgcacggaatctccagatgtaccctggaagtgtagaaggcaaaaggcactacttgtctgaagggggttttctgtttgtcagacaatgaaatacagaaatatcgacttttaatgcatttaaaggttttaggcacatgaggagtgtgcatttgtcttttttcttggcagagtaacaaataatcctaactgaaggaacacccggaatggcttcacaggcatgagctttacagagaattggagtgatccaagggcatttacctagcaaagaaaggaaggcttcaacagagaaaaagctcagctagaggactaggagaatgaaggaaaggggctgggtaaatgaaacatgtgaatataggaaaaactgaaattagaaatgaaggcagggccagaatgttgcatcttaaatgtaagaatggaaaactgacagcaattaaaaacagagtgatatagtctaaaagtgtagagagaaagcttgatgattttaagtcatgctatactgattaaactgtggagagagaggaggaaaagcagagtcaagaaaagatgaggttgaagttgtcaaagcagaagagccgtactcaagaggctttgaacagtctggctagaagcgaagggaagttaataatgacaataattacacgtgtatctttatattgtgcaagtgctaaataaggatgcaaaggaagtgcttagtctctttttggcgattttagatcccttcatcccaccccagaagttagaaacacttcatctcagaatggaatttcctaatattcatagaacaacattgaccatatagcatttttctactccacaaagctctagtgaacctcttcttctctgatccccagtggtgtttctgcttttcatgtgaaagcagattctcaaagtccacgagaaggaggcattgcttttgctgcctgtatccagagttagcacttttatcaatcagttagcttcagttcaattcaacaaacctaaactgaagggctcttctatgaaggactctgtgctgggtgctaagaggaaaatataaaggtaaatagacaccctgttctcaagaaatgtacccttttaacagaggggttaagaaaatcacacaggtatgatgcagggaagaatatgatgtggtaggcagccgctaagatgacccccaaagattgtacttcgtgttattcatgcctgtgtgtggtcctctcccccagttatgggctaaatttagcaacttgattatttggaagagaatagtgaagtgatgagatgtcagttttgagatgtgcacatgaaaggactagcttctgtattggggccctctctcttgcatcccttgctctaagggaagccagccacctcgctgtgagcaaccctgcccaagtgacaaggaactgatgtccctgagtagcaacagatgaggactggggcctgcccgctgccatacagccctgtatacagccctgagccacaggacccagctaaagcgtgtctggaagctgaccgacagaaactgtgggataatcaatatttgtgctttataccactaagttttataactttttacacagcaatagataactaataaatgataagacaaaggggcttataaaaagaaattacatatctggttaagggaatcaggaagggttttgagaagaacatgattttattgataggctttaaatgatagggaaggttttagaggtgagtaatattggaagtgaggatgatatttcaggcagagggagtaacaggtgaagtacaatatttgtttattgaataagagtttttttttaaaaaaattgtctaggtgataggtacaaataagggggtagagagacatctttaagtaaagattgagcttaaagagcattagaagcaaagatagtttgaattaactcaagaagcaatcggaagccatgaaatgtttgtgagtgggagagtgatgtgattatgacttctcttcaaaaaattcatccagcagctgtgatggggtgtaggaacttaggtgcctgcaggaatgccgcagtcatcttgggcctgaatgaatgtggacaatcatggagcagaggtggctgcgagagtgatggcagaggtggaataaatctgtaacctactgggaaagatgagacaatgaccactgaagaattgaacttcaggaaatgggacatttatgggacactgggacatcaaaacaaggaacaaaattagtgacggggaagcagtttcatgggttcaattttaggatttctaattctgagttactgttgagtcaggagggaagtagaaatgtcaatttgtggttctggtgtgaagataccactaagaatgcagactgagggatgttctccacggaggggataattgaaggctagtgagaagatgagtttctaacgagaacagaaggagagggaagaggaccaaggacatgggctacaggacatgcctctgggtgggtacagggtaagaggagagagtggaatcagcaaaggaaagggagaagtagtcaccacccaagaggttggtagagccaggacagcctgacagcaaggtgaaggcaggggactttaaggaggagaggaggggatgaagcctgacttctcggtggttctcattcatgcatcattgggaagaaatgcttcacaagaccccaccccatcaaaaacagaccatgccaggcaatcacagaacaatgtagctctgttcttttactcattgtttaaaactcaggcattagggtttttcttgacaatttaaggaatagatggacacaaatatttttacccaaatataaattcttattgttcttcagtgatggatctgtgctcttcaaaatctatgtttttattctccagctgaattattggccgcttaaaagactcttcttaagtgtaagatcctaaagaaggaaaataccttaaaccgtggtcttaaatgtattccatctaattatgaggatctctttttcagaatctgaggaatcctgtttcgttttcatttctcttttatgtaacgatattttgttatttgtgtctgatgtcaaaagtatagcagtcgttcattaaggaaaagttaattagagaagagcatgaagaaaataaaatccaccccaaattcaaccacccagagataatttgtttatattttgatttatatcattttagtccttttatctttatattataaatgtgtgggttggctttttggctttttttttttttagatggagttttgctcttgttgcccaggctggagtgcaatggcacaatctcggctcaccgcaacctcagcctcccgggttcaagtgattctcctgcctcagcctcccgagtagctgggggagtacaggcaggtaccaccacgcccagctaattgtgtatttttagtagagacagggtgtctccatgttggtcaggctggtctcaaactcctgacctcaggtgatccgactgccttggcctcccaaagggctaggattacaggcgtaagccactgtgcccagcctataaatgtgttttataaaaacatgtgggaatatttttataaaattgagatagtattatacatcctgttttataatctataatcacaatatgctgtgaatgatgtcataaatatattaaatcgtataaactaaccatttatctactattaaaatatatgaaatatctaatctctgtccattatctatttagattcatgtatttatcccatgatttttaaatttctgcccctctgtactcccctcttccctgccccccaacacaaggggcaaatcttggtcatagcttattggtctgaacgtgttgtattgatagtaggaagatctggcatttgttggctttgccttctgcatcactcactttttagtgaactgctgaagagcacaccaacaggtgtcagggaacaccaaacacctgcttgtgttggctcttcccatatcgctaacatgaactctgctccttctctaagcaagcactgccctcctgggattcccattgcagctacaaatctgtctcctggtgctttctcttaaatgcctttttaaacatgcttaataatagatgagcacctgggcccttcttcatgaaggggagctctagcagcttttagaacatggaaaagctatttggcccttaaaagctgattcttggaatatccccaattccccaggacaccattcagtaaccacgtgctccaagacaggaagtggttttcctagtgggttttattgctccacttccccttcaccttactttttcaatcctgaagataacttttattgactctttgcagtcagtcagctgactggcagcaaagcaactcccaggcccctctcctgctctccttccctactctggcaatcccatgctgtgtgactcaagcaggacatctgtacttgacttggtgcgattgatccgttttctgagtcctagtatcccagaaagaaatgagtcccttccccttggattatcatgtcttggctttgccatccatctagtgggtgaccttggacaagtcacaaaatgtccctgggcttcggtttccatccatatctataaaacaagagggttggattaaattcttatggtccatctagttcaaacaatctgtagttttaagtacagttttagattttccagtgttctgactatggcgtatttttagtgacatctatttattcattagttataagaatagcttatttttagaacttcatttcttagatggggcagctcagtcacttggttccatggtctttgttaacagctaccttcctgggaaggatgcttggaagggaggttgaatttttccactgtcctctttcttctgcctttttagtaaaatttagtaaaattctcagtaataacaacctagagcagatttcttcagaaccttgcgaccagcgatcagagaaagacctttgactctctttgctttgtgcagttgacttatttgtgtctccttcctggaagaaacgttggtgattcgagtcaggctgaactgcctgcacattggtgtgtcatggttacgtgcacacagaacaccaccagtgttccctaccccactgcaaaacagtctctttttgtttgttcgttttattctgtgatcctagatactgttttacgtgtgaccatttgtctctttctctgtaatcttttccttcaaaattagaaacaatttatagggcacagtgatgctttttttcctttttatattttgaaattattattgtattcaggaactgaatcatatgttcatgctttggttgaccattcattcaacaaatctttaatacgttcctacagtgtgctagattctgttctccaaggaaggagattgaggaagatgagtggagagaactgacaggtagagaagcaagagaacggagagggaaaggtaaagaaaaacactacaggagaagctagaagggagtggaggtggagttttctcaaaagaggtaaggaacagcacagactccatctaaggcagaaggcagaggaaatgaaagtaaggaatcagaaaatttagggagtgtcagccaatccttcttgtaagacaattctctcaagcaactggagccctgattgacagataacaaagtgttagtaatagctaacactataatatgtctacagtatgtcagtatttataggtcaggcactgttctaagcagatcacttacattaactcatacaaatcctcacaacattgctatggagtcaatatttaatatgacaaaaacaaatataggccaacaacatgaggcccagagaggtttagtgactttctgaaggacacagctagtcaatggaagagccaggcgttggaccatgcagtcgaattccagagactatgctgacctcccatgcaccactgaatgtaacacagagaaaggtctggtcccattctcattctattgaggatgcagtggggattaatctgcagtagcttctaagtgtcctaatgcccattttccttctcagtcaattcttaccgctgtaaaattcaagcctcatacttgatgtttgctgacagcaagaatctggccagcatttttgctttagccttaggcatggcttgagtatcatcatgactggttgggctgggtggttctattctgggatgaggtaggttaggagaacaagcttgaaaagatgtggcttttgactcactggttttcttgtacatggaaagaagtataagaattttacggcttttgaatgcctttgggtaatcttgtgctcggtgggttttttggttgaatgttgattctctccaaatgatatgcaactaccaccctactaagtcttaacttctctgggtttctcaaaagtgttacactggcccaactcagggaattactaattcacttcttttactcatagggagaaggctgtggaagactgacatttttcaattccatttcttccgttgaaatattgttttttgttctcctgggttcctgtcctttctaacaggtgtaagcctgtttctcctgcttgtaaaaccttcagtgaagtagccagaacctgagacagaatattatcctcaccctgagagctgttctgaaaccttagaatgggctttgcagaactggaggcaaatctagcttttcctcattgtaattgccattgtaacaggtgaacagagatgccaggacctgagttatctggacaataccacctgagaagagcaaaacacaccagcaggatggccagaactggactttggggcttttagcagtttcatctatgaaagaaaaacagagtcagcactttttgtatacaggaactcagtgaaagtaaattgttggaaacagaaccatttgacgcattggcagccagcagtttgggggagccagtcctaagactgttctgtatatcattgcattggcattaacctgtaaggctattatctgaaggtttaagcagagaccatcagagtcagcaatgggtttcttaaaagatgtgcttcctgtcaagattttcactttggtttttcatatacaaacaagcaaacagaattagttaaccattgttggggtctttcattcttctgtttcctgccacttctcaacatgcacacattttcaaatattttcctagagcttctttgcaaagagcccagggaagcttttctttcccttgccacctcctcccttttcttcctatctggccctgcagtgagcttctcattacacctcttatcataataattccagaaataacatctaccttttctgtcatgcctttcatcggaggattcccattgagccactctagcagtgagggctattcagcagcccacccctggcacagcattcctctgcttttgggtcacagacagaaaatacgggaagcataggtacagcctttttggattttgagagtcagaagggagtgcagaaaggaggtagcagagttgcataacatttttttgtgatttttgacaaaaatcagatacttagtcctaagactggctcaacaaatagaaattttagtgtgaaccataggcctgtactgcagaaaagaggaaagatggacaattaatgttaccaattagtggttatagatgaaacatgcctactgaaaatgggtagagatatacttatgtgaaatagtggatgtaaagctgtggtgttaggtgagctcccaccatatacacttgaagagaatgaaagtcgcctactgagttaatattgtactgtgtgcttccattataattgcccttcctaatgccatttgtgatttcttatgtgtaaatttgttaacttactgacatctctctgacatttgatactggggacccctatctccttgcaactcctcctttttttctgtttaagtctctcctttctctgctggctttttttctcactccccctccccttaccttccatctttactcccactctgccttcccttatttattgatgtactccagggtaccgtttttgatcttctcatcttctcagagacccatctacacagacttcatgaaaaatgcctgtctaaaagtaatgcctttcaaatctgcatagcctgatatttctcctgaacccaacttagatgaccaacccccttcttttaagccttaacttttatgtctcacagagaccccaagcccaccaaactcaaaagttaatgccccattttctcccctctctttccaacatgcttctcctcttgtatcgatgttggcatcacaatctacttaactgtccaaggtagaaagctgggacttgctaagtgattcctcttcctcatctatccatctctttgatctaccatctcttctttattttctcttttatcgcctttgtcattgattgcatgaattactgcaatttccttctttccttgactctaatctagcccttttctaatctatccttcacacagtgtcagatggatcctcctaaaacataaaattattcatgtcagttccctgactaaaactctgcaatagtgctccagtgacatcaagatgaaaactcaaagccccgctaaggagcttccatttctattttctttgttaacagctaccttgctgggaaggatagttggaaaggaagttgaatttttccaccgtcttctttcttcagcctttttagtaattctcagtaataacaatctagagcagctttcttcagaatcttgctactgagtgatcagagacagacctttgactctctttgccttatgcagttgaaccatttgtgtctgctttctgaaagagacattggtgattggagttaggccgcctgcccattggtgtgtcttgcttgcctcttccttctctttttccataatttcttaacttatacccatgcataataaattgattatggttctttgaatctaccataccttcctcacctccttgcactgcacatggtttccgctttgtctagaagggccaatattcctcctcctacatcagactgttagcacttggctaactcttcacagttcttgaaggctcagttcaaatgttgccttctctggcaagcttttcctgacttctctgcggcctccattagaaacagattaggtgtttccaaactaaccaacacacttcatccatgcatttattacaccatattgcacttgctcatgtttacttgtacctcttctccagaggatacagagagcctctccacagaggctgcagagaggtcaggaaaagcttgccagagaaggaaacatttgaagtgaaccttcaagagtaatgaagagttagccaagtgctaaagtctgaggtaggaggaggaaaagtggcccctctagacaaagcagaaaccatgtgtagtgcaaggaggtgaaaagggtatggtagattcagagaaccataatacatttcttatggatgggtataagttccctagagtgggaactgactctttagtctctagattcctagtgcatgatgcagcctagaacacagtaaatgctcattaaatgttaaatggatgaacagatcaaatcctgttctcatttaattctcataacgcatcttactggataaatattatcctagttttatagatgaggaaaccaagatctggagaggttagatgactttttcaggattacgcaaatatcaagtcagagaaacgtggatctgttcaaacctcatggacatttcgcatagaccactggactaatttctgtttactggcactagaaaacaacttctgatataggctgttttctagcttagttatgagacaggtagagaagggttcatattaaggagttagggttagagttacactgagtgggaaatatcagcaatggattctaagcccagtaaaatggatggacattatacttgccactatttcacttccagaatttctacaaacgcctataaaatcaacaccagccaatcaatcagctaatattcattgagccaccattttatgctgaatataaaggtagtggtgctattttttgacaaagtttacactgagatatttttctttcccgtctcatctctgtttcttttcccaaaataattaaacttctttctagattcttgtccccactgggttggggacagatgttggaggccccgctgtctacacatggctgctgattaattttattgaccacatgcctggttttaatgcaggacagactccactatcaaagaccattcctgggcccacattgcccttgtcatttcttctcttttctaccataggccatccctgcctgaggtactagaccttgggaagatataagccatcttaggccttggcttttgagacaatcagatgtattcttgctatctctcttgccccttttcttctagcactggcaggtatgcttcaaattggacttccctctcatttagtggaaagatcccagcacagatttgcaaggtagaagagcagagagtaagaggccatatgaagtcctttaggttaaatggtattctctaactcagctttgaccagagagttctgcattcatttatttacttaaaaaagtttgttcagcacctactatgcaccaggaactaatctactactcgagcaccagggttcagtaacaaaaaagacaaaaatgtatgccttcatggagtattcattctagcaggaaagatagaaaatgttgggaataagtaaattatacaatataattatacatcatacaatttgttagacagagataagtgttgaagagataaagcaagggaggaggtctgaaatgttacagggagtgtgttgacattttaagtaaggcagacctcattgagaagatggattaggagttactgaactgaatgaggtgggacttttttcccccatttgccaattgatgttcatgggatataatttcttgttcagaactccagcagaaagaaagggtggctggtcgtcctgaatctctaccttttaagatttcatgggtaagataaatcaacacacatgtaaaggggattttctatcatcttagtgagaaggcacacactatggtctgctgaattgtaagtgagtgagagaaggtccctactatggggacagggcagacttcctgtgatctgattggtgtcctgaaagaagaagagaatttacattgacagaggggaggaaggggacaggtttcaggcaagataatgctgcgaaggaaggagggaagcacatgactgggcatgtggagaaggcatgtggaatactttcatatgaagggagtgtccacatggaggagaggaaggagtgaaagaccaaggttggcataattattgggagatgaagaatatcaaatgcctagactctggagggccttgactgccaagccaaagagatttcttcctctttctgctttgttcataaggcaaactcttccaggaaccatcaatcgaaggagcctgggcagtgcagggcatctaccacacagcatggtgtatagtggctgctcagtgaacacctccgaagcttctgttgaagtgaattgctggttctctagaaggaacatagtaatgtgtatagttttcaaattcttaatcatgtagtttatgctcacatagaaatgttaaactgttagcgctagaagggtacttagaatatgtatcttcatccttctattttgcacatgagaaaaccagggggccagaggtttgaatgatttagtgcaaggtcataccacttagttatgcagaagatggggctcatcttccagattattttccaagcagcttcttctggggacattttcccaaacagtctggtgtccactggtatgatatcttgatataaatatcaacttgtattcaatggaccctaaccccatgtgatctacaatgaaaaactggtttctatcaagttaacttgggaaatgctgtctattatattatcatctcgaagagttaaaatgcacattaaaaaatgtaggctctaagattcctgtagtaaaaaaagttgcttaatttcactatagcatttatccaacatattttactatgatttaattttttccctgaatacctgtaatcttgtggaagtgctcataggaaccaattgtaagctgttctcagcaccagttgacctcttgctaaaaggaaagaagaaggtatataacagagaagcttcagccgaaaacctaaaacactcaaggaaaataaggcagtagagaagagcgagtccctcccacttctatcttctgtcttctctccctgcctgcctttgttccttcctttgataaattacttttgagcatctactagatgcaaatcctcatgctaccggcttcacatacattatcttgcttattcctaacaacccctggcaagatcagtaatattccctccaaatgaggaagctgagctcagaggtagcagggaattgctcaaggtttcacaattacactagtggcagggcccagattcaaaccagtgtgtgattaaagccagtatttttgtccattgtgctattttttcccaggctatttcttcttatccctctttcttctccttctctcccttgtgatgtcaaccacacatagcacatatgttaaaaccaatatcctaataaattaaagaagatactggaccctcaaggagatgtaacaataaggctcctacagctcctatgcctcttaggtatttaatttagcatgtaatttagtattccttaactagatcacaagatcctccagggcagagatttgttatacttattctaaagtcctcactccacacttcctgtgattgccttctgcttggaaggtggagatgataaaatccagaaatgttcattgaactcatggtcctttcaactggaccctgcctattgtcaaaggcgctaactgcaataaggtctttcatcaaaggagaaactgctttctctgtggcagtgggaggaaattttaaatcctaggacttcttatagcaagtgacaccttgccccttaagcttttcacacctgctgcctggtcttccaagtgacttagtgtcacctacttggctgcgttaaagccagtgccagctgtgcccttcatcattgcttgctccaaagaggctaattccaaatgtctgtaaggttgtttagttattaatgtttatacttctctatgctactggattagatactctaggagggtgagagctatgtaaaactcaccctgtgtttccctcacagcactcagccctgggcctggcatggaataagttctcaactgtccgttgagctttttctgaaactgtgctttagaaattcagcaatatgatagactagatagagctagggtttatactactccgtatgtgctctcatgtaatttggcatgtcaatattttgatacacctagtttattactgttctagtgatttaactgtggcccatatataatacagtccaatttggtccaacagcagacaggcccagccaagcctcaccaatgaattttcagcctttataatccacatcaaacagacagcccctaagatatctcaaccaatgctctctgactcgtcaagctcaaagtcatcccactgccagcgtcctttcatccaactgaaaccaatagtattgaggagaagctgcgggattcattaacccagagcatggaaccttattcataggccctaggcttctgcctctggggtattcctggtgagaggctcattatttgtgaccctcagagctttttcctaggtggagcagttatcttttggaagacattcactgaattccccttttgagtgggtgtggacctctcttcaatgctagtcaggctacccctctattctattcagcccctttcctctcctcctctccgctctttcaggggtaagaggtgggcagcattccttaacacgatggccagggaggagggcatggggagaggaacagactacttcaattatttttaacttcaagaccatatacattatgggttcaaaatcaccagaagtcatattgtaatccatacatagttatattcagtcaacaatgaaagttaatgagaagagaattgtggaaaagcaacatggtggattggacagcatttaacctttgggcttcaggaggacttaagtttaagtatgagtcctgttgctttatgggttgtgtgaccttgaacaaacttactcaaattatcaaaagctcacatacttaagttctccaaagcttaatttcctcttctattaaaaagagataacaattgtattaattttctattgctgcataataaatttccatcaacccagtggcttaaacagcacatacttcttatatcacagtttctgggggtcaagactccaggcatgtctttaactggatcttctactcagggtctcaaaagatgcaaccaaagtgtcagccctgctatgttttcatcttgaggcttgagtgaggaagatgctacttctaagtgtctgctgctcattggctgaattcatttgcttgtggctatttggctgaggttcttactgggtattgactggaaacaaccctcagcttttagaaaccactcacagctcacagctcctggccatgcgaccctcttcataggtagttgacaaatggctgtttacttcctcaaggccaagaggagaatctctttctcaagtgtgttaagaagaaattttgtggctgggtgcagtggctcacacctgtaatcccagcactttgggagctgaggcaggaggatagtctgagcccaggagtttgagaccagcctggatgacatagtgaaaccctgtctctaaaaaatgaaaataaatacggaaataagagaagaaggagaaggagaagaggaggaggaggaggaggaagaagaggaagaggaagaagaagaaagcgaaagcttatataacatgacataatcatgggagtgacattatatcacctttgcgattaaaacataacctaattaagggagtgacattgtatcacttttccatattctattgtttaaaagaaagtcacagggaggggattacacagggcagtaacccagtgtggtcccctttgggtgtatccacaataatatctaccactttttattacagtgaggatttaaacagctgatgtatgtaaaacataaaaggaatgtcagtgcctttattcctgtatatgggagacacactaaggcaggtattcttaaagaagaggagtcaaagacagtagatagagttggaggaagagaaatgggtaataaaagaaaagcttagcaaggagagtgcagatgcttctattccaaagcttgtcattagaaatgttgcatatatgtctttgaattactttttgtaaatcagggagagaaacttcctatcactacctctcatatctgccgctgtatccagctcttcgtttttgttccaggtagcagctgttgtagactacttaccagtgaacactgtctggggagttaagaaagaaaaactttcagtgtccaaggtgactgactagaagaatataaatttatgtggtgaaatgatgcctttgagtttcttctaatcattcctctccaatttacctctttctctttactcttccccagattccacaactaagtctttaagagtcacccccttctctttctgttacttaaacatttatttatgtagaacttgccttgagggaaaatgcgagtgaatcagagaaatcagtgaattggacaggagaaatgctgaaggaggtcagggaaaggagttgttgacatcattccctctacctagaggcctaatcccatatcaagtgggaaagaaaatgaaaaactagggtttggagagaaaaaaaaaaggaagaggaggaggagaaagaaattgtttatttctctgaagaaattagcacaggcacacctggttttattgtgcttcactttattgcacctcacagacactgtgttttttacaaattgagcatttgtggcagtcctgggtagagcaagtctacagctgccattttcccaacagcatgtgctcacttcatgtctctgtgtcacatcttggtaattctcacaatatttcaaactttttcattattattatatctgttatggtgatcagtgatctttgatgttactactgtaattgttttgggatgccaccaaccacacccagataagacagcaaatttaattgataaacatcttatgtgctctgactgctccagcaactggcctttctcccatctctcttcctctccttggatctccttattccctaagacacaacattgaaattagtccagttaataacccttcaatggcctctaagtgttcaagtgaaaagaagatttgcacatctatcatttaaaatcagaagctagaaatgattaagcttagtgaggaagcctcatggaaaacctagaaaggctgaaagctaggtctcttgtacaaaacaattagccaagttgtgaatgaaaaggaaagcttattgaaggaagccaaaagtgctactccagtgaacacacatatgataagaaagcaaagcagcctgattgctgacatgaagaaagttttcatggtctagatagaagatcaaatcagccacagcattcctttaagccaaagcctaattcagaggaaggccctaattctcttcaattctttgaaggctgagagaggtgaggaagctgtagaagaaaagttagaagttagcagaggttacttcatgaggtttaaggaaagaagccatgttcataacataaaagtacaaggtgaagcagcaagtgctgatggagaagctgcagcaagttatccataagatctagctaagatcattgatgaagtggctacactaaacaacagattttcaatatagataaaacagccttctattggaaaaagatgccatctagggccttcatagctagagaagagaagtcaatgcctggctttaaagctttaaagacaggctgactctcctgttagggactaatgcagctgatgattttaagttgaagccagtgctcactgacctcttccaaaaatcctagggcctttcagaattcggcttaatttactctatccatgctctatcaatggaaaaacagggcctggatgagagcacatctgtttacaacatgatttaccgaatattttaagcccactattgagacctactgttcaaaaaaggagattcctttcaaaatatcactgctcattgacaataaatacatctagtcattcaagacctctcatgtggatgtacaaggacattaatgttttttcatgccagtcaacacaatattcattcaacagcctatggatcaaggaaaaattgtaactttcaagtcttattatttaagaaatacatttcataaggctatagctgccatatgtaatgattcctctgatggatgtaggcaaagtaaattgaaaccttctggaaagaatttgcccttttagatgtcattaagaacattcgtgattcatggaaggaggtcaaaatattaacattaacaaaagtttagaaaaagtttattccggccctcatggatgactttaaggaattcaagacttcagtggaggagttaactacagatgtggtggaaacagtatgagatctggaattagaaataaagcctgaagatgtgactgcattgctcaaactcatgataaaacttgaggaaatgaggagttgattcttacagatgagcaaagaaagtgttttcttgagatgaaatctattcctaatgaagatgccataacattgtcgaaataacgaaaaagaatttagaatattacataaacttagttgataaagcagtagtagggtttgagaggattgcctccaattttgaaggaagttctgttgtgggtaaaatgctatcaaataatgtagcatgctacagagaaatctttcatgaaaggaagagtcaattgttgtggcaaacttcattgttgttttattttaagaaatcgccatagtcaccccattcttcagcaactactaccctgatcagtcagcagccatcaacgtggaggcgagatcctcctccagcaaaaagatcacaactcactggaggctcagatgatccttagcattttctagcaacgaagtatttttaaattaaggtatatgaattgtgattttagacataatgctattgtacacttaacagactacagtatagtataaatataacttttatatgcacttggaaacaaaaatttgtgtgacttttttatcataatacttgctttattgtggtggtctagaaccaaacctgtaatatctcctaggtacacctggtactaagaatttgacttcttcaaaattattcttttccagactcagattcaagtatcctttagaaaatagcctttatatatttcctaaagaaaattatttacacatttccagtgtaagaaattttagaataactttcgtcttcacagactaagttgatggtcattcatcattgaaaaagagacagttctctattgtgtggtgaggcctttaattggttgctgctataattgatggtgtattcttttgtggcatatactgagtttgaagaataagctaggtagccatgcaatcatagcataatggaaagatttcagaactctacgtcccaaaacccaaagccaagccccaactctgccaaagccagctccatggccctgagcagtcactaaaccagtctgggcttcagtttcctcatttttcaagtgagaattctgaaatatcatatcggtagatggggacctcatgagaaaataacagttatcagagtatctgacacataaccagcattcaaatatttgagcacgcacggagaaggaatgcataagcaaataaacatgcatttttggcaaatgaattctaggcaatatgcaaagctagtctaacttttacttcttaaatgtgtttgaagttgtaatcttatatgtaagtgtcatgggaatgcttataatcaaagtatacatgtaataattagccactgagaataattagcccttaagagagagtcatagcttcttggatctggaaggcacatttgatgaagataaggtctaggctgagaaaggtttggtgactcacccaagatcatacgctgaatagcagagatggaactagaagccagcaccttgcctcctacttagtgctccttcagcaaggcagagtgtgcccacaagtgattctcagggaagaatggtgaaaataggtactgactttcataatcaaaataatgagttggggtttttttaagttacattttagtttagtttagttagctagcttgtttgtttgtttgtttgtttgtttgtttgttttgagacagagtctcactcttgtctcccaggctggagtgcagtggcgtgatctcggctcactgcaacatctgcttctggattaaagcgattcttgtgcctcagcctcctgagtagctgaaattacaggtgtgcgctaccatgcccagctaattttttgtatttttaatagagacagggtttcatcacattggccaggctggtctcgagctcctgacctcaggtgatccacctgcctttgcctcccaaagttctgggattacaggcatgagccatcacgcctgaccttaaggttacattttgagaatgactttgattaattaaatttcacttgtatagaaatacagccttgaattgccaaaaatgttaaaaattctagccaagtaattccagatgctgaagaaggaggcctatattttctaaactgaacttcattaaagcacctgcctatacatttcctctaatgagtaaacactaaaaatggtgctgcacagggctcagtcctggattcatttctagttaagatgatcatccatgactttgttaccgaaacagcatactcattaagttcatagatgagactgaatttaaagtgtaggctaaagtcttgggggatgcaattagaattgaaaatgacctcaacaaattggacaagtaatcagaaactaacaggatgaagttcaataaagacaagggcaaaaggaagtcaagaactcagagaaaataaagacagagaagtataagacatggaaatggcaagtcaggctgagagctacccaaagatacatgggttaccatgaacctcaaattaacgatgcaaggctgggcccagtggctcacacctgtaatcccagcactgtgggaggctgaagtgggaggatcacttgaggtcaggagttcaaaaccagcctggccaacgtggtgaaacccccatctctactaaaaatacaaaaattagctaggtgtggtggcaggcacctgtaatcccagctacttaggagactgaggcaagagaattacttgaacccaggagatggaggttgcagtgagctgagattgtgccaccgtctgggtgacagagcaagactccatctaataataataataataataataataagcatgatacaattaagtagcagggtttagcttatattcagagttctatgttttctggaaaggaaaactatggttccgaagtttttatggaaggtttataccctaaatggttcttctcacaacagagttgtgtccaccaataagtaacctggtgtaacaactaatggttactattgctcacaaatttttaaaaacttcaaattttttttaaacctcattatcttctggttacttgggtaggtaatgagtgctgtccttacctactcgacctaggctccatctcaatcacacattttggttcctgcaggtacagggaaatttggctatgccttggccctaagcttctcattcataatagatagttcagaatggttcaaagtatttaatagtgttgttattacattttttagaatcagccatcactgtgatgcttgaacgttttgtcaacatgcaacattctgtaatgtctagttatttctacttaaagccagattcggaataaaggagcatagaacatgaggagaatccagtcaaagacaaactatacaatagagagggggaatgaattggatgctgagccaggaccagagacaacagctatggggaataacagacagaaggcaagatcaatgtgtgagacaagataggcttaacaatagcagggcaaggggcagtatggaagcaggggttttgactatcacttatgaacgtcctacttccagataaagtcctaaactgaatctacacaggctatctcatttaatattcagatctacatataaatatagttgatatctacatttttttctttttggttattttagagacagggccttgctctgtcatccaggctggaatacagtggcatgatcatagctcactgcagcctcaaactcctgggctcaagcaatcctcccacctcagactcccaagtagctgggactacaatcatgtaccaccatgcctggtcttgtatctacattttacgtctaccagggcctggtatccctcttcctcaaggaagtgcagaatagttatttttccaatgataccataagtggaaaaactagcatttgaaccaggtttatgtgacttcaacatctctattttttcaactcaactgatttgcctctaaaagtgtaaaaagaagaagagaaggtgaagagtaagaggcggaggaagtgaaagaaaagaacatgggaaatttaataagggaaagggatggagagagaaaaagatgaaaaagaaaatgagtagaggaaggagagaagaaaagacaaaagaagcaacaataggataaacaggtaagaaagagaggaaataaaggctccagtgaaatgaaagaaaagaagtgtggaaccccagcagaggatgcagtatgcttctgataagagcattctgagtgctgatcaggtcatctctcttctggggcacattatgcttttccaatcttccttgagtactgggtcctgttgagaactgcagaattttcaggagataaaaagaaccttgtgaatgtctattggaaatcaagagaatgattataaggccagtaagtggaacacgtgtgggaacgtaaaaggagatgggacattgaacgttgagaagtgacctattaatggtcttcgggtatgaaaaagctattaacacagggactgctgaaaactgcaggatttatctggcattagaactgacctcttcagtgtctatgaacactgtgactgcttttactgcctctaccactgcagaatctttgtatttttatgacccatccaagcgctatctggcactagggtctgctgctgactggttgccacagtctatgaatcaaggagcattgctcctgaaattctgctgggatctttagtagaatgggcatgatctaaaccagactaccttgcctggaaagaatatggctttggtagagacaattggatttgatgttttgacactgcaactcattagcccaatgaccttgggcaactcaacttttctccctcctcagtgaaatggagaaaacttaacttagctcactgtgtatgcaggccttcctcagggcttgagagataggaagcattccataaatgctatttttcatttcctttttccttcctctgaggtacaacaaacgtgcagagaggggctcatcttcaccatgggttgtcataattagggaaccaggagtaaggtaactggggtaagaaatggggtaatgtccagaaaattcagacccttccatttccatagatggagtaggatggaatttgccatgctgaggtcaccaggaatacacagttctctgggtaacaggacttcttggaagcttccgccaaccttattttccaagcagttttttagtgtcaagggctgacatctgtgtcctaatacttacattttgaggacagaaccattttgaaatgagagttcaaacagagatggactcatgtacctccagaggtacattgaatttgcaagtgaaaaagatcctttcttgtgttttgagtaccagatggaaaactgaagcccagctcttgcctgtctttggaaagcatgacttttccctagtgatactttctacagtccatggtcagtgctcaagggctgcctctgccaataacccccttctgtttgcatggacatttccattcacattcattcagtatgtacttatgcattcacgtggacatgtcttggttttggtttacttcttgcaaaaacaaaaatcactgagctcaaaatcctttaattatatgattgttatttccaggtattgtagggactagtctcttatacgacttttctttcagtaaccttgtgaacaatagtgtgaaaaacagggtcaagggaggtgcccttgtctgagaagttgtctcttgtgtacttaaaccattggaaatgagcttttgcccagtttctttgagcagaccttgtttgtctctttgttttctcttatgttgtctttggctcaggtcaaggagtacataactctcaccatctgggacagcagaaagatgacagcaggtttttctgaaaagtagaaaccttcctttccacttgagtgagaaatctaatctcgtttcttttaaatcccctttgccactcagacacataacacttatttgcaggtcagtaacagcattttggcctagactcttaaccaagctctgtttgagttggtgaaacaattcactgattgttagtaaataagtaaagcctgggccttatttatatggtacacaaagtagacagtaaagggagaagaatgctgaaatagtaggtggatgatttgaataagtttcttaatagatgcagtttctctctatattctaagggtatagtgtcctaaatagagaagaaaactagtaaatcttttcatcagggtcctgcttactattaggttatgaatgataataatttgttagcttaggtaaggccctgtgtcgtgattatcgttatcattttgagaaaattctgactactccatggactattttttgctgcaagtgcaaactgtatggaaattgtgacatttccattcactggttggtgccaaaacctttactggtgatggaatatctcacttaagaagacaactgatatttttcttgaggaaatgtacacaggtgtgtaattaaatttcacactgtccttttctatacttacattttttaacctactcaacatgggccatgagtgttatgattaaaaacatacaaaggggaacagtgagcataataaccaatggaggttcatccttcaggtttccactgaaacatcagttacctacatctagattaattcctcttcttgcatactaccctgcaactctgcctattttctctttagctctcaaaactcatataatttctcatctattgcctgaatttggccaatgagtacaagattataaaatccagtctttcaacttgcaaaatattctaaatgtcaatgtctctcaaatttgtatcatcagttttgaagcccagactcttatgcccacctactcattaatatttctactgagatatatgataggaatctcaaacttaccttgtcccaatacaaactcttgattttctctgtgagtctgtttcacaccctccatgttcctcattttaggcaatatttattgagagtttcctttactctagatgctgctctaagtgctttacaagtattaacttgtttaatcttcatagcaaccctatgatttaggtattattaatatctccatttaacagaggatgaagctgagattcagagacagagatacagaggtcatacagttcatcactagcagacctgggctttgatttgaagctgtctggtatcaataactgtattggccacagcctaatcactgttctgcccaggatctgtctcagtaaatgtcaccaccattcacccagtggcttgggcccaaaacctcagagttatcttcgatttctctctttctctcaacccaatatcaaattcattagcaaatcctcttatctccacctgtcaaacatatccagaaagtggccacttcacactccctctattgccatcatcacagtcacgtccccatcacctgttcccttgtcttttgcatccactcttgctccccttagtcaattcctgtgtagcaaccaaagtgcttctttcaaaatgtaatagtttgtgtctgctatttgctcaaaaccctgccatgactttccaccacatacagaatacccaaagccttactatggctgcaggcccagcatggtctgtgtcctccctatctcaccagactgattttctgccactcttcccttggttcccccaaggttctccagctatactagccaacttgctattccttagacactccaagcaaagccacatcaaaagatctttgcccttgcagagtcttctgcctgaaatcctctttcttcagatagtcacatgacattcactttattcaagcctctgctcacatgtcacctctttagaagacttttctgaacatcctgtctaactcccatcacacaccatcctctttcccacctttaattatctcaatagctctctctagctgatattttgctatatatttgtttattgtctttctccctcactagaatgttctggagggcagggactagtttatcatcactgtcctcagcacctagaaaattcctgactcctgattgttgcgaaataatacctgctgaataaacgaaagaagaacttatattctaattacacatgtgaatacaggcaacttctgcctaagcttaggtctccatcataaaatctgtgaggtataaaatacctttctcagcataatgtagaggaaactccaatacacactcatttcttcactgccactaactgcctaaatgaaacagaatgccttgcttaaaacaagcaaatggctagattcagggcaccaagttagaaagcccaggttcacatacatgctaatccttctgtgcttgtactctaccttttgattgctacttacgtctgctatttccaacagagactgcagacactgggtgtctgttgattccaattagaaaattgtcttcattgcaaagcagcagggggttgtagtccagatgtgtgtggcatttccatcttcctctgctcctcccaggaccctaaactagtaacatggtgtctgggaaagtgatggaagagtagtgagagggagaaatgagataagtatccattcttcacccagaggagcatttaaaggcatctattgatttcccttcctgtagaaaacaggaaaacatcaaaaggccccctctccatttccagctgacttggtttcaccatctccccttctcagtgtgaagaggtttcctcccattttcctccacagtctacgtttctcagcctcctctcagcattaatattccatcagaccccagaatgaacactccgagtaaagcagtttctgtcctgccttactggaccctctgttggcccaggcacctgaatgaaatctatcactctctgggcagtgccagcacgaaagtgatttccatggattggcactaagcagtgaagtattgactaaaaagaagaacacaaagaggttaaagatgcatcatttgaagattgttacccttctcttgctgaattttttcatagcctcccaataatgctcatccttggaatgggctatactgcccagtcttcagtaaaactctaggaaaaatcaagaaagtagcaacgagttcagataacaggatcctaactatagcaggatcttcagaagttactgtgatagtgagaaacaatgaaacaacacatgtgtaaataaataaaactgtcccccagcctcacacaccttccccaaccatgcccagtatggcagaaactgttgggtacttaacaaaatgtgtttgttcacctttctgggtatacagatggactctatttcccatttatggtgaggtgtggccatgtgatggacccgtagccaacataatatgggcagaagtgatgggtgtcacttcaaagcttagcccataaaaccctcccctgacagctcaactacgctccttttgtctctcgctagttggaatgcagacacctcctagggactttggaagactcctgttgaagatggcagagtctccattggcttgggttcccaaatcactgcttagaaaaggctgccctgccaacctcaatgtggttacacgagctagaaatgaaattctattgtgttggaattataatacatttcacagactatttgttacggcagttagcctaccatagttaatacactggaagttataacgtctttctcaataagtgtatttctctttcctcagtttcattacaagctcctggaaagcagaatctgtgtatcccctaccgtatcccctgcaggatctcatacagagactggcacaggacacataattagtaaatacgttggtcagagagattatgtctaccttttattctggaacatgagtaggaacatggccaaatcatatgggtttttcattttgctttgaaatccatcttgggtgtgaaggatcttttatgtatgtatagcagctcaggactggcatggtcaacgaagtgtgacacacattttttattatccataaatggattatctgctgtgacccagctcttccatcattccggcacattcctcctgtcagcagctgtgtcgtaggcgctgagagggaccctgagccaagggagaatcagaaacaggtggggtgggtttgggggtgggtgctggtgttactgactgggtatgagttgtgaatacatctgcaagtcaaataaaatgttgattatcttttcactattatatgcatcttcttattaactattatgagacataatcaagagttgacaattgaaagatataagttaagaccaggtaggagcaaatgaaactttttcaagtcaggaatatattagtttggcatgagctctctttgaggaaacaagagacattttatttctaccagctggctgcaggtcaggcaggcgatacctggtaaatattaaaatctttgttgtagaaggggatgagttttaccctgcatccttgattactccaaagtaaacttccagcctttatccttagtggcacaggccagtatcctcatgaacacccctaccaccattacctcctacttttctccctgtctccaaagactcacttttggaaaatggttgtgtaaaccagcagttctcaaacattagcatgcgtgaggctttgttaaaaccagattgctgggttctgcccacagttgccaattcagtagttctggagagatgcctgagaatgtgcatgtcaaatgatgcccatgctgccggtcttggggccacactttgaccttcactggtctaaacccctcaacctcattctatatcagtgaaggaatctacaaacatgcacaagtgcaacagccttacaaggtcaaggatcccagcacctgggagtgactttatgtgacttccctttcccatgaagccagattgaggctgtgaaggaggagtggagttctcagggcagctcagtgaaatgtcacctgacagcagggacccacacagtctctcttttgcttctccaaatgtgttccctcatttccccactaggaaaatcaataggttgccacagatgtgtgggtctcaattctggtgcccattagaatcacctgcttagcgattccaatataattggtctgagataggtcctaggtatcagcattttaatcacattacaggtgattctaatatatacactggttgaaaaccacagacgttttctaggtcacttccagatctaccagtctacctgcacaccctccctccccgtggaatcccaccttgtctacctttgcttagccctcaaccctccagcctagctgaactctttgcccttacctctctccacatacattatattccattcaccctgggacacaaagttgcttcaaacctcattaacttccctgcttaggcagaggatgagtcccaaacaactgcagaaattcactgataaaaatatagacaacaaaataggagcagttctagaacccctgtgaaaagttaactgtggaagcagtgggggaacccattcctggaaagtaacttttactcataaagtcacacctgagcccgaagagtacacattacacttaatattggctgcatattatctattctcctgggctggcccaaccccattttgtggtgattcctgcagattgacatgtactttctatttacaagtgactcatgtgataacatttctgcaaagatggtggcttttgcctgataggaattcaagtgctaccttaattttctgttttacttatcttggtacagatgtgaacttaccaactgttagcctaacttactttcatttcattctcttttgtaaactgaactggaagcactggaaccttcttttctgaacttcacttgaagctttggttggtggagattttccagttgagttgtcagttttaataaggttattgtttggggttttgttttctttcaaatggcttaagttggaggggaagtctagtaatttaattctaccatgtggtctggccatgaacccaaggcctgaggactggtgcctttctgctaattaattctcgatgtcagacatctggaaacccgccttttctgcctcatctgagttgactaattaattaagctatgtttgtaaacaggcgttttctcctcagcacttctttcatcatctgtttctttagccacaagctggcgaccccatttaatggtagactacctggccaataattctgttcttgcacaggctgtggaggttcctttaggaggccacttagcactgtgcaagcagcccaggctttggagtgaggcaaatcaggatttgaatccagttgagccatttattaattatgtgaccacaggcaagttacctggcatcttaacatgtcagtttccccattttctccctgcaaaacctaccacttagcccagtgtctggcacatcatttgttactctctaaacactgagtatttttcttttttttcttttctttttggctggatgggagcattcttgccaacttccttgcctttgtccagggagtagctagtttcaaggcacttccacaaatattttcaccttagtttctctcaaacctatatgagggtattttggcaaatgtttttaccctcatattttacagttagagaatcagtctctgcaagtttatgtgccaacatcccatgggcagtcacagacagggcttggccaggtcttcatgctcttggcgaaaatctcttgctttgagaccagatatccgcctgcccttcagtggaggatgtgagactagattataaacactgggaggaaaaagttgcacaagatatactgagagcacctgatatggtttggctctgcgttgccaaccaaatctcatctcaaattgtaatccccatgtgttggggagggacctggtgggaggtgattggatcatgggggtggcttcccatgctgttctcatgatagtgagggagttctcatgagatctggtggtaaaagtgtttgacagttacccgctcctgatctctctctcctgctgccacgtaagatgtgccttacttccccttcgctttccaccatgattttgagtttcctggggcctcctcagccatgcagaattatgaatcaattaaacctcctttctttataaattacccagtgtaaggtagtactttttagcagtgtgagaatattgctgtgtaacaaccacctcgaaacttagtggcctgaaacagccatcattttattactcagccttctttgggtcagcagtttgaattagaataagtttgaattagtggtttttgggttggtctccagggggtcacttatctgatgagtctaccaaggctgaaccatccaaaatggcctaatttgtgggtctagtgttggtactggggatcagatgagcctcattctacgtttggttgtcctcaaggaggctggcccaagttttttcagcattgtcagcaacattccaagaggacaagacaagacccactgactatcgctcatccaagtctctacatgtgtcacatttttcgatatcctattgggcaaagcaagtcacaaagctaaactcagagtcagtgtgagaaatgattggaaaagggcatgaatactgggatatctgattcatttagttaccactaatataagaatctaccataaatggatataaaaataatatctaccttataagactattctgaaaattaaatttcatactgcatgtgttttgctcagcatcacctctgacataccaaatgctcaataaatattagctagtattggtagaatcatcattatctattattagctgccaggagcaggttccccttttgaaatcttgctgttatgtgtttagctaacatttatttagtgcttaccgtggtaatcttccttatgctaggtattggggataaaagaaaatgataatattcagtccctgccattgaggaactcatagtctactggaggagaccagacacataagcagttagatataagatatcatggcaagttgtgaggccgagatatgcacacggtattttggcagtacaaaggaaggatacctaaccccttagtccagccaaggggtgtggtaaggaaacacttcttggcatagatgctactgagccgaatcctaagggaagagctgtgtcattcagaagaccaggggtttaaaatagaggattttggcatgagtaaagacattcagataagaaagagcattctgtgttatcaaatgaaattaaaaggctaggaatctgaagagataagccaaaaaagaaacaaaggcagggaggcaagagagagagaggaaaagagagagggagagaaaagtaaagaaagaggagaaggaggagcaagaggagggaaggagggaaagaggaagggaaaggagaaagggtgaaacgtggggaataaatgtgtaattttccaaagttagatattattctataggtgaatgaggaggccctgacagcctttgagaagggtaaggatgcagtcagatgtgcagtttagagcaatcactctgggggccaagtggagcatgaatggaggtggggaaaccattaggagtaatgcagaaatccaggcaagagggagagtatctgtgaatggaagtcaaggtaggatcctttctatttccaccctccacagctgaagaaaagcatttccgtgagagatgcaatgaccttggatatcctagtttgggagcctatagtctagaatatctgacaaaaaactattttcttcactctttacagatattcttatctaccaaattgaccgttattgtctagaagagtggtcgaccctgggcaatcttagagtgagtgttattgttaagtatttagtcttgttttggatggccctggtgaggtgtgaggaaactgttctatgaatttgacaggtcaccttagagagaacagtaagtacattcttagacacagatccttcaagcctttttttttctttgtggtctaggcttctaaaattataatgtattttaaatgactttgacctcttccatttgtgctccctcattgcctcagtaattcttatgtgtctctttaatgtttataccttgtttcttttcatatgtattcacaaccttatgtcttgaatttcctggatgatcacactttcaactacattgcttcattgtcccagaaagcacattcataattatcagtgtttacattcagatttgtggtctggaaaatattgtcattatacttatgcaatatgtcccttttccagaatgcttctcattactttctttctgatacttctgtatgggcaccctgcagtgataaaagcagctctctgcagtctcatctgatgatgtcctgctctagtccagctacatgttctagctccaaagaaatttgcttgagaaccaattttgcttgtttgattggtttactaaatgtgcaatgatttgcatcacttttcattagtgtcctgagctatatctgagaggggttagtttagtatgtctaagatctatcagtagattcctgcatattttcaagtaaacttttctttaaacatattgaaaacacttgaaattcagagaaggatcatgaagagggtgtaatgagactgatcaggaggcaaggggtagagcaagctggggaccagtccagtaagccttgtttgaagaccagtataatcatttctgactcccaggggtcttctgcaacaacctggtgccttctgcatggtggcgctgtttccactcagtgtctttcatcctcctgcttctttgggcccctagaccatctaatgctatggcaggcccaaggcacacagaactgccaaggagaataggacaggtgggtattctagatcagcatcatttattagacattattatgacatgcctgatactgttctctgcattttatgtgccttatggcacataatattaatatttgtggcatagaggagtggtaaaaaacaaagcctttggtgtcagactgcctgtgttcaaatcctgtttctgccacttacttggtttgggaacccctaagtggggagtcttaaaggacccttctggttatgagctcttaatcctgggaagggacttgtagaaggagtgcatggggaatagaagaggagacggaaggcatgcaaatgactgcacctagcagcagggtctggcacatgggccaggtggtaagagatgccaagtgacctgctgagtgcgtttggctgtgactgtagactctgtggctgtccaagcacccccacaaggcctgagggccaggaagagaatgcagccacaggtcactaaccaaacaacaggaactctagccgattggccctgcctgaacccaagactcaaagagcttgagtggaggccccctgctgcttcttcctttggagagacacttgtttggaaatggctgaggaatctgcctgtcacttgcaacccaacttacttcttggcttctgagatgttgacagaaattggcgatgataaatgtcactactgccaccacaaccactgtcatttactcagggctcaccatgctccaggcactttgcaaagcactttatgtacattattttatttaattttcatcagaaccccacaaagatagttatattgccatttatgaatgaaatacacagtacattatgagaactgttttgattataaagaatagacacccaacttgaaccagcttaagcaaaagacaactgtatgataggatactggatcatctcaacagaactcacaatgggaatgtggttgagcccccagaatagccataaaccgggactctgatgctgtcatatatcttgctcatactctcacttgtatttacttttcagtagcttctgccttcattcttctctccttccataggtcagtttctccataggctacaaaacatggctgcccagggcttctgaattttacatattatagcttatgccactagattgagactgacttaacattctcctgggtcctaccaaaaatcccgaggattcgacccagccagtcaggtgccccacccttcaacctctcagctatggctgggtcagtgagtagaccaggaggtggaataaaatggcaacctccacaggatcacatgggtggagttgaggaaggggcagttcacaagaggaggagataaagagctatggtgaggggggaggggggagggtgggggggagggggggagagtgagtcagaaggagaggtagggatggctggttggtagctcaacagtagccatctacaacacagggttaaaaagattaaggaactcatccagaatcacatgcaaccaatgatggaaaagcaaggattcaaattgggcatttctgacttcaaagtctatgttccttactaatatgacaaattagaataaagtagggtgaatgaatgagttcacatacacatacatacatatttgcctgagtactaatgaagaccttgccaagtcagtgctcaaatccagagagtcacagttcagaattgtccaacattacacacttttgctctaccctcacaactgtcatttgagaataaaggtagagagtaatgacaaggtaacctgatgacaagcagtatcagtgattgcagcctgtggcccagttcccaaaagcagattataacagcatccctagaacccacccatcattttcagtcagcagttcagcatcgctgctgagctgtgttctggagcaagccaaggccttgggcatggtgcacacatgtccaggaagaagttgatttagagggagtggtctgtttgagtggttcctcactgtgtcctgcatgtcccagaagatggtttgggacccagttttgttgttccagaagacaggtcttcattggaggaaggcacatcaaaggagaaggtagagctcggttctcactgattgagctcctataagtctaagaataggactctgaggattatggcttcccaaggatggagagttgtggcttgggagtttttgagcccttgagccaagaggcattagatacttcaggaaatcctgttgaatctttccacctatttgagcctgtttagcaaactgtttacaaaattctctgacctaaaagaattaatgcccttttctaaaatggcatcttgtcccagggaggggtttatgacgaggcaccacctcgctcaatgggactctttggattcaagaccttgggtaaattcagaagggtactggcatttttattcctgtgatttctgtttttatttgcacgtgaatgaaaataatgaatgaaaccaaaagaacctcatagagttcgccctgatgtttggaaaaaattgagttaaaagcttgggaagtagaatttgttcagtatttcccccttgacaattgcaagccacttgcacaaaaaattatgtttctgggaggaagtcacattaaggagctgcactgatgttttcaattgtagtagtaatagttataatgagaaggaggaggaaaaaatagcaaatacttgcagaaaactaatgagcccggcacagagagattaaataattcatgcaaggtcacacagcttgtcagtaccctgcctcccactgccaccagccaccattctgcctatctggcccccattgtgaacttcggtcgccacttgccatgaatcctttagacacaaccatcagggatcttgggagactagggtgagctgaaacagactcttctactctcttagatcacagtaagtttgcaaggaatatagaggtcataaatattctcttggtaacatagcgtggtgaaaaaaatatgagctgctagagtcaaacaaatcagagacaaaattctggtccgtcaatgagccttgggttttttggtctatattgtaggcaattaataatatccaccttttttagtggcattgaattgatagacctccacaagaagtgcctggccctcagcctggtccctaatggctctaattactctaatatgatcacatctccacccgtggtgttatctgaaatgaccataacagctctctggtgctgagagaatcaacaacttctattcctggcaggtgagtctgctctacctcccccattttcccattccttcactctccagagtaggaaagatggaaggaggataagcagcgaagaagagtcactcagagggcagtgcctagcagcaacaatgggtacacacagcgctgagggggcctgggctctcttggagaggcagggctcagccagggatagcatctgaggcccgagatggcaatggatgtctcagtgtccctgggagagccatgcaggtgccagacaggattggctggatgggcttcccttcagcgtgtgtacccagagacaccggtccccagcttagtaagtgaagaggcagtcataggccaaaggcagtcatggatcaaatttaaatatggaaattatttccaagcacacttttcaaaaactagatttctaaacctagatggcactgaatatgcaaataattaggagaagaagcatcaaagccatgccagtggcctttttagatactgcagcagattgtgccattgcacttagagccattcacatagaactgagtctgtccagggtaactttataatcaggaaggctgaagagaaacagaatgaagcaggctttacatcttacatccttttcatggaagaaagaacactggagggagatctagtggaggctttgtggagggtgtgcagtgacatcagtcaataatttactgagaacatagttgttattcatgccagtacaagggacaaaaaaaaggcaatctaatatagtccctgccctcgaagggcttaaggaccagttcagagatatgaattttgaaatacagctaacattttaatatgatagccaaagggagaggttgacccacaaaattattacaggagatcaaataagaaagctctttctctgggctggggtgatcagggacagtatcatggcagtggagaggtctgagaagggccaaggagaatgcagaacattcctgaaacatggcaaggggacagacctgcaggcaggggaaggtcatgtgcaacaacagaaagcaaaacggcatctctgtcacatgtagtataggaaaagctacatgcaaaagtatactaataccaaagaagaacactttgggaatggggtagattgttttacaagttaggtaggaaaccaaccctccatttaaaaagaatattatgttctactgcaaaagaaaaacagtaaaattttgtgcacagaaaaaaagaccagtcagaagacaaatctcagagtgggaacaatatttcaagcatacctgagagatgaagggttactatcatactacaccaggagctcttctctatgaatggataagaaagacaaacaactcaatagaaaatggataaaagatgtgactagatggtaaaagaggaaaatttaaatggctaagagatgtggaaaggtgcttgcgctcactgtgaggcaaggagatgaaaattagagcaggaagatattgtgtttcattcctcagattggcaagcatttagtagtgataaaaacttagtgctggtgagagtgtgagcaggatgcgctcttgtgctttgctgataggaatttcaattgttgcaaactgttgtattctggcaccattgagaacatttaaaaacatacatatccttttgttccgccttttcatttctgggaattgatgccttagaaataccaagatatgtattatgtcttctggttaattttttggaaatatcataaatatcaatagggctatgcttgagtaaataaaggcacattcattattataggctactatgcagttcttaaaagaagttagatctactgttggaagaaattccacactgaagtgggaaaagtaagtggtagagaaatgtgtgtattatgatttgatttaggaaacacgcatacataccaagtcacacaaatccccttctttgtatatatgtagatgtattttgaacggatacagataatgcagggccatacagtgttagaatgttcacttggttacaaagaaatgagggggagaggtagtgctgtagtttgaatgtgtcccccaaagttcattaagttggaaacttaatcttcaatgcaacgttgttgagaggtgggaccttttagaggcaattaggtcctgaggctctgccctcatgagtgaatgaatgacattatcaaagtagtgggttggttattgagagagtgaatttgttataaaagtgagcttggctctctcctgctctctctctcacacatactctcctgcccttctgccttctgcgtgggatgatgcagcaagaaggcccttgccagatgccagcacctttatattggacttcccagcctctagaagtgtgagggatacatttaaaaaaaaataaattacccagtctgtgtgtttttttttatagtagcagaaaacaaattaaagataggtaaatagagaaaaacaaagattgagcaaaatgaagtattatcatatactcaaacattaaaaatcctcagagttgagttaagatgtatagctttgggggtggggaagtgagggtgtcctcctgtcctcggatttctgctctattcagagtctgaggcctgccccggggctgcaggacagaatgggatgcagaatttaggctgccttgcagagactctgcctcttcctttagcttgctcagggaaatagcatgtagctttaagtttcacattttaaaagtcagatgaaggcttaaaataagcagcaagtgtttcatgttacatccagatgtcatctcaagcaaaaaacaaaaatgctttgatttttgaaaaataacctttgacgcctaaagaggctctaataagtgtttttgctccagaatcttaaaaaatgactttctatgcagacaagagaggcagcccgaggagaccgatgtcctttgctaatctatgcaaggactgcagcagcctcaataccctgccctggtcccctctcccttcttcacaatgacacattcgcccttctgctcacatcaactgttcatggtggggggacaaacgtgggggctttcagagaggaacacagtctctgtggtctttttaatgtgtggccttgtcagggtgctaattggtgccaatttcactggcagtaatggaggaatctgttagcagaaggaagactttgaagtctaaaagcattacagattagttccctagaattttcctacgggaagccttatgagccaagtccactcgaaggtaccacaggtttgtaaggtagacttccttctgaggagaaattcccagctattcaggtgttcagcctgtaccaagagaaccaaaccagaaactctaaaacatcactgtttttctgaaaaaaaaaaaaaaaaaaaaaaaaaacaaaaactaggcaattttttttttctcttgaaaaagatgattttggtcctcaagagatctttttaaatgttagaatggcagataactgaattttttgtagacagatgttgtgaaatgtgcttatggtaatgatgtttgtttagttacctcaaaggaattctgagtgctttacagtcattttcttcattatttcttaaggttttttattttcctgatcatattttaatctcaagcataaattcttcattcagttcttctcgctacattgtctctgaaatatctcctgttagcctcatgttctaccgctgtctgcacttccaggattgtagactcacaccacttcggacatcctggatgcactttcaagatgtttgcttggtgtctccggcttctctttctctatttactatttttcattgctctttcaaacttttccatttatatttttcaccatactttctcccccttgagagaaagattgcttgaaatacaccttgttcttctacataatttttgtttccttttttgttaattttagttgtttactcatttgtaacctgcctttgctccataaagaattggcagtgactatctaaacatgttctttaacatgaaccctgtttgttggaattgggaatctgatattcagatttttttttttcaaaaaagtttcacctttcagtactcaaggaatttaactttccctcttatttttttttcatttccttgaagaaacgaaaaaaaaaaataacgactttaaggcaagctcgtattttgtagaaacaaatcagatactgccaccccttcaaaaagtaacctctaaaagcacctcttcatcgggctttaatttgtaggatgtagagagcccctgtcctaaagaaattatgatcatgaaattatgtggaaggcacctcagaatgccacacacctatttttacagatgcagaaactgaggctcacagtgttttagaaatgtgtttacagtctcagaaatactcagagacatgtttagaattattttaattaagacaatcacttggaacatttaaaaaatcattaaagaaggtggtagataccatgaaatgatgaatgattgggttctgggcagtggtgagctggttgacgtttaacaacaggggccagggctggacagagggagcctgattgatagtgtttgccaacttcacggtgcccatgccagtttcaagctaccagcctgacacccttgaacaaggagttgggaagagatgagcacaatccagtcagctctcaagattggcagagatcatccggctacagtgagcaggcccgtaaggaagagaactgtgctagacaattgctccccatgcctcagaccttacaggtgtgaaaaataagccattttcatttagcctctgcaccactctgttccctcactcttgccctttccttggcagataaataactcttacctcctcagctatcatttacgtttcaagccacagctcaaaatgagggtctctgtgagatttcttctgattcttttagaaaacatcacttctactctgaatgccggagtactttatttatatcttttattacagtaattaccaaagcctaacttgtcaatggatagtggatattagagtaattaccaaagcctattattgtcgatggatagtgtcttttccctctagactgtccttggaggaaaaggaacatgtcttactccttcattgtcagagaagcagtgcagagtggtgggtaggagtccaagctctggagtcagactgctcagcttcaagtcacttaccgtgggagcttgggcaagtcatcaaacccctctgtagccatctgtaaaatgaaacattaaatgtgagcttcaatctcacaggctcactgtgatataatgagattactagatatggtcagtgcctagcacatctataccctcaacaaatgctacctggtattgttacctctagcacatagcccagtgcctggcacagaatcggtgtgcagtggttggtggttgaaatgaatggacttgaagtaaggatattacccagctaacttggtagaagttgggaaagggtgtgatagagggaactgcgtgaacaaactactgttggggaaatgagaatgatatatttaataaaaatcagtagattatagaattataggatcagaacccagttttccagctgtggtatgatgaacacagagcaaggtaggatcattcgtaccttcccttcaccccatatgctagatgatgtatgtctataaatataccattgttattgcaatagcttttgtagactgctgattgaaatatctcatttttgatactgtgcaattgctttttaaaacatcaaaatgctagattttgagtacaaatactgttacatttcattcagtttggttcagttcatcattccaactaattcatatctcctccaaacttgattctgcaatgcagtttatctttcctcctatctagttttctgttgtctgcaattttgtaagcatgacttgtattttgttttctaaaagactacccaggccgcttctaagaacagagtcccctgatatgacactagtgacttttttctatgttggcagtcattcattaaacaatctctttttttttcctttttgggtacagattttaaactcctttcaaatctatcaaagtgtgcaatatccttattgttcacaatagtatctgagaaactctgccaaaatgttatgtctgtagcattttttcccacagatatagtaagtctattagaaaagaaaatgcagctagttcgttgcaaagtgttcctgattaatccatgttagctcttaataccaacaacttccttttccaagttgaactaaggattcatgatgtaaaatagtgaagttaactgtatcaaggtaggctagactcaatgtacagaccttgactatctaggtgagaaatttgggcacaattctgaggacagtgagagattgttgaaatttttgaatcaggattatatgacaaaattgtgttttaagaaagccatctggcagcagtgtccacaatggactctggggggacccttagtgaggtttgaaatttcctgcaataatgtcagaatgggccgctgggctataataggccaggctagtagcaataaagatggaaaagaataaatttggatttaagagaaaaaaaatcaaaagggactgttgagggaagatgataggaaataaataaataaataagtactttagggcttctcaactttttacacattattgaaggtgcagaatataaaccagtttggccactagggtaaataggcctatttggggagggggtgaccaatgtcctggacccccaggactgagtctctcctctcccaattcctacctggccaaactggcagaggacattagtatctccactggctggagagccatttggaaatttctgttttagaaataagtagtcttagcaatatgagaaaaaacggacttgttctaaaatcaggatcaacagttcagagaagcctatacacatgaaggaaagcaaacgtttggttcagtgcatgattctgaacaaagaagcaaaacatcatttatacccttgaaagaaaaccaaccagcatcagccaaacaaggactgtgtaggtaccaaataagatagcctatgccaccaagccactgcctgcattataatgatgcagtaacacaagggcagtggctatgcaggctactggacaaagaaaccaagaaggagggagtctgggttttgcattaatatggaaatccaagccgatttgcttgaaaatttatgaagtcctaccaacttgttgcttcttattgatttctgtagttaataaattaagtggtgctgtagttcctggtgcctcacctgttctactaatttgcattgctgcatggaggaaatcatagattgagaaaatgcaggtgcttgcaatccataattccttacgataattgaagatgctcagttatagaaaataagcaagtgttccctctttctccattaaactcaatgagacagagagaatgagaaccccccaacaaagccatgttgattcccttataaataggaatgagtggctcttctgaaaaataatggaacccatacatttctcaggatggttgccagcaggccgccatgttcatgattcagggacactggcctttcacattggagcccatgtggatggtgctccatggtgttggggcactcagcctgtgtggccataggtggtggctcacagagagacatatctgattcatcccagggcttccacccagcccaggaggtgcacatctgcattgacccatgttcatccccagcctaactgtgctcccttcccaaacagtgttagtattctttaatcccaatttgtaattttattccaatttagatccacctagctctccccactggatctcttctacagccaaaacacatcattttggctcatttgctcccattgttctgttgacatttccaaagctatctgctgctctcaccatcatgctccttgttacagttaaatagaaaaaactggcagccacacataatgcgggaactccagcatcctcacttactacacagtgctgcaagatatttgtttacatatctgactccactcactgtgagcttcatgaaggatagaatgatgcttctttgagccatgggtcttaacagggtgccagcacatagtaggtcctcatttaatgtttggtaagtgagtgataaatgaatgtattgcctttcttacatttggacacagtagtctcatttggggcacatgatttaaaaagtattcctatctctagtatgtacaatgttggcacttgttggcttttgttcaactgcttcctgggattgttcagacaatactgggacaggctgtttgttatgttgtggccagtggtttctgattcttgtgttcatccttgtgcaggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagtatggcatcctctcaatgactttgggtggcatgggagagtcagctttgatgcacctgttagcacttggctggcctgagacctgaggcatgagaattgggcactgtgtctgatttctagttgcttttgagctgtgggattactggcagccctctggtctgatgtctcgttctgtccagctggtgacctgggaaaatgatggccaacttcccacgctaaagtttcttcggtcttgcttggccttaatgattaggacctcaagtttatggagatttaagtttacttctggtgttcaaatatgttttcttgggccagcatgtcccagaatcttgagatttagaaccattttttgaaaaatataaaactaatctatgcttttaaaagtcaggataatggttctccttggtgtgaagtgcctagagtgggaaacaagaggcctctctggtactggtaacttttctgtatctggatccgggtgctgattaataagagttcagtctgaaaagtcattgaactgaagccttcaaatatgcacccttttcttatgtattttgtacttcaaaggagaattaaaattaagaggaaacatatctcaatatgacgagataatgagaatattgcaggtctgttgcctgctttatttcttcactcgagtctagtataaattgtgctgagctgtgaagggggcctgctttgggattggaggttttttaatggcaaagggtaataaatgttggctttttgtacaaagacttttttgtttgtttgtttttgtttctttaattggctaggaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtgagtgtccacaagggctgtttccatttccattttcatttattttccttcttctaaatataagtttaaaacatgctcactttatgcatttcagaaaatataaaatggcaaataagatgtattgttcccactatacaaagaaaaccactgataggctgtattttccttgtggtggtcccttgccctcctgaatgttttaattggagcatcgcgcctttcttttaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttaggtaaatgatgggtttgctggtggaaggaaatggacgtatggatggggaagtgaaataaggaaaaaaggagcacatggccaggctgttccagctagaaggtggtttgctaggagctcaactcagccagggacttcacttaggggacttcaaaatcaattactctcaaacatgaaagctgatgaacacccagaaaaataggaaagcataatgccatctaagaaagtagtactgggctggtcctcagagggcttactgtagtcccattcctgccatttagtcagcatgtgaccttgagcaaatttgctgtatctggggacttggtttcctcatccataggagaagtcatttcaaccaggctgatctctgagactgcttcttgccataataatttctaattctggatatcattgaaatatctatttatttttaattatctgcaagaattgcgctcagagctaccaaaaaagattttttgtttccacgcaaattttctgaggctttgccagatagagctgatctgattcttcctcccaccccactgcacccctccccataccattctctccagcatcacttaaatgtcaaaaatctcagacgtgatataagactgggtgagatgaggccaagatttcaattagatgaggtcttttgtgagctcataccccatattttttgcaggggccatggaatgaggggttggaaaataaaacgtcaccttgaaaacagaacactgggctagcagaaaggagactgggtttggcataaacaagctgtaagcccctggacgagtcaccgtctctctaaggcacatcaacattttttaaatggggctattacagtagacagtgactaacatttctttaagctctaaccatagggaattaattcaattaatgcattgcaaagtggagttataggctccatagaatttttctataaattactcaaatttcttagctaatcttcttactcagagtgaagcaaattccagccttgccaattttatgtgaaatgtgattagatagtacacactgtatccagtaattctcatagcttctatacatattttatttgcttttttttttttttttttttttgctgtgcaaggatagttggaacattaagagatataaacaaaaccacattctaattctaaccttgtcagtatagcactaccttaacttctgaactggcagagccagtggtacattaatatatccctggaatagcatagaaatgtcaggcagggtgtgtttacgtctgtattcagaggaggagcagttagttatagggataagagaagccaacatttattgagcacctactatataatgtgccaggcatcattgtacatcctttggttatattaactcataaaatgttattatacccattttatagcttaggaaactgaatcttagacctattaagccattttccagccgtctcttagctgataactggcagctctaggattaaaatccagctatggtagccttcagaacctgtgttctagtacaaataaggccgtttcagagttcagcccctaacccaggaaccagcatggggggacaaagagcaatgtaatacaatgaaaaaacacagactttttggctcagtttgtaagctgaccctgacactttctgagtatgaattggaaagaaccttgacctctcagtcctagtttactcctccataaaatagataaggtaatccctaatgaaagggccattagaaggattatatatatagtatgtggtaaaagtagtttctaaattgtaaagaccaaaacagacgatgtattttgtgtatagaaagtttccctgggcctaatgggaggaaaagaccatagaggtggtgcttttactcagttattccccaatcttagacaaaagggaaatcagggtagaattgcaatcaattagagtcaagtgtgcagaggttttctccacacctctggagagagcctttgaattgtacctcttacgctcgcatctctagctgccattgaaaggttttgcatttcacagttggtgtgttaagcactggggctttatcaagatcttttaaaaattgattaagtgaccaggcttttacaattcctttgggagttcaataacaaagtaggtttcagagtaagaaatatattttctaattttcagccaatttttcccctttttaaacttcatctttattaatgatttggaagatggagaaaacagcatgttaattcacttagttatgagtttacaatgtgctgtgacagctaaaaaggccagaactattttgagacacaattgagggagcattgtatcatgggacagaatagtgattgtccctttttataggcctttacagagatggcttctggaatatagtatctagtttctggacacctccaagccagagagatatttagctcaattggaaaggattcagcacacatgattaaagatattaaagaaagcatatgtggaacattcttgctaccttgcccagtcttgtcccatcaaccctatcacttcataatgggggatagattgtagttggtttgtgaattacagcttagacatgttcccttgtcacttgttaaattcccactgttgcagataataatatttaacgtggaaggatactttaacattgacttatattctcataccctaatgatgtctgataacatacaatacatcaaagtaggttgaaaaagtgaatctaggctaggaagtttaagagaaatgatacaaggggaaaagggggctggttatttattgtacataattattcctgaacaaattcaactctaaaatagtaggtaggtctgttgagaaagactgtatctgcaaggttcagaagcattggagaaggcatttccaggcctccattacatggtgtggccatatagatgagaacataaattgagtcagtccaatacaactcactcacttcatagctagtgcttcttccaattgcaccatttactgaaatacccagatattggtccaataatggcagaagctgcctctacaacctaagaggctcacgggcatgaagctgtccttctcatgtatttgaaggaaggcaatccttgacctttaaggaaatggttcagtacaatctaacctaggccctggcttcctgaaggcagacaacacattgtggtttgttccccaccccctaaaatatgaaatgaatatgtgaattaattcgaattcttttgctctctgttctaaccctgagcactgcttttttcccttcctcagagccattcagcgctgacgtatgggtgatgatgtttgtgatgctgctcatcgtctcagccgtggctgtctttgtctttgagtacttcagccctgtgggttataacaggtgcctcgctgatggcagaggtaaggccggctggaaccgctgcacttccccagtttttttctccttattttcaaatctctggactcctcatttgttatctgcattttccctagcatatccatttctgaaaaggaaccctcaggtgaacatttctaagtcaccagcttggcgtctctttagaaataccccagttaagatgttagtttgaatctataggtctgctttatgcctggccccaagcctagtttcactcccaagtaaaggagaggaaaaactattggtagatatgggtatagcataaacatgtcacaggaaactattttgataaccttaggctgtgggcagtctgttggaacagatgtcgctaacaaggcagattgtacacacatgttaagaacaagaagaaatggattgccccaggatatatgcaggtggttgtggctggttgagttccccagtgccaaaggatcacaactgaggtaccagatctccaaagcatatgcccctggttcaacccccttgcccgagagtataaaagttgggtgttggaaataaaatgaatgggaaagaccaattctcactcatagctattattgggtatggtccaatttcctgggtaggtagacctagagatgtgagggctgcccatgtgtttgaggcatttatgacagtttttaaaagttcacatgatttctaaaggggaccatgggatccttgtaaataactcctctaaaacttcctgagaaccccaggattaagaaatattctgccttctctgagtcttctccattccagaatgtgagctctatcctagaattaaacctccaagaggaaagattcttaaacctggctacacataagaatgatctatggggcatctaaaagacacaggtgcttggacctcattttctgattcactaagtctaggttggggcttagaccactgtatgtttcaaaatagtgtttctctacgttggttgcatgttaaaataaccagccccaccctacaccaatttaataagaatctctgagtatagggtttcaggcagcagtattttataaaatcttcctcatgcttctgttggattcacagtctaagctgtgaaacaacactttactgaagtatttccaagtgcagacctaccttttaatttggtttgtgtattctgaggtgggagttggggtgtctccatggcatggtacaatcaggggccttccacctgtgcttcatccagaagccatgacctatatcccagcctgtgtggcaccagtgagaagtggaacatctgggaatcacatgagtatatacttaggttggcaatgtcaagagctaaagtcagtgtgcattgcctctctcccttgaaaaaataacaggagccgaaaatccagatttgcaaagaaagctcagagcgagggcttacaattactcactttaccaaaggatgtttgtcttcacagaggaattcaacatggggccactttaaatatcaagtctccttagagcattttacaatttataaagctttgatttataaacaacgttttagttacacatctgttgcatgaaataaggtccacacgcacagatgtgtgtgcacagttagatatcaggttcaacatgagttgtccctgatgatttatttggctgagcagatgctatcaggatcacagattacatcataagacctgtgcaaatatgttgtaaaactgtgcaggcagatgttcatttctgcagtggaggggctacatggagattcagacaacaggcaagattttaccatcagcaaatagagattgcagtgaggtcacaatacatacatgggcagaagcccaagcactgtctatgcaaaggttaggtggggggaaatcaaagtcaaaagcagcttcctttctccccttagatgcaggtagccaggccaggattctatgacttcccctttggccttcctgatattcttttttttttttttttgagacagagtcttgctctgttgcccaggctggagtgcagtggcgcgatctcagctcactgcaagctccgcctcccgggttcacaccattctcctgcctcaggctcccgaatagctgggactacaggcgcccgccaccacgcccagctaattttttgtctttttagtagagacggggtttcaccgtgttagccaggatggtctcgatctcctgacctcgtgatccgcccacctcggcctcccaaagtgctgggattacaggcgtgagccaccatgcctggcctctgatattcttttacacgcaagcttctatgacaggaaaccagttgggaagtgttggcatcggagtaggatcagggttgtctttgaaacattgagtgctaagtgctagaagctaaagaaaaatcaggaaaaagtgcattctaagccatctagcatcagtataaacagacttggagagggtttatgaatggcagaaaacaatcttacccagttcttgctgatgtttttggaagttaaaatgcattcttggtagatacaaatataaaatttaggaaaaaatgacagacatgacccaagtgtgaccatagtgacatagttggcctgttttactcagttttgatgtaatcttgagagggtcttgtatatgggggcaggttgatggctcctccagaggggagtcatgactgttagttcaagaaagaccatcctacacacactccgggcttctggtttttctcctaaggaaccctctgcagccctcctgagagtccctggaaaagagagatacacactctcaaatttaaaagccgtctataaaagggcttggttttagcggaagggtttcctgctctgagcagggactcaccctgtgtatttgtaggtttcaacagaaccagccacaatggcttaactttcgtccttgtctttttgtcatgccagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaaggtaagagactcatttgaaatctcccgtctttccctcaatcctgttctcagccatactcaaagttctcatgtacctgcttgtcttctaaatttttggaattgaccgttctttcttatgttttcttgtattggaacatgggagtagaagtcagtttccctactgaaataatatgacttcatgttggcctcctgattcgtgaaaagttatcactagtacaccctaggctgaaaataaggggcttggtatgttagcggctttctgagtgcatggtacctcttgttggatgtggttgggtggcctatctgcacagggctgcccatgtggggtgttattagaggaccgccgccgtgtacccacaccgaggagatgggcgcatgatggcctccttttcttcccagtggtgtttggctgtgggctctcccttggttccggtgcacactcgtgtttctggggctgagcaggaagaagcattgtgtcttgaagagaagtaactgctgtttaactggatgatttggatgattgcccctgtgtggtgctgatgaatgggctgcccccttactaattgcaggcctcctgcgggcctatgcaattgagagagaagggaaagtgtctgctgttttccatcactgctggatgaggatgtacaaaacccattctaaatacatctgaccctccagtctgcctgaagcatcacattttccatgggagatctgtctcctgaaactatgtaaccaggactagggatgggagacactttcatggagtgtcccataaagcttatggccaaaataattttggagacttgcgcttacaacaaattttctactctatttccttaagatttagaaaatgtgatatttttccactcccacccccacccccccaggatgaagccatgagctgcagataggtgtgtcttcagaccaaatagtactttgcacatgggttagatttgcccaacctaaaaccctacacacttaagcaaatggtctgagaagaatgaaaaggaggagatattctcttcaggggctcagattctcatttttccttctacatctctacttatcaagaacattcaaaagcatgtggagaagataaatagtatcttgagaaaagatactatatatatttattatatatattttatatatttattatatataatatatattatatataatatatattatatattttatatattatatataatatatattttatatataatatataatatatattatatattttatatattatatataatatatattatatattttatattatatataatatatattttttatataatatatattatatattttatatattatatataatatatattttttatataatatatattatatattttatatatattttatatattatatatattttttatatatttattatatatattttttatatatatatatattttttttgagtgcatggtacctcctgttagatgtggttgggtggcctaaatgcacagggctgccagtgtggggtgttactagagggccgctgctgtgtacccacactgaggagatgggcacatcatggcccatggaaaatatatactccactgtgtttacccctttgtgttatctgtttctctgatttgtcttcctttttgctttattcttcttccttatttaaaaaaaaattctctctcttgtatttttttctctcttatttggaagcttttatttacttctctcatctcatgatttatgatacatttatttatatatcatccatgtattaacccatttttaaacccctctcttattgttccttcatcaacatctttcatcacgaccctaactaaaatctgagttgcacacctccttttccccccatttgcagccgctaccacaatcgccttttggtgactgtttctgtaacctggacagtaatagggtgaagaacaacctcagagctcaatacttggttgtggcttagggtaaggtggaccacgcccacctcctattgtttggatgtctgatccctttaaatctcatgttgaaatttgatccccagtgttgaaggtggggcctaatggccagtgtttgggtcacgggggtggatctctcatgaacagattagtggctcccttgggaggggtgggactgagtgagtttttgcttttttagttcccatgagaattcccccaacagctgattgttaaaaagagtctggcacctcccctctctcttgcttcctctcttgccatatgatctccgcacatgctggctcccctgccccttccaccatgagtggaagcagcctgaggatgtcaccatatgcccaaacttcaacttttccagacatcagaattgtgagccaactgaatctttctttttctttataaattacctagtctcaggtattcctctatagcaacataaaatgcactaacgcaccaccctaaaacatggatgttgcagaaacttgatgggccatgccccatgtgtagacttgtcagaggtatggcagaccatgtcttcacatgaggctgtggcagagaggtagtagactatgtaccacacagagtatagcagggccatgtcaccatgcatgacatggcaggggtgtagtgtatcatgtcctatgcatggttatagcactgtatggtgagatcatgtcaccgtgcatcaatatggcagagatgaggtgggtcacagaccttcttggctgttaagtggaggatctgcatgggtatcaaaatgcttccttcaaatgtctcaaaaattacttggcatactgcacttatctttctcttaccctcatgggccacgcagtaacaactgaatgtttttctgtttgaactaagcataactgagatggaggaagatagttttcttttccatgattttgaaataagtaccatttctaggcttcttaaagcggacaggatatgcacatgtctgtcctccataccgtgttcattatgttctaaaagttggatcccatcagtttgttttatagaatgaagacaggtgtgtgtgtgtgtgtgtgtgtgtgtgtgtgtgtgtcagagagagagagagagagagagagagagagagagagagactttcaagacctttgcaaataatttccactgtgaccccagctctgcagtctcattggccaatgcttgggttcctgcatctgatatcctgggtatccacaactgttcatctttttcaaccatacctctatctatgcatctgcccgggaggcttttttccccactttttcactcatcaaactcctactgaaacttcaaaacctagattagagatccctttatttgtggagctttccctagctcatctgggaaattagtcatttccctagctcatctgggaaattagtgctctattatggcaactattcaaatctttattataacacgtatcttccgcattctattacaataatctataggccaatacctgaccacctattcctctgtctgaccctgaactccacaaagtcaatgaccataagttgttcatcattaagacaaaaaaaaaaaagagtctgtggggagagaggaagagaggttgtatttacttaagagcccctggcaaaaacaacggacccagaatcacaggcaaagaaagcaacaagtcagcaagtgccccttaacagctgtttactttgtaaatggttttctgatacatttcagaactttgcagatgacaaaacagtaaagtgtaagcaccctaccagaatctgtcaacatgatttacataattataaaaaacatttaagtaactaatgactgcatatcagtgtcatggacagttatataaatcagaaagagagtttcctgaaaatatacttaaaatgttaaaattcttatagtcttacttacttacagtctaacacctaaagaaaacaaattattgggacagggtatggtaatgcatgagaggaagtatattctgtgaatttagaaaaagaataaagacattcaaacaataatgttgagaaaagaaatgagatgattttgaagattattttccaatgtgattagattttcatcaaggaagtaacatttaaaatggagaagggttcctaaacttgttttgactattacagatgatgtatcttccatataactcacatcaagtgataaatatcttggagcgatgatggaaagatatttgtagccattcgatttatagctttttaaaaagttatcttcagctttattgcagaaaaaaatgtactcagatttcatttgtgttaaggtagaaaacgagagttaaatttccatgaaaacctatttttgtactcctttatactggaaggcttccattttgcggtagcacattacagtgaattcagaattattccactacatgctgtacctaaatatgggtgcaagttcgaacattcagcaacccgactgtacgttccatcagctcccccagtgggaggagggtgtaagggagctagtgacatctttcttctcttaacaaagagcccacaatgcattctcatatttctcacccatccagatggatttctcattttgcagtctgccaaccatagtatgaaggaaaaagagcttggccagtgagggagggggacatatttgctgggcactaggtacattttgtatgctctgtgtatgctatttggatagtcttcacacaggtatgattattctcattttacaaataggaacaccgagactctggaaaactagtaacttccccaaagttatacattatcaagtgacagagccaaaatttgagtccctgtgtatttggctccaaaatcactctgccagggtgcttctcctgtagctaatctcagggaaagctgtgacatagataaggactggaattgacacccctgcccccactttcctatttaattccctatcctttaatgtaatgccttgattccacttaacagggcacattaacaccaccactactattactactactaataatgattatcattgttattattattaataataatataacttcagcgataacttcccaggtaagatttttttcagctcttacaagccaggcatcatgccaaatatatttcatagattatcttatataatggtgctattaatatctttatttgtagatgaggcaactgaagcttggtgaggttaaataatttgcccttatggtgttcctggctcactatagcccctgaacagtgtgccaccctgtttagaccctgatgctatttgatgctctttccagttattcacttttcttcctacattcctatctaccttatcaatcaaagcctaacaagttagatcctttccccctactaacatgtagctatctaattaattgagccataataattagatagatagtattgtaacatttgcactttatttaataagccttttagagacattattttaaatagagaagaatggtgatttccagtacttgggcaggctaatggccctcaaattgactttagcctgtgtatagagtgacccttagctttaagctactgttggatggtggagaatggtggcaccaggagtgagaagggacagttagggggtcagtggggtctggggtcagattggaggaagcccacagggaggtggaggctgctaaagtcacagaagtttgctgtttgaccattgggctctccagggtatctggctgcaaacgatttcacacgttcctaccaccattgtgacacatgcctgaaatatattttgcagctcttctcctcaaggaagtagaggagtttgattaactttcaaatgtcaaaaatgtgctcatctgcttaatgagggtagctatctttgcctgcaacactggaggtacaatcaggatggccacgtaacacctaaatgaataatgagtcttctgggtttccaagaagtcccatgggggtctggaagtcacttcatattcttttgggatataggaagggcatgacttttaaatcaatatgcaggcaagtaaataaatatgcgttctggaacaaatcagcctggtgataagcaaatttactccacaactaccctgaaatgttgagtggttgttgagcatgtgtgaggaaatggggccatgctttccactgcacaaatttattttcctgccctattaactttaggctggaagccagcaggagacagccaacctccagcccgatctgtcacacccttttcctggcccagatcatctcgctcagaccatggaatactgggctaaaaataacttaattgagaaagtagcagtcatgaccaactagccagggagctagtaatgagggcctgggttggacctctaggtagctgagcaaaatgtaagggtatgattcatgcatgggagtcctcttggcctgtcaggcaactattcttcttggagctactgatcaagagcagatctgaaaaatgtaaaactccccaaatcctgggagtgtctgaggtacagaatgcacatgagaggggggaggacacttgccttttgttctcttaattggcagagccagtctggccctttccatggactgctgtcccaagcgctgagcctccttcattcctgccagggtgacctccatccaaatgggtccagaacagatccctggggcttggctagccccaggtctgtccatcagggttggctacccccacttcttatctggcattatttaagaatgggtctgctatatgccccaacaggtatcccccaagtcctaattcctgaatccatctttactgagacaagagatccttaacttcagttcaacatcctgtggcttagtagtgggtcaccctccaagtcctgaggggcagatgacccggagttgatgactgggttcctagcaaggcttcacagttgccttttactccttccccttttgtggtccccttccccttgaacgaccctctttcccttgaacgaccacctgcttcttgccttcctatgacttctaacactgtattcctcacctctaagctctactaccttgttggggcctgaagtgggttgaattgtatcctcccaaagatatagccacatcctaacccctagaacctacaaacattgaccttgtttagaaaaaaaaaaaaaatctttgcaaatgtaattaagttaaagatctcaaaatgagatcatcctggactatccaggtagacactaaatccaaagacaattgttcttataagaaaaaggcagacacagatttgacacagaaggggagaaaacacacagatgagaagaccatatgaagatggaagcagacacaggagtgatgcagccacaggaagacatggagccaccagaagccgaaagaggcaagatatggattctcccctagaacctttggaagaagcactgcccagctaacaccttgttttggaacttctggccttcagaactatgtgagaataagcttctgttcgtggctattttttatggctgccacagggacctaatacaaggccttcacaacttcttctgtaatctgcactttgagctcattgcatcctttagacttcagtgcttctcctctttgtcccgatttgcattgtcagtctcccagccccatcctttcaaagtgagtatttcttgcagtgggatcagattcagttcccctctcctttgcctggaagaatggatccagtttgcactgaagctttgcagagacatgctttataggcagtcttctcctagctggttaattttagggagacattacaaaacctgagtgtcattgtgtgctcccttttgctgtgtccttgagccagattaatgttagtttctcacaatacgtactacactgcttatgtgcacacttccccactaccttctacgaggccttttagtagtgatgtccttatcgaagggaattgaggacatgtttctgtgagatgtatcattttcacaattcctttgtgcagaaaaacactaatgcactcttctcatattctagactgtgccatgttgtttaaatcagagaactggaagatactttatttgatcatcaggcacagggaactcttttctcatcaaaagcaaacaggtgtcctctctcttcttgtagccttatcctccttgttacacagaaatgtacacacacacacacacacatgcacacacacatccctaccctccaagactacataaaggtaccaagataactggataaatagtaacttagcactcacaaagctgcacaaggaacacaggtttcccatgtgcgtagaagacttactaaatagatatcagaaagtttgtctttcttacctgggtaaagaatttggctttgtctcattctgctgatattagtagactcatctttttgtgaaacacaaaaatgaaatgaaggaaggagaaggaaggagacagatggagagagtatgaggggaaagaggaaggaaggaagggagggagggaggtaatcagaagccaacgctgtcctggatctgctctgtattacccttcttagaaaggtatccctatgcaagatattagaggaccagaggcttcctggaactacgactttttaatgcaactatgcaaactagcatgagtctgaattcacagttttgtcacctgcattgaattgaactaggcccaaaattaaagccaaaaataggcaacaaacaattttaattaacaaaaatcaaagtacacagcatgggatgttgtcctttcagatttggaatgttctggatgtgggagaggctagtgagcacttcttttaactgttggaatcattgaatttgtctatagcttccctatgtggcctctcccagtcagactgactctcccaggtggggaggagcaggtggctctgaggattcccaccaaatttcaaatctatttacagcctagtctctgtttctataagagagctattctatttagctaactgttgaaggcagttgctttgttccaaagtttagttacataaaataggagagttccccaacattcttttctgattaaaaacaaaaaaattatcaatgttttagtacggggagggctaatcttttataagttcactaaattgtgggttgtgggttgagaatttattaagaattaatgtttcacttctgaacaactaagttcgagtcctttgagacaaattaatgcagcatggaaatttatatgtggccaaaagcatcaagcctagaatgagtcaggttttaaagatgtcagaattatattcacaatgaaattgtggccagggctgctctgggcttttgtgtttcagccttgttgcctccagctgtaatggtggcaagagtggaaaaggtgtgcagcctgctatatttttggaacctttcggcctagctgggcatatgctagggctgatgggggcctgagactccctgaggctagggaagcccaaccatttagtttacgattccacatcgagatttcctgtccagcatgggtcacagagagccatttaaagaccaagtggctgacactctgaaaacactatagtctcggatgtttcctctcctattttactccagtgccactcaggtgatggctttgatcgagagcatcaggagcattggcttcaggccaacatgatcctgagaatggccagagtggagagaagaaaacgagcaggcaagccgactccctcagcacggagcagcttggattgtcagccatcactccaggaggaagtcaggaggaggaggctcaagacctcgggtcctcactttaaaaagcacatggctagtcagtaccagaagttgtttctgtttgggagtgcacaggaaggagtagctgccagggaagtggtggggtagaacagttcattgatatcaaaattatctggagaaccctttcaaaccaagtaggactctctccaaccagctggaaataaaagtacaggtgccaaaagctcccacctgtgtggcactactctgccaaggaggtagccaggaaatcaaaagtaagaaaaggattgtgagagaaaactactttggggtggtggagggggtggggtagctgttggaaggctgtggaattcttttttctgtactttttaacctactgaagctgctttgagggtgtcatctagagagcttggtatccaccccctgcagttagaatggagaagggctggcatttgacccatacctgagaagactgaaggtgacaggtcttggtgagaactggtccctggctggtgggccatactccccacaatggccagatagatctgtttctcaagaccagatgaggccatatgggaaggagggagtcagtctgggcctgaggtcgagggaggtgtttttcaaggctccctgcccaaaggcctttcttcccaagataaggcaactgcaacagatagagtcaggaggggtgctgtccagtggaaaagctggagggactgatgtgagtgaccagctgcactgaggttggtccaatgttcttcctgagagcatctctggggagcccagaacttgcctggcaaggaggacatctgccatgcctagggagtggcaatgccagaccactgcggtgccagccaaggaagtgctttcctgcctctgcagctcctcttttccctgacaccactgccttccaccccaccctagagtgggaggagaacaactagaatgaatgcaggatctgtaagagctggcatcacgttgagttttatttcttggctagatgatagccactgggattcctggggccaaacctgcctatttctctctgcccttattattgaactatgtaatgaacatatattatgtgccaagcctactattaaactcttcacatatggttctactgttaccgatggagggtcttgaccagaagttgtccaggtccttggtattttgaacaaagaactgaacaaagcacacaaagtaaccgagtaatgaaacacaggaaccaagcagcaaaagcaggaatttatgaaagcgagaaagcactctgcctggtgggagtgggcccaagcaagtggctcaagggcctggttacaaagttttctgggttttaagcaccccatttgaggttcctattggctaccccttgtctggatgaaggatttggtctgtggctaactaaagactgaggtgaattggtgccctatgcagataaagggatggtccccgcttggcccagggccaatccaaggcactctcccttttccatctgagacttggtggaaggaggaggttggtagggagaatagcctttgatcctttgctactgggaatgggagatggggtttttcctttcggtttagcttcaggaagtttgcgttaattggctttaggttccctgcccccaggcccaggttttttctttttgatccagctttgggaagtcagtgcaaattggccttagattccgtgcctccagaccttgatgtttttccttgattcagccttaagttcccttcctccagaccctattctcctgcctcactacttttaatctttatgtccaccctttgagatcaccattattaacatcgttttacagatgaggagagtcatctaaggattaagcaaattcacctaagtcacacaactagaaagtgagggttccaggatttgatccagagagctgaccccacagcctgcatctgcccctgtgatactgcctaccagagccctgtgtcttctttgtgtggacacaggaaagtagggcatgcttctagaggcattggcctgaggcaacagaatctaataaagcctctgtcctggggaccttctctggcctggcttcttggattctcaaaggagtgataatgggactccagccagagaccactcattatccagctgtgagtgcacaggaaccttgaagagaccttgttcattctaaccaacagtatttccagcgaagtttgttttcttcatttgtgcacatacagccccttgcacatttaagaaccacttatataatgagagttgactggatgaatgaatcaaaaagacatcgaatattattgggtgtcatgttttctctctgctaggcagtaaccagtgtgtttacttaatccagctacaaaggaaaagatcccactctcagcaaccttccctttatgggaaaagtagaaaaggcagagagggaagaaatggagtggagggaaggacaccctacttcacccctccatcctcatctcagaagggaaatagagcaagagcagtgtttagtttctgaagtacttgtgacaagaagaccatgagtagcttaaggctataaaccaccttggtattaatttcctaaatgcttaattctgtgaaactcctctacacatctcccagcttatcactagcaccacagttttctgagtaaagtattagccagctgtgtttcttgcaagaactgattgccaacagaccctgaggcagctgggactccaccttttttggactgggtacaaaagagatgttgagctgggtgttatcctggtactgaagaaagaatactgtgatttctaatgatgtctgtgagtggcctcaaatacaaattgaacaagatggctaacagcattgtgtcatgaaggactctgcagctgaggacctctggggttcaggaacctctgggaagtgagccttttttttttttcttacagaaaaaaaatgcacttgaacacacaaggttattaactcacatgcctttacatgacacacccacccatccctgcaaacacaccagcacatacaccacatagggtacagatgtggttttgacttggagcactgagcaattttctgcttttctttttatccttttaaaagcacaccaaattaattgtggccaactacctataaatccctttctctctgccaatcagggctgcctgaacaggcaagaggcgctctcacctgcctcgttatgcaaattgtattcaagtgctgaagaacaatgcagccttcagcactgcaatgattccaggttgctaatgaggagaggctgctgctagaggaattgttttaaccctctgatgctgaggcaagaaggctgagaaggcatcaagtggagatggaggcagagtcaaagtcaatgccagttctcagcaccagacagggtgctcccagagcaccattacctggtgcaacttggcccctgatatagaaggtcacccccgggtctgacataatttgggataatttggagtccaaacagtgtgggcagaatagcttgatttcttaaatatccctgtggtctgacaaccataagtacatttttcaggttatggtggacatctgcaagcacagggtctggcatggtcacaaatgtatcgatcctcagaatacctgtagtcaagggcaggcaggatccaccaggcaaagggcatgagaacgatcaacacacacacacaggaagaaatcaatggacactaagacctcacatcatgagattagtttgaaaaagacctgtaccattcagccattcattcattcaggacctgctctatgtggagcaagaattatttcattctccagtaatcacagttgtcaggacttatttctctcttgactgcttcaccctgttaccttgccccaacatttcagaatctcctcttggaatttcaatctcacctctcaaacccaggtaatcaaaaaggggcttttaacacaattatgtaattgtcatgctgggactctgtgtgagccagacagtttatgcagtagtaaggggcatttccgctaggcagctgtggtagcattgccttggaatggggcaaaaaggaatttggtattgggaagcacagcagttctccagctccttttgaagaaagtctttataatgcaacttcaactctcagttggaaatgccctgaaatcacacgttatccaatacacccatgctccaagatgagtttccccaggttacagatggcctagacaagcagccactccacttctgcccttccacttggcactactggcacctccatgtgagcggctttttttttttttaatactttaagttctagggtacatgtgcagaatgtgcgggtttgttacatagatatacacatgccatggtggtttgctgcacccatcaacctgtcatctacattaggtatttctcctaatgctatccttcccctagccccccacccccttacaggccccagtgtgtgatgttcccctccctgtgtccgtgtgttctcattgctcaactcccacttatgaatgagaacatgtgatatttggttttctgtgcttgtgttagtttgctgcgaatgatggtttccagcttcttccatgtccctgcaaaggacatgaactgatccttttttatggctgcatagtattccatggtatatatgtgccacatgttcttaatccagtctatcattgatgggcatttgggtcagttccaagtctttgctattgtgaacagtgccacaataaacataggtgtgcatgtgtctttatagtagaaagatttataatcctttgggtatatacccagtaatgggattgctgggtcaaatggtatttctagttctagatccttgaggaattgccacactgtcttccacagtggttgaactaatttacactcccaccaacagtgtaaaagccttcctatttctccacatcctctccagcatctgttgtttcctgactttttaataatcaccattctaactggcatgagatggtatctcattgtggttttgatttgcatttctctaatgaccagtgatgatgagctttttttcataagtttgttggctgcataaatgtcttcttttaataagtgtctgttcatatccttcacccactttttgatggtgttgtttgttttcttgtaaatttaagtgctttgtagattctggatattaggcctttgtcagatggacagattgccaaaattttccccattctgtaggttgccagttcactctgatgatagtttattttgctgtgcagaagctctttagtttaatcagatcccatttgtcaattttggcttttggtgttttagtcatgaagtctttgcccatgcctatgttctgagtggtattgcctaggttttcttctagggtttttatggtttttggtcttacatttaagtcgttaagccatcttgagttaatttttgtataaggtgtaaggaagggatccagtttcagctttctgcatatggctagccacttttcccaacaccatttattaaatagggaatcctttccccattgcttgatttttgtcaggtttgtcaaatatcagatggttgtagatgtgtggtgttatttctgaggcctctgttctgttccattggtctatatatctgttttggtaccagtaccatgctgtttttgttactgtaggcttgtagtatagtttgaagtcaggtagcatgatgcctccagctttgttctttttgcttaggattgttttggctatgtgggctcttttggttccacatgaaatttaaagtagttttttccaattctgtgaagaaagtcaatggtagcttgatcgggatagcactgaatgtataaattactttggacagaatggccgttctgatgatattgattcttcctatccacattatccttacagcatctgaaaaattagtggttcagtaaagaaggaggaatgacttaaaatagttcccaaggcaatctgtaaactgggccttcatgacccatgtaaagtggccttcatgaccactacatttttttagcatgcttttatgtatttaaacttccagtttaaccctttatataaacaacaaaaacaattttggggaagttgaatgcttgtttaatcacacatcagtaagacattgttttcaaattatcttccttttaacacctagatgtcatcacttagaccgaaagaacagggcttttgattttgtggatgtgaaaatagggggtgtcaggcttggatgccccaaaaggaggttaggaaagcaccagagctcagcaagtggagtacaggtatagataaatgaagtatgggggccagctctgaacccaagcaaatgcaattcattttcctttcctccaatacttcattacccatttctggcctttgtcacccccatgtcatgggtgcaactggctagggctacatcacaggtggtaaaagaatttaccaagacagttgtgggtaaagaaaggcagatttattagagaaactaagaaaggtgcattgcaagagtgcaacaggcagtacagcagagagaagcctgtctgccaagatgcagaggatggaggggagttttatagggtcatgctggaaaggctactgcagataggttcatgctgctggggctgtttggaaggaggtatttgggaacaggatgtttgtggttagccatttcttacaacaatagcttgttagccacttcttagaacaatggctctcttctaccctcattcctgttcctgccagcgagggcctctttcttgtttctatcaacttatcaagactccacaccccagacacccacccctgtcctcctacaatggcccaaacacacccgtcaccctccactagaatcattgagcaagtgctcatttccttcactgaatcataagctccttgaggcaagagacatgctttcaataattatgtctttccagctcctgagacagtacctggtacattgtagaagtttattaaatgagtaaatgttccaagaacataagctaataatattaacacaaaagttctgctctcttttggattaaattggctttaatgagccaaccacttatagtattgtttcttgggggcagcatatttctgtttgtgagcagctgatttataaatgaactattgaggacaatgtgttcataggttggagtctgcctattgaaaattgcagtccaaagccaaaaatatattaacctttgtattatgtgttcttttgcaatattagcaaccatggccctcattcatggtaatcacatgaaaccacatcaatagttacagtctcagagagcatacctgtcattagtgactgctgggtggcattctccaggctagatgctttacattctttgactcatttgccatctcccacttttaggtagatgctacctctactgtgcagtagagaaaactaagacaagaagctatgtgatctggctaggttcctaaacccttctcatgcctcagtttcctaatgtgtagaatggggattaaaatgttacctactttatagctgctgtgctgatgaaagagttactctttgtaaagcttagaagagtgcctcaagcatgctaaatcctcaataaatattagtggtcacgtcctacatccacccagggttcgctcctaaacccagctcacaaagcccacgctgtttctagcagatgattaacatgtgccctgaaagccacaaactgctacaaatacacccaagagcccaccactcagccctccttccaccctgcttgccccaggcactcacttgtttcagtgagattttgaggtgggagtaggagggctggtggagggaaggtcaaacgtcagggctaaaaaagatgtggaaggggcagcaggcgagttgcagtgcttagaccccttgaaactagctctggctccgaggatgcctggatgaagagcatcttcatggccctctcagacaagaggtgcctagtacctctttgcagccaaccttgtgggtcttttgaaagcatgctcccagcatcctcctaggcacatagtaagggctcagtgagcatttctgaatctgtgtcttttgcccatctctgtggtagaaaacaatgacttcaagagtgagcttcaactatgattccacctgactactgggctctaccccaaggaaatggtttctcacaggagtgggcaaattataaaactggtctttccccagcaattccattgccgggtatatgcccaaaggattataaatcattctactataaagacacatgcacacatatgtttattgcagcactatttacaatagcaaagacttggaaccaacctaaatgcccatcaatgatagactggataaagaaaatgtggcacttacacaccatggaatactatgcagccataaaaaaaatgagttcatgtcctttgcagggacatggataaagctggaagccatcattctcaacaaactagtgagaaactaacacaggaacagaaaaccaaacaccacgtgttctcattcataagtaggaattaagcaatgagaacacatggacacagggaggggaacatcacacaccagcacctgtcgggagtggggggctaggggagggagagcattaggaaaaatacctaatgcatgcggggcttaaaacctagatggggaattgataggtggagcaaaccaccgtggtacgtgtatacctatgtaacaaacctgcacgttctacacatgtatcccagaacttaaaataaaataaataaataaaaatttaaaaactaggtctttcttaaggccttccctgcttgcatggcatatattgccaaagaattttctgttccttcagacactcagaaaaagtaaacctaatttattctacttcaagctctctcagagacttagagaagagccttagtttcattgcaaattattgatgcagccagataatttataacatttctaagtttttaattaatacccattttgactactgtgtttagcaataaagttgtttttattgccatagttgatagtctatcataatctgtccactattaaaggaaatactctctctgaaggccccttgccatttggaaaattcatagtaatttcaagttagatgtgagtttgggagaggccgagtcccagtggttttagttcctgaagctcctcttctccattcccagcccagagagcttgtcttccaacctctataccacatagggtttttcctggcaaattcattcttaaagcatactagctattaatgtgacttatcctgtgtatctgttagttgcaagtagaatgtaatgatgttctctaaatgagggatacaagtcagtttcattgcttttcagtctcaccgcctacttttcatttattcattcatcagatagattctaaatactacatagcacttactggaatagagtataggaaaatcagaacagctctgcataaacataatctctgatctttttgttggtactaaggttagtgtccaaccacctagtctatctcaggagtccttagcatctgccagactgcctatagctaaggcctagaggccctcagaatagaaaagatcagtagctctgttttgttatctcaaagtctctagaaactgccaccctcaatcaccttgtaagccccttgttcaacttggattctacctgttaccaaaatcctgctcctgtcctcatttctttgaattaactaaagcctctgttgtatcatctacctggcttttaaaagttactatatcctctgcatttaaaataatacctagtatataacaacaattagcttaatcgttattgaatagttactagttaatctttgaatagagctaacagatttagcaaataagaatacaggacaccgagttaaatgtgaatttcaggtaaattgtgaatatgattttagtataagtatgtcccaaaatgtcatggaaaccctaccttgtgagacgttggagatatgctgaaacagccctactctcagagtctagtgagggaggcagacacttcgttcttaaaaaataggatggtaaatacaacagaggaatttcctcttttgctcctttcaaggctaaatatagtcttaatcttttacaagaagacttgctcccctcacttttaatcatttctgaaccttctgctgtgagttatggaagagaacacacggtggtcagaagccctcctactggtgtataacgcagcctgaccacatccattccacatattgctctttagcgtccagtgacaggctctttattttaaaaaagcagcactgcattatgtatgcatgcagtatgtggtcaggtagaactgcatgatttttcttgagcatgcatttgacaaagcctgttcctgtcccttctagttctagtgcagtgtggttttacatcctgtaagaattattttgtatgcttcctaatttaacttcatccttttaatatcttcttttgtcaggccagacttactgttttgatgtttaattctatttctcaagtagccatccatccaatccaatttgatgcctacagcaggtttaaagagcaggttttttcatcctgtcacttaagttattaaagaaaacaagacccttccctgtgtgtttaataagttgccccacactcccaacaactggtcatgtctatcctttcactaagtatctcacctgcctagtgatggagcctcttatttgaaagagaaacgttttattttacagcattctttgctgtaggttagaaacattttccatttgttaattagctcctgccttggaatttcaagaattttgaagtaggctaccttctctgtaatccattgacaaagagaacatgagatgcacatttcagaccatgaaaaggattcagtggcctggtctcatgatagaattatcatggagttcaataagaccatttgtgagtaacttcccactaggtaggtgaggaagtatcccaattagtgagtctgtttccctctaatttgcatgtttaaactatattaaggctggtgcaaaagtaatcgcggtttttgccattcggttttgtcattaaaaaataattacttttaatggcaaaaaccacaattacttttgcaccaaccaaacaggtgtgaaattgactcatcgagaatatttccccaaatatctgttacaaatcaaaggcaagctattataccagtaatcctatttcttcagcccatttgcttactctagaaaaagtgtctgctccaagcctgggatgaaacaggacttctgattttaagtggaaaaaataaatgttaatatgtttttccgacataaactcgaagttgttcttctgaaaattcagctgggtgtggtggctcatgcctataatcccagcactttgggaggttgaggtgagaagatcacttgagcccaggagtttgagaccaggctgggcaacaagacaaatatctgtctttacaaaaaaattaaaaattagctgggcatggtggaaagcacctgtagtcccagctacttgggaggctgaggtgggaagatcgcttgagcccaggttaaggcttcagtgagctgtgattgtgccactgcactccagcctgggcaacagagcaagaccctatctcaaaaacaaaaacaatacaaaaaaaaaaaaaagaaataaaaagaaaagaaaagaaaatgtacatcaggctagtggggctagactcagagaggaagatgcttacgagtggtatattgttaaagacaagggtttccagggaatgaccagtctaagttcaggccaccagatgagtatctgatctaaaatttggaagaggatctaaagaaagtttactcttctctgtccttccatctttttatatgttaatagaatttatatgttgtatggtgtgatatattaatatttaacatatttataatatttaattgtctcttcatactagactgtaaactcaatgaaggcaagaatttgtctgttttgttcactaatggatctgcagtaattaaaatagggtctcgtacatataggtgctcacatattaatagatgaattaattaaccaactagtcaatgaatgaatgaataagaagacagttatgtaattcatatagtgtccacagcataaggcagtacttttcactctttattagccatgtgaatttgagaacagtgaaagatagtttcatgaccaatggttgagggggaaggaagagagggtaatgtagataagaaatatttgacatttagaatcccagatagaattttctcaccttgtggtttctatgcctgtcacaccatctaaatcgggcaggtatttcagaagagaactgagtaagtgaggtctccaactgtgctgctatgtggcttgtcggatcttaaattataaagttctttcaggacctatttggcaatgacttcttcaaagcccctgattattcctcggctcctgtgtgagacaggcacaggagtcccctccttgtatgcatgtgttaagcctgccctgttctttgaatggtgaggcatcggcttcccagtcagccaagtgtttgctgagaactttctattttcataggaaaatatcgcttctgtaacaaaaagtaaccaaccctaaaataactatgtccccttgccacttttagaggggaaaagatataatgataacaaagaaagcttatataaagaaattattaaaagtaatgacagtttctaggatattcctggaataagtacatagtaaacataatgtcctaaaccatgtatggtcttttgtgtcttaatttctgtatatcatttacctccctgtatcatgacacatagcagatgctcactgaatatgtttgaatgactatagtttagaatgattttcatcaaaagggttgaaagtaagttttttggcttaacccttagtcaactggaaaaattgaacttcatttttctaccaacgtggttattgatatttcacttttgtagcagtcaccttataataattatgtttgcattataattggaggtccattaaggacaactgaagtacactggcatcccattagtcctaaaagcctgagacatggaaatgtctgccgtatcttgctgtcgactgttcagggcagctcctggtgcagagtaggtactcaatacatgtgtggagactaaattaaaaacaaaagagatggagacagaagcagacaatggctgtttggtcttcgataggtaatgaatttcccaggcctctgtttcctcctctgtacaggcagaaagttgctcaactggcatttctcaaactgtttcatagcctatgagtgttctgggaaacataatggctattcttgagaaaaagaaatccatgggaaaataagtttggggaaatgctgtgtcagggttacataagtttctttaccaaaggattgttcgagtcctctcctgtgatggtccgttgtgaaccccgaggggcatgcagtgtgcgtggtgggatcgccaggctgcatcccaatactaacattccataaaccggagtgtccctcgcatagggctgactttattgaccaaaggaagaagctctgctgggctgtaagtgggtcacaatgtgacagtaagtacacatgctggcatttccgtgcctcaatttggaactgacagatctgattgattgccaggagggcagagacacacctgtccccctgccttgcctgtcactggatcctcactcaccctggcctccgcctggcggaggtctttgacatttccgccccaccccagcttcatgactctgaagatgctgataccgtattagaacctcaggtgattgtgctaataactggagaaccctaaattcattgggaatcttgcatgtggaaatcttggtagtcttctttatcttctttatctcctccaaaattttatgagctgctgaagctcctggtacaacttcagaatcccagtttccatggtgaatccatctgtcttctttacttgaaagcttctttaaaggccatttctctttgctagcacccacagcttttataaaatatctggaacaatcccttgtaccctcccaagttggtctgtgaggtagagtgcagtggacagtaataacacctctttgtaacaatcttgtgtaagaataggttgaaggagctcaacgaaggccacctgtcacacacaggatgacttaaggataaaactcaaatgcctctgtccttatgcctctgtttcacttcatctccatgttatcataatcatctctaactctgtcacatttttggtgccaaagaaatattcatatgcattgtcaagtcctaagtctgacaggctcttgcgggatttcagatctgatatattttgtgaaggaaaaatggagaaagtgccaggaaagatgtccttgactggcattaggacacattaactccttattcaccagagatgctaggcttgccctagatctgaggaatgttaatgctcaactgtgtgttgcatgataatgtatcaacagctaaatagtgcactttgaatggagtttttcatataataaatatatccacatgtgcgattcaattcattcattctttaaatcactcattcattcatattgagagcttactaagtgttggatgcttttctaggcactagagatacagcagtgatcaaaacagaccaaaactgtgtccattatattacattctaaggaggaaagggcagaaaataaaaaggcaattaagtctggcccaaagttagtgagggatcaatatatgtggatatccagggcttttggggcagagaagagcatgtgagggtaggagcttgcctggtgagttttagaaactgcgaggaagccagtgtggctcctgaggagtgggtgagggaggagagtgggagagaaggtggtggggatgaggctgactctgccgcttcctctccttcgttcttctgaatgtataggcagacttggattcagtcaaggcttccactctgatgtctttctttttcatttatccctcccattattttccctctgaaaatagtccaggctcttagtagttttccagtaaacgtcccttctctaacctctctgttcttcgagccatgctgctttagctgaacaatagctacacctgagcactgtggggttcacagtgtccttcctcagtctgaccattcggtgtgctccatgggatggtttctatctaggcgccaaacattcctcccaacgtcagtgcagatgccatgctcacgtcccagtgcttcttttctcatgctatttcgcttgccccatcaccctccccagacctctttgcctggataaacttggccaatctggaggagttggctccatctctgcctgctctgtgcagcctccccaaccatatccttttgtaatgattttcactccctctaaacttccgtagcccttcctttccttacctcccattggataggcatactaattcaggcactggattccttaatctgtacattttctgagcatccattctatttgcatagagccctgtggtgtgttttacagttaaatatgagtatcctgcatttgaatccttgctctgatagtttctagctgtatggccttattcaaattacttactgtctgtgcattagtttccctgtccattaaatggagataataatgcctacctcatagcatcaatgagaggatcaatgagttactatacgtaaattatgtgacacatggtgagtgctgtagaagcattagctgctgctggaattatataattatcatcatcattatttccagctaaactgtaatggtagggattgtatctgttgcctcattttatttcagagctcagtggcttatatgtggtttatgccctttaaatgtgtgctactgatgtgatattttatggccagacacaagactttgccaaacacttaaaacctcaaggtgcaggttatgatatgttaaagttaatatagttaatataggaataaacccactttcttggctctgctaactcagggaccaagcctcagctagctaacatgccattatctgattttatgaaatatttcaggaaatattaaggcttatgtatccaaattttataaaatacaaaagaagtgactgccttattgcattaaaaccatcgttgcgaggaaaactggtaattaactaaattccaggaatctgaagaactggtgttttatttgctgcaagcttttgtttcggctccagcaggagggtgatgacaggagaataagttccagtcctcaccacccccacccttctaagacctattatagaaccccagctccacgttgagttcagagaggcacaaaattccttccccagcagcacagcatccagagctgtgaagatacagcctcgaatgacagcacagccagaggcaggagaaaggccacttaccagccttctcacatccaagtgcaggtctcttcatatgtaaacttaagggtgtttgccactgtaggcaattatagcactaatgttaataataagaggaaaacaagcagaaacaattaaggtgttgaatgcttattatatgccaactccctttttggcagtagcaaaatgtcatcagattcatcaggggcccaggaagagaacagagttaatttgggcaattttcctatataccggtagcttctaactacattctgcaatattattgtttccataattcagccatgccttttgaatgaatttgaacaatattctctccaatgaacactttataatgaaatataacaataattatttattcctcttacctccattccagattctttcatgaaggtgaagggtttaactttctaatctgtcaccatatccacagccagtttgttttaggggtagggtcttggggggccactccaggccccatgttttgagatggaggatttgtagtgagatgctataccttatttctccttttggaacattgttaaaattcagtttcaaagctaagtggcttgtttattgagtcacacagttaataagtagtagagctcagatttgaacttagatctttgagcccataacccatgtgtttacttacgttttatcaataaattgtcttttttttttttttttttgagacaaagtctcactctgtcacccagggtggagtgcagtgacacgattttggctcactgcaacctctgcctcttgagttcaagcaatcctcctgcctcagcctcccgagtagctgggactacaggcatgcgccaccacacctggctaatttttgtatttttagtaaagataggattttgccatgttgtccaggctggtctcaaactcctgacttcaggtgatccacctacctcagcttcccaaagtgttgggattataggtgtgagccaccatgcctggctaaaattgtcttttcactgtaagcacagattacctccttttcacatctgtcccaagcacttatgggccatggaacagtgaaggagctcatgctctcagaaagtctactccttgtgtggtcacctgaccttcttcttctcccactgggcccgacaagggattatggtagaagaggagagagggtgcttcctgcagccacttcctcccctctccagatgctgcccagagtctggaatcacacatacatatcccttcaccctaattgggccatagggtattattatggaagatttagtgatgggcaacatggtttggtgcaacacccctgggctaaggaagataatatcagtttctgtacttgcttgatagttcctggaaaaactgagaagatcaaaagatagaagagctgtaaaaaactttgggagcatggggcatatgactcatccctcccacccctgaatatttaccttagaaaaatgaaaacatgttcactcaaaaacctgtacatgaatgtttacagctgctctattcataattatctgaaagtaactcaaatgtccttcaatagataaatggatcaactggtgcattcacataatggaatactactcagcaataagaaggaatgacctacagatacatgcaaaggcctggagatgaatctcaaaggcattatcataagtaaaaaagccagtctcaaaaggttatgtactacaggattccatttatatgacgttttagaaaaggcaaaactatgggatagagtggctggaggttaagagcaaagggagtgtgtgacttgaaaggagtggcaccagggagctttttgagaaatggaattgttttgtgtcttgattgtggcggtgactgcaagattccatacctggttaaaattcatgacaataaaagtcaataatttaaaagtactattaaaatataaaatagggtaatgacaataataacaggagggtgctgagtaggtaaaaatgtggtgtcttcagaattctgatgtgctgccacctcctcataattagcccaggcccaaagccattcacatctcctaagcctttcccactttttctcttgggtgcctggaagggctgagtggcatttgggcattgattctttttgtgatgcaaatgtaaaatcagaagtaatggaatgaatatttatgtgtaggattgtcaagctttgaagacaaaagcccccagattctatatctcatatggatggatccctgcaaataggatgtgcaatatccgcctctgcaaggtcacagcactggtttgtcctaatctgcatatgctgattggacacagactgaatgagtagagccatttttcagggaagccaactacccaagaaggcagttcctcaccatcctcttcattttaacagagctgctttcatttatgtgctgttattcaccggatctgactctgattattgtccttgggactgggtgacagctgatcaggagatggccttgactggtggtcagaacgaccactgctttgacaccatcagtatttaggacattcttggttttgttttcagaatctgctcctctcctggtgccaggaccttaaagacttctcaacaagtatgtttcttcattctcaccctggaagctaaccaggttggaggagtcttaaagcagagagttcctctggtgtaaattgatgttaacgccccatcgccacccttccaaagccaatccatcctccctgccagcttcaattcagcctccttctagaagcctttcaggaaatttatatgtcaatggcgtgcacctctgtggtcttgtatgttagctagtagtgtagggaaatatctgacaatgcgtctgttccttcttatccgactgtagcacccataccctcaccagagctcagggcctcttcagctcttgtctctccatcttactcctttcaacctgttctgcacaccagcacctggtgactttttctaacacaaaaacccaatcttgtcattctggcagagttcttcagttgcttccaatggcgatgatgaagatgatgatgacaatgatgatgatagtaataatgatagtaacaatagctaacatagtgtatttatcagccaggcactgtgccaatactttgcccagattgactggttgaatacttaaactttatgaggtaggtgctattagcagcccattgtacaaatgtagaaactggggcacagataagttaagtgagttgatcaaggtcacacagctatcaagtggcatagctgggatctgaatcaggcagcttaactccagaagctctgctgtttctcatcccttatattatgaactctaaactcctttgcacagaattcaactttctttgtgatccaggccctgcttccttcttcagctgtgtcaacctcctgtcaccatggccatacctgctaggctctggcaacaataagctgctcgtggtctctgatcatgcccaatctttctcaccaccttgtgtctttgaacagacactcgtctctatctagaaaccattttgctcctcttgtttaaatggttaagtcttagccccagtgcacaggctctgggacaccatcgagacagcccccttgttctgttctctcactgctgcatgggcacagctgctcatagcacccgccacattatttatagcccctggtcacaccaagcttgttcccccatgtcagaacctttgcatttgctgtttcctgagcctgatacattttcccccttgtctttgtatgtctggttcttcaacaggtctcggttcagatgccaccttctcagagaggccttttcaggacagccagtctaaacttgttctcctaccaatcactctttatcctattatgctgtttcaatttcttcctagcacttctttttcactatttgaaattatctgtgtttccgtcacctattgctacacagcaaactagcccaacacttagtggcttaaagcaagaatattttattatattttactggtttgtgggtcagatatttgggtagggcttgcctgagtgattcttctacttcatgtagcatgactgatattcagtgggaggctgggctggagagtccataatggctttactctaatgcctggctctgactggaatgggtagaagtccagggctcagttaggactggagatgggagcacctataggtggaatctccggcatggtggcctcagggtttttggacttctgacatggtgcaccgattctctcagagcgaggtttccaaaggccaaggtggaagctgcaaatcttcttatgcccttgtctcagcaatcccacagtgttacttctgtcaacttctactggttaagcaggtcacctaggtcagctaagaatcaaggtagggaggggacatggacctgtttgtcatagagtggcaaataatttctggcagactttagtcaaccgaatgggaggctgaggtaggaggattgcttgaggctgggagtttaataccaacttttacaacatggagataccttatctctacaaaagattgtttagaaattttaaaaataaaaaacaggcttactgtttgcctctcttctttataatgtgaactctttgaaggcaagatcatactcttctgcaatactgcatcttcagcacaggcatctcctctgtacacaataaacaccaacaaatacttgctgaatgcttatataaatgaatgaaatcaataaatacatgaaatgaaaaagtaaatggatgaaaaactgaatgaatgtttatgtttctgactctctgtaatgcaaactccttgaaaactgggtctgatttttttcatctttgtatctctgttcctaatacagtctcctgccctaatagatgctgggcaaatatttgccaaatgaatggatgtattttaattatcatagttaaaggagataatgtaacttatacccagtacatacataggtattgaataagagtggcaattattaatgacttacaatgcctaatacataggaaaatcaatttatatattaaaaatggaccagatccgtacttcccttacttgctcccctcttcctttctttctccagcaggctgtataagaagctctctagcggggaggtggcagccaaaacagcccaggaccctagtgtctgctcatctctgggtgggggccttgactcctggcccttgagcacctttctccttgcatggctgctgagactaattcactttgaggtcattaagatggaggctgagatgatctgaacagctcagagggctgaattctgattccctgctgctctccaggaggatcaaatgagattacagctcttttaacattctggcattgttttgcccttgtgcaagtgtgtgctcacaagcaattgctggaagccctgtgttaaatgcggtgggaaggatgggaattggcatttgatttgccacaaaaggaagatactctatgtggccccacttacagtgtgtggcttcactccctagtaggcagcagtaggactgttcagctagcatttcagctggcaaaaggaaggccatactcaggggtcaagtctcagcttgtcctccctctacactgtgtctactggaacgacttgatctcttcaggacttcggtttcctcatctatgaaatggggcctgtcctgtctgtgttattttcctatccaaatctatgtgttgataattccaatctgggtgactcctagaaaaagattccacattcaaggaagctctatgaccaaaggtgattaataaagagtactgagcccagcatggtggctctcgcctgtaaccctagcaccttgggaggccgagcagagcggatcgcttgaggccaggagttagaaaccagcctggccaacatggcgaaaccctgtctctactaaaagtacaaaaattagccaggtgtggttgctcacatgtgtagtctcagttacctgggaggctgaagtgggaggatcacctgagcctgggaggttgaagttgaggtttcagtgagccaagatcgcaacactgcactccagcctgggtgacagagtgagactctgtttcaaaaaaaaaaagaaaaaagaaaaaagaaaataaagagtactatacacatttccctactttgaaatcagactgagttttttaattcaattactgagctccctgatatattaggcttttaaatttgtttaaaaattattttttcagggtcctcactgttctattaatgttaagacattctggttcttgacagcgctaaatttttctcgttcccaaattgccactcaggctaagcaagtgccatataatgtcttacagcttggggtaagttttattacaagggcattttctggaagcatcaggatatttggaaattatttttccttcttccccacgggcctccctaaacagttctccatgaatgtgaattttagtacagttcaagttccaatgacagtataaaaaatctctgttttatgtaaacttcacagatctcaccaggctgggacaagaattttcaaaagaaaaggcaaactcactgctttggctaattctgaggcaatgttctctccctgttggcctccagactggcctagtttaaggaacaaattagagaataagaattttcaaacttagggaacattgccttacataggacaattttaaatgttagaacttcatctccatagaagcaactaagaattttaagactccatcatgtgccaggtattaagtattttttttacatattatcttattcattaaaataatacttccagaaaagagggtaggtccataaatttaaggaacttgcccatgttcatgcagctggcctgagacaaagctgaaatccaaatccaaattctctgcctccaaaccagcacttcccttcttcccagtactgactgcttggtttttctgattattttgattattattattattattattattgttgttatcattttggagacagggtcttgctctgtcacccaggctgaagtgcagtggcacaatcttgacttactgcaacctccacctcctgggctcaagcaatcctcacacctcagcctcccaggtagctgggactagaagcgcatgccaccacgcacggctaatttttatatttttggtagagatgggatttcaccatgtttcccaggctggcctcaaactcctgagctcaagcaatccacccactttggctttccaaagtgctgggattacaggcgtgagccactgcacccggcccgattattttcatttgaaggatgccttaactatataagtcttgctatgttattatctaattcctttagtgttttaatagctttaatttattttcaaatacttcttcccagtcggtggcttatcttttttatgattttaactgcatctttcaaaaagttcttatttttatgaactccaatttatcgtttaccttttttggtggattgtgcttttggtgttgtagctaagaaatctctgtctaactcaagattacaaatattttctcctatattttctataagttttataattctagtatttacattttagatatatgatccactttaagttctgtgtatcttatgaggtgtgaaatgaagttcctttttagcaaacagatgtctaattattccaacaccatttgttaaaggccatcctatctccactgaatggcccttgcaccatatatgtggggctctgttagtgggcactctatcctgttccaatgatctgactgtacgctaatgccacactctcgtgattactgtagctttataatgaatcttaaagtcaggtagtgtaaatcctttaacttttttttcctttttcaaagttatcttggctattctagaccctttatcatttctttagcttttatttattcagggatacaattacaaaacaggatttagaaatctaaaaataatttaaaattaaaaattactatataaagagctgtatgaaaactacctataatgtagcttcatcaggaagtgaggccctctgggcactggattccatttagttaccataaaatttagttgcagataccttgcatggattgccatttttttcagaaaaattaaagtgtaataatttataccagaattgtattggacatgattgcaattttcactgatgtttcagaaaataccttgggccctagagtatcttagtcattataaacatcagttgtcattgtcctagtattgtggggaattactgattaaaaggagttaattagttgtattgctatctaccatagttatttactctacttttgatttgaggaatatctttcttcaaacatctgaagtgttgtatttgatagtggtatgcaaagcattctggtgtctgtctcttccaataaagcatatccctatttactttaagcttgctatctgctggagacagtgaggagtgactattaattaggcgaattgagctctgatctgttagctatcaatgccactgtgtgatgtggagcaaattacttaccctctttgggtttcatcatttgtcaaatgaaaggtttgggctagttaaccctgagtggcccatttggctgtagatttttcttactcttttgtagtgtctttatccacttaaaaattataacccctttcaaaataatcaaacgaaaacttctaatgtcaaaaagccctgtgatgagtcagagagggagctttctcagtcaggaagtagtagttgtttggtgcatcacagattgcctaacaccacggcatgactctagttttaaccatggccagcactgagcaattaagatggcatttatggctcctggtgctgagatattttgtggcccatggaactcccatattctaagaaggaaaagaattacttctaatcccaggcaatcccaaggcttcagagttctcctgagttggcaggttagattttcaaatgtttctccaaagtaaatggtactattacttgaaaccaagaggacttcaaatatcttcattgtcgttccgatgccaaagcacagcacagctacaatgatcattgctgtactaatagaataagaagcttagagagcgggtttactaggaaatgcagaatagagacacaaattaaaaataatataagagaacatttattgggcacctactgtgtgccaggtgctgtgccaagcactttatttttgagacggagtctctctgtgtagcccaggctggagtgcaatggcatgatctcagctcactgcctgctctgcctcctgggttcatgccattctcctgcctcagcctccggagtagctgggactacaggtgcctgccaccacgctcggctagttttttgtatttttagtagagacggggtttcaccgtgttagccaggatggtctcgatctcctgacctcgtgatccgcccgcctcggcctcccaaagtgctgggattacaggcgtgagccaccgtgcccgaccgccaagcacttcttatgcattatattagttaatcctcacaacattcttgaaaattaggcattatcatctccttcttacaaatgaggacaggatgcacagagcgtttatgctacttgcccaaggttacacagtggtaagtggcggagctggtcttcaatccgtatctgtttcaatctagagtttaaactcttaatgatgacatcagagacgagctagcacatttagagagtaattgcatgtgtaggattacagtgatctaaacaaagaataacaggttctgatgggtcactttggggtagacttgatggaagaaagaattcacagaagatttcttgaagaaattgttttgagttttattttgaaacggatataaattggcctagagagacagatgagttggcactgaggagatggactatatgaggctgtgaagatacaaatgaacaaattttgtgttcaggaagcaacataaagacttacgcattgcagggtgatagccagaaataaagctgatgtcatagggatgaaaatccaagaggtttctctttattataatgggcactggagatgtactctcagtctcaagcaagaaagggaacataattaaaattgtctttgattgtacagtttatcctacaactcatgtgggataaatatgagctttcagtgcatcagggaaggtcaaaagaaaatttcttagcaaaacatatttgatactcaacaaattatcttcaggagtaccacatagctcacctcactaaggccctatggacaaaatagtgcaatgactgtgtatttaggcctttaagaggcctgaatacagattttacatatttttttagaaagaaaggtgactagcccactgcaattaagccaccagcacattcctttggcccatcaacactggtattgtgtagtgtacataaaaggaacatagaagggttatagattaaagtcagggttgggcaaatagaaatctctcagcaatatgtactaaattgaattgaattgaagtctgctttcagatagcaattgctgctcttgagtgagggctaatgtattcggtgaattatagttgggtcccttccattataaatccactaatgctaacttacttaatgtctcttcacattttctaaaatgacttttctctctctctctccctccatctcccgctctgtctctatctgtctttctctctccagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggtaagaactgcttccaagctcagagtccttgatctgtttctcacatttattaagcatactattgaatcacatgcactaggtataccatgcttggtatcataaaatgttaaagaagacttcatttgctctttatggatttccaagttaaatttgatcgtatcatttagaccagtgtacaacgattcctatgctattacttctatgtattttttttacaaattattttctagttgcactaatgtaaccatgaaataagagtgaaataaatgtagaagtaggagggcagagtgaaggataaggtatttgtgccgtgtatgtaataaagacctgttgtccaagaggtgaaaattatggttctggtgtcttatggacaagggagaaataaaagggggaaagtgtaaatgtttttagataattaacagtaagaatgcgttgactgatctccagtgccagcttgtgttaacatactctgtcctctagggagtgtttgtccattcataggagttcatgacctacacatgtgttggcttgcacagtcccagccacactggtccctttgttcatttggcctccacaagccacagctatggaagataatggataacagagcattatagatgttgggatttggaggtcaaggggtctcgtagctgattttctttgttgtatgatgactaacagcacttggaccttgtctcaatacccttgtagctccaggtctggaaaaggcacctagataaatggttacttaaaatactgttagattctattttatcaccataaatacagtcacagaagatttcagaagatggaatttgagcttgaaggtagggccactttgggtagtctgaccactgctacacccactgttctcattcatatcagggctttggttttttggtgttcccctttctatcgggtacctaacaaggtgacttaactaataaaaatgaagggaataatggtgttgcttttctttcttgcagacctctctattgcctgtaaggctatatctaaatttcttcctctacctttgatatgtttaaatgttggttttaaatattgattcatgccttcctgcccctacgcctggtcttattcccttttttatgtatttgtgccttgcaaagcacaaatacataaaatgaagttcttatatgtttaggaactatatgctgtaatttatgtatttgagagatctgaattcttctgtattttgccttctcttgtagtttcactcatctgctcttacacaagcctgtactgccaccacctcaacccctcacctctatccttgtgttgcacaacagaatactggaaccttcctgaccacaaaaatagcattgcacatctattgaaacacaaacacctacacttatccccactccagactgtaataaactgagaaatgaaaaatgttatataaatctaaccccatgctatttgttgctcgttgcagtggttacttttcattatttctgttattatttttattgatccctttttactccttcttcctttcagacacagtttatgagttggcttcaggcccaacttacattctcatcattcccagtgggaagaaaagaactcctcctttcaacccaaaagcacataaagaacagcctgggatttaggctttagattctggcagagttccaacttaaaccttactttgaaccaattctccacatagttttctggaaccctactgcttcatattaatggccccacaggtagttttgttctaaaattcctccattggatttgtttgcttttttcctgtacaggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggtgagttcaagaaagggaaagtgcccatttgtcctctactgatggccagtccaaaacatcaacctttccttttcttccatttctttaacctgtgcatttccggaaaagcatttcacagtatattgtgtagttttcgggtatatatttgtttcctattgctgccataacaaagtgccatgcactgagtgccttaaacaacagaaatgtcttgtctcacatttccagagactagacgtctgaaatcacagtgccagcagggtcaatctcttccggggtctgcaagggagaatctgtttcatgcctctcctatagtatctggtggtttgctgataattttggcattccttatcttgtagaagcatacccctgacctctgattcatgttcacatggtgttttaccagtgtgcatgttttccctctgcacatgtctgtgtctgaatttccctttttcttaagaatgccagtcatattagattaggggttcaccctactctgggatgatctcagcttaattatgtttgcaatgactctatttccaaataaagtcacatcccaaggtattgggggttaggacttcaacatatatattttagggggattctataacatctttcaacccataacaagctgaaagatggcagggagaggattgaagcagtttgtcaaggaggtctttttctgggttgcaggctataatcaaaccttcagggataaagtaggagaactgatattagatgtttcatccagtcatctcacatgtggccaaaataatagatggaactgtggaaggtctctgctctttatgtgcccagaggtagggcggagaaataaacttgcggccatctcttcattcttcctgctctcccatcttgctctttcagctggaagaggcagaaggcagggttagggtcctcagaggcagacaccatcagccactccccagtatcatcctggcagcagactgaaccaccaacttgagttgaaaaaaatctcatcttctgtttcattatattcctgtcttctgcatccctcttcactttattgtacaaagaaactactgtttctgttagcattacagaaactaactcagttgtggatgagcagccagacccttgttggcttcaccagccatcagccaagtggctatctcaattatgtctgcagctttgctgttaaggatgagatcagaagcagaagaccacaggtggatttttagaatccaggtgaagttgtctgctccactagttaggagaatcatagtttgatcaaaaaaataagggaaaagtgatttgattaacattggaaacaggaggatgttttagctggagtgttaccaagccattttggtataagagcttctgtaattttagtgtagctgtcactcaaaggcaataatggagactgtatccatgagaaagagatgatttgcaaaagttgccaaaactttagtcagattatgcaagcaaagttcaattttttagccaaagtagaactatgggaataggcaattttctccatgagatttttcagaattttgcttgtctagaattagatgcattctagggcacatggtttcttttactttccttttgtctgggacctcttcctacttccgcctacttcctagcatctggtgaagtggaaaaaggtcattgaaatctgacatgagttaaagtgatcaaagcaccgttaaacaatgtgtaaagaaggcaagtctgaatttgggggtcttattttatccaagcttactcctctttgctctttattttcttcaacaagagatcagtaaatctgaggggccctagggaatcaatcaatctctctgcccatctctctctgcttgtcttctccctacccaatctgctttgcacaattttaagggcaattttctgaatcactcgtttgattatgttattccccactgtctataatataaagtacagaatgcttaatctgatactcagatcttcagcactcttacatcactcttttttattcagcttcttttgcctactatacctttttctgtttgaactgttctgcatgcctttacttaaacaagccttgtgtgttcccaccgaccatactattcctgctgcctggagtgcctttttgtacaatgtaaattaaaattcatccatccagcatgcccacttccaactcctacttacttcacgaaaacccactggccatgccatccacagaattactgtcaccaatttggactcttgttacctgcagacagcttgtcattgtgattatttatatgccaatttatacaggctagataatggagagcgggagcaacgtctcatgtgttcatatcgcctgcggtactcatgtgaaatttttattgaatgcttactaagtacgttgatgaattaatatgtaatggcattaataagattactgttaactttattcatttcctttctttttgtctccttgtctctttttctgtcacgtatctttctctttcttgctcaatacccctctttctcccttttctctgctcctttcctgtctcctctttttatccattttccttctctgtcctttccccaggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagagtaagtgttttgatttaaatgcctaaagcttgttagggacagcttagcctagcactgtgcaaagcagagagaaccaagaggacactatctccacccccatgttgctcaagcaagaaaccacatcatgtatgttttcttaggagtttgtgtgatatgattgcaagtggctcagaaaagtgggtgatactatatttccttcaagaaacagctttctgtgtgggatttgggcagttggttctctgtaagaactgacagatctgtcaaaatggaaaatttggctttttaccaaatgtctttcatcaccattagttggttctgtataaattgtattaactgtctaatcctttaaaaatgtacatttctatttaaataatcatatgtaacatctctctcttattttaacatacaaaggtatattattagttgtttcactctatgttttaaccatgtgttggttatggagagttgaagagcttaacagaacctttagaaataagctctgactcataagaaatttacattccagaaacttccctagttggagcaagagtaaaactcttaggtcattctttatttaggtctcctcttcattcctagtctaaaatgagacactaggaagacagttttatgtatgaacaggtcacagggagaagtttttttaaaaagtgagcttcttttggttttgttaataaagtggagagactaagtcatgagaggtgaactcaaatgtccttttagaatgaaggtctaggttccagatatggccaaccaactttgactcaaatggagttttgtattaatgagaaaattgatttctcgttaaattatttcatcttttcatcattttcctatagtattttactgatagagaacaatttctccgtgtcctttctggctgtgagttaattcaggccatcaggtgagctcagaacaggaggctggaacttggggtggtgatgatccctgagccatgttgcttccttggtagcccttccctaagatctcagataggggaacaccagaagccatgggagctggtgatgtgtaataaaaaccccatttataatcctttgacatgatcaatgcctctatagaggaaaaaaggcttggaattttctcttgagcttaatcaggaagggttagaagaactgggaaagtggaataaccttaccttgaagatcttccatcttgctgatgccctgtgagacaatgagacttaccttgtctaaacctttcttctttcccatttcgctacgattcttctaaccctctcccctctcattcccatccacggagacaacttccctttccaaattagtcccgttcattataatgacacaattcaaacaacctcttttcatatgctttccctagccagggagaaaagttccaagtttgtccacctttccaggcagggaacaagatgtgagaaggaggttggcttgactttagaatcaaacatactgagccctccaggaacccagcccgttgcctctcctgcacggtgtccttcaaagccctgtacaaagagctgtacacagggagctctcgatcaatactaatttgttaagatgttaattattgatgataatattaagtgagtgagaaagtataagaaggaaaacaggagctaaagagagaataaatgagagaattcaacaagggagttatttattcctatttagtactggctgtttttcccaattcttccctcccacagtgtagaacacagcaggagaaaaatccttctttgaccccagggcttgctaattctctctttctgtgaattttgttcatgcttggctcaagaagagaattgctcagctgttatttggtgaccaaaattctaaacctgcttaaaatttgtcagagctagaaaagagtgacagttgtaagctactgagctcccctgtgctttactgtcagccaggtgtggcccagccacagcagagcaacctcagtgtccatagaacatggccgtttatttccaggaggctgatgatattttttgctatgggttgatatcatggcctcatttttaagatgtgaaaatctaggcatagaaaaccacggtaagtcaacagtgaagctgaggcaaaaatgccatatcttatgattccagtccctttgctcaagttactgggtggggccatgcccccccctctgatggccaggtcactgacctcagctcaccacatgacagtcaccaaatttaggggtataaattaggcaaacttctagccacatctaatagtatattagactattcgcttcatgctttccctttttcttatccagttggagcaattattggtgggagagtgttttttgtggtcatttctagcctctctggagatctaacctgtccctccattcttgcttcagggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaacggatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagagcaaggtacataaacaagtcctcagtggttggcaattgtttcaaccagtttgaaccaagaactttccaggaaggctaaagggaaaccgaattttcacagccatgattcttttgcccacacttgggagcaaaagattctacaaagctcttttgagcatttagactctcgactggccaaggtttggggaagaacgaagccacctttgaagaagtaaggagtcgtgtatggtagggtaagtgagagagggggatgtttccaatgctttgatcccttcttacttaacctgaagctagacgagcaggcttcttccccccaaaactgattacaactgctacagagcagacagttaagagaaatgagcttgacctttaagagaaatgagctgcactccatgagtgcagctctggaggtacgaaaagaggggaagagacttggaaatgggagacgggggcagagagggaccctccaccacctctttgggcctggctccctgggaatgtgacttgagcccagagtgaacactcttggtagaagcccttctaccttcctgcaacaccttgtttccctctcagattgtaccattgaggaataaaaaaagatatacatgtataaaactccagggatgagggtaccggcagaactgatgctcccttcacttaacattggaaaattgagaagggaaatgaatatgtatcactgccggtcctgaaacttgcggtagggctatttattctatgggtcagttccactgtcctgccatcctcccctacacagggtggcatccagagagccccaggtctgtgtggaagcttgactgcaggatcgccatgttgcacacaggacacataaaccagaaaggtgctcatcctcctctggaaggaagctgccatgtctcttcaagtcactccctccagggctgctcttcgcccctgtttgccctcactcgtgacccttcctcatcccgcccttgactgctgtccccaaccctcctccttgatttttacctcagtatctttcattttaaagccaactgaaggccttgtaaagctttgttttctttctaaaatgaacatgggggcaaggggctgaacctctcacagatttggtgagaggagcacggagtgctttaccttagataacagaaaagactgagagaggacagagggcatgaggcacctccaggaggaagaaggcgaagggccacgtaaacactgcttcgccctgactctgtccaggggtcagggactcatcccctcatcttcctcttacctcacccctttcaaacaaaaaaaccaaaccaactaacctagcgaacagcaatctagaaccaagggagctctttcagtctccgctggcaacagaaatcaagatggtgtttatttcatatgtaaatattttgttttctaattttgtatagataaagtgttctcttgtgagtattcagggtgttgggctggagggagtggggtggtgatgggaatgagagggaaaaagtgttttgttatgggttttcatttcccattgggggaattgttttgtatggcttttttgcttcagggtgtctggaaaaagcgaatgctcatggaggccactatggtgaaaaagccaggggaaagtaattgtgtccatcccccccagaaaaccagtcttcttactggtttgtgagaaatgttcatgcactttggccagggttttacatagggttcaatttggctctaagcaaaccccaggtctgactcctatcttctaggtagaccctaggttaccacattccacacaaagacaggctggtggcaccatatttcctctgtcagtacctagggtaggaaagattcccaaaagggcttaaacagaattaaggtcaaattaacttcccattcttggcgtgactgaaaggtttcaggaagctcaatcctgagaaatctcccagcggcctcctctgatgctgaaacaatcgtctcagtcatctgagtcttttcttctttaggacctgggcgctgactcactccctgccccatctccaccctcagaaatcagcctggcaaacacacgtggaaaaatctccactaactctactttttgaagcatgtgatatctggtcacagagaggtagtgctggatatgtgtcttacaaatttgcatgcttttctagaaaagatgatgggatccactaaaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttagctggacaattttatttttctaaacttatttggccccagttggttgcttttcttcaactggatatttgcactgggactaagttactcatggtctgcttaagaaaacttaaagaaaggaaggctgggcattgttaaaatctagatgttacttaattccagaataacaagcaagtaaaatgcatgaggaagaattcagctataagcccaatctatatcacagatgggtatgaaacaacacccaatccatccaaaactgtgagattccgcagataccctcaggagcacctaatattcccatgttcttcagaatccatgctttctcgctttgtaccctctatcattcccttccattgcagaagtggttggtgagtgtggtcctgtatgaactcctttcagtggcaatgcttaaatctcagcatttccactgacaataatctgacccttgaatttgcctgagtcgagactttgcacacccttcaaagtgatgcatgtacagtggactttgttatttcaaaatctgtcactgtgtatcctcagccagaacttgggaaacatccttcatatgtatttccctgcactggccacagccatgttgtgattgaggggaaaatcccaaatgattccattaaatgttgctggtgtcagtagtgccaaaaacgcatgtatgacatgatacagtaggagttgtctatacagttaagtgactatcactcacccggtcttccgtggccatcaggagttgcccaagggagaattctctgcagagtgctggtcacctgcacatgtcactaagaactaggtttctttggttcatttttttttttttttggtcggtttttagttagttagttcaagatttagagatagaataaccagattgtttgggcaataagcttttggaaaaactattccagaactcactttattctttcaatcatcatctctctaaaaaggccctgtcattgcttgacaccctgtgaatgtctgtttttgtatgttaggaatgattcagatgtgtgcataaatgatgtcactgcagtgatattgatgaatgcattcagcatttccagggactgtggccataccttatgtgctctctgagcccaaagccatataggaaatacatgctcagtaggctgctacacactacagcagagcttttgctttcttcacttgggtgtcagagacttttcctcctgtttaaggagctcttcatggaggagaagcagctgaaagtgaatagtcacactgggatgggtctggccttatgtatgctatgtggtccatggtgtgttgaaggtcctgaaaaggtctttttcatttcccaccccactgcaactaccaccttcccacacagatttgttgctttagcactgagctgagctgtctgtcattcgaatgaaagtaatcccaggaaaggtgacatattaagccatattagggatgtatacatttaatcacctaatttacattaggaatctcactccttttcctgggaataagttatgatacaagagaagaggaagggagcagagagcactgagagcaatagagtagggaacaaggatacaggttctagatggcaaagacatttaaaccatattttggcctccgcctgcttttatttaagcctcatttgacacctaaataggactcctggttaggaattattttcaatacacaatcatatgagtgtataatttatgaatttctaaattcagtatcttgtagggcaggttgagaactatgattctttccatagaaaatagaagagtgatgcttctcctccattacatgttactgagtaggcagctagaaaaatcaaattgaattagtgatacaataaaatttactgtcattgtctggtttctgtcccagtttaattaatcttccaattagctgagttggtctatatcctatactttccacctccatagggggtgccctgttatctggtaaaagagccacttatgacctcaggtgctacttaacctggggggcaattgtttcttaggcctagcagatgtttgggatgacactaaaatggcagattagtcagtctgagaatgtctaatattgatctgaatctaggattctattctagtttggggggtggggttgcagtattgtataaaatcataggatatctgagaacatcccaccctcaactcattccaaccacattgattcagtcacacagtggccctgtgagctctatgacttagaagagatagcctatctattcctatgacaaaggccctcacccaaaaccttaaattgaaagccagtgctgctactttcatgccttggagagaactgtgacgtttagggcttctcatttacaatattgaagcaagaaaaaagaattttgttcagagtaatgggttagaatagcagtactgggaataagtagggaaagttagaaatcttccacatttctctctacatctctcaagagctctgtacagtgagtttctggagctgcttcatgctttgaatataattgctggggtgattatgtggttaagggctcctgaaagaactgaaggtgaaaagcagagtagatgagtagaattcctcagagccttggcattctggtgtgtagaatctgtgttttggagaaggtgaaagaactcagtgcaagaattaaggtacaattaaaaagcacaacactaagcccaatttaaactgttattttaaagattaggtttccacactttaaacctgaactcttttatcggtaattattttaatgttgtgatttaggaggtggagcagattctagtactatgcaggagaaaaaaataaaagctctctggttaaatatgtgagtttaattaaaccaacgtctattgtgcacgtactatgtccctaggctagttctgtgaatgatataaaaggtttcaaaatggagtatattgtactcacgtagaatatatgaaagcataagtataaaatatgtaaatgtatgtataaataggtatgcatacatttgtatgattatacatgcaagtttaatattttctggcttcagggtaggagtcaaagatatccattatgctatttgaaaaaacattgcagagattcagcttcccatgtcatggccaggcctggacttattcttttgaaattattacacctcccagagctaaaactctgggatttcctctctaaccacaaccttgccttttctatatcttccttccttcaagacccctctgttgttctggtccataaatccatcaggcctcattgaattccctctttggtctaaccctgtatttacccacattagcaatattctcaccggcaattcctttttcctcttgccatctcactacaccaaccatgcttagctaactgcatcccatccccttgtcattcattgcatccccaagaagagcaagtcttaaacctacgtgaagagcacaaattcaatcaatttaacctcacctgaagcctactcacttggactttttaatttctccaatgttgactcagtgtcacattctgtgcttgataaatttgttttattttcctttcatgttcatgtcctgtctttcaacaggcaatctttcctactgtgtttgcaagaaaatctgattattgaatcctcacatatgctgtcctctctgcctttagatttctcttgtctttcacacatcttttccatcctttctcccaaccaagtgctcctcttccctatgctctgacctcttctgaggtgctctccagccaattgtatttctctcttttgcatctttaattccttccacacatctacctgcaactatctcaaaaacacccgtcctacaactatctctaaagacaaatctctcaatccaatttgactcttgaatttctgtcctatcgctatcttttcacttcccaacttctcaaaagggtagtctttctttctccacttcctcaccttatgctcatggcttcatcaatgggctacaccctaccactcttctgaaactactctcaggcaacgttccaatgaagttcttgttacaaaagtcaatagccttttttctttacttaccctgctcttcaacctcattgacaattaccattgggaggcaatacattctggttttaatcttagttctctggtcctctaacctcattggttcctgctcttcctcttatctccttagcattgacttgccatggtatatctgagcttgaccctcttctccttatcttaatgcttctgtagcaatctttctgtcttctatgatttcaataactctttgaatgaagatgaatcccaaatcttcacttttagcccctaccttttgcttttccttcatacacatacttccagtcaccttctgaacactcaacttcatcttgactcaaatatccaaaaccattgctgcaaaccaacataatcaccaacttcctccttttgcttaatggtatcaccatgtcttccgtcaccgaactcaagcttttcaggcacttttgcctcctccattttcttcatcctgcatatctaaaaatttgaaaagcctactaattcttccccctaaggtttccagtctttccttttcattcagacccttccttctagtctggattatttcagcgtcttttagcattgttccaatattttatatttgaatctactcttgtcagtactcacttcctacatataaatcagatgtcattcttcagatcaagaaacaaccttcagtgggcttcacttgccgtagtctgccagcaataatttcttgttacttgactatgtgtgtgtcccataatccagacaagctgaataacatttgtttcacctttccctaccagcttgttttcccacttgcgtcttcccttaaactgttccctttgtccaaaatactctccttcctatctcccatctcactcccttcttgaataatatccattccctctatataagtcttcaaagaccagaacaacttctttatcttccattcagaaaataattttaggcattttatgaatgcccataacactttcgttgtttctccctagtggcagctatcatgggccatcttatttcataggtatttggttatacatctcatctctcctgctacagcataagctccctgtgttcagggccatgtatttttaaatctttttatctcctgtagcactaaacagagtgccttgtatatgaaaggcattagtaaatatttgatattattataaattataattgagaaggagtcactttattttgcccatttgtatctgcagtagcacctaaggatgaatccccccagtttctctatatatatctgcacacacaatcacatgtatatactacatgtatacagttcattatttcaaatggaatctggatttttctaagtgctttgtcctttttctaagtgctttgtcctttgaagttgttttggactgttttatggttaggaaagtgtacttggaacactacatgtgttcaagtaagtgacagagggagaaactatgaaggatattgatcaaattttaggtatcagcttttcagatgctttgggtagagcttgtatccagacactttactaccaagattgagtctctaataacctgatccatgctgggactgatctgtgatccaatatttagcttcttttttaacactttcaacaccaaaagaaccttgtcacagttctggctcactaatcacacagccttgtagaccccaggtggtggtccaacaggaccactgtatttcaccacacgctacttccacatttgtggccttgggggaactgtctgtgctggtcaccaccttgtctttatatttctttcctgagttctttggcttctcaccctttctgaggctttgtctacaggatcacttctcccaaagggaggataagagttgaggtaattgagcactttacctcttatctgtatatttacaatgaaagtaagttaggatttgaatgagctggctcagagagaatgctagtctctaaactactcctttctctgtaaatataaagggattcattacctcagggggagacaacatcacttctgaccttatggccctcccttatcctctggtccctgtattcttgaagccctgttaacccttcctcctcctctcttggctctacttagcaatctatcaatcattctttctagccagtgtcagtctctgtccctctgaagaaactcttggagctcgtactgtcctttcacttcagctgctctggtaaccgataatgttttcgttccttctcccggccagccttctctgtaaatctcattatgccattggctatgaattattcccctttgggaggcatcttctgccactgtgtgctaatttaaagcatactatagagaactgaactcaaataagttacaggcagtgacaagtctctttttttaaaaaaaaagtgaagaaagtccactcttcattgagacaggagtgggtaggacaattattattggcaaggtagggcaaaacttgtgacaacttgggagatacctagtgaaaattaaaatataagtctagagagataattttgcttttcaaaagtcctatggggtctagatagccttgctcctgaaaatgagaatagttaatattttagagcaaaacccatttcattatactatgagacttttttttttagctgatgaaacaaattatctggtaaacagctggtgggagggtaggaagacagccatcctcatgaaggacgttcatgaatctcatttgggccaataaatggaccaaaattctaggcattttagccatgaactgttcatgtcaattattttgcctacaaatacccataaaaggaaagggaggatatgaggaaggaaaagaacaggaagtctacactggagcttccttttgtgtcaccaataaagccagaagctgacatgtgaggcacatggttcccccttggttactggcttcaatgatagcttcggaaagtagggaaccttgaaagagcaaggaccaaagcggagatgagtgaggaacctgaatgcaaccttatgtgtgaggtcctgatatccacaaggaacctggccccatgtcattcctgcccaggtccttcagattacagcacccaaggagcccttgatcatcaccctgggcagagggagtgacttatcacaccacccttacccacagaatttaggccaccaggctgtgactccatctgtcccccttgcagtaagagattcatagtctctgaaatctgacaggagaacagcatcaggggaagaggccacaggaatgcgaatttgttgagctgcctgctcctctaggataagtatattacctgtttccagaggggattgtttttttttcgaaatgaaacaaaacatgcctgcctaaaacttcagccctattcagaacagtcttgcagttaactgtcattgtcacattttaattgtaattgattttcttttgaaatccatggctattttaatgctccctttgaccatgacataagaaccctctgcaaaccagagacctggccattaggttgcctctggctgagttatactctcagtagtttatactttgctctcagatattcacctgaacagcacaactacacagaatttgatctctttgccatgagcattctgatgcctatgtacctccctaatgcacacacacaatcttaacaaatagatccaaatttcctatgtcaatcatgttatggtagatgaaagtgttcatttagaatgggataaagagacatatcataatttatgcagccagtgttttctctttgctctacctggcttgtggatcattgatccctcaaggtttgacagaaatattcaggcttcatgtgaaggcagcatgttctttgtgatgaaacaacctagttatcgtctccattttcccattttaccctatggaatccatgtggccttctaaggtcctgttgatggactggtactaagaggatggagaagcagaagccagtccccctgagaacagacagtcctgttgcttagatacatacatattcgcacatgtgcccacatctcttcttggaaacatcatgagcagaggtggagaggtctgttctcaatgggaggaataagggtaagagaattccttgagaatccctattctcaaggaatagggataaatgccttcacggattcaataatttatctgttctctctctcccagggtcaggagcaagaaaaatatcaaggtttcacataggcaggaagcaaggaggatagtgaagcatccaggtggaaactcttactgagaaaaacatgaagtagtaaaatcaccctttctttgatataaatgcatttagaagtcaatgagggcacttacagctgtgtttcccttcactaacttttcatctcttgcattctttacttctctttctcaatttattcatcttgaggtatacttatcctgagttgactctgagcagcccatcctcaaaacacaaacaatgttaggatgagaagttgagtgagcacagagctcgaacacgtgcatggtacttaatgtttccaaactcgagcccaatcagtctagcacagtcaatcccactgcattttaatgactaggatggggcctgctgtacatagctggacatcttggattacagaaaagaggctttatgtgaaggcagcattttctttgtggtagagcaacatagttatcctgctaactgtcctatttgacctgatggaatccataaggtcctgttgatgggttggttctaagaggatggagaagcagaagtcattctactgagaacagacagtcctgttgcttagatacatacatattctttatgacagaattcctcctgagactcttgcacaccttcagtgatcagcgcattcactttggttatttcttggtaacaggcacgagaaatgggtcacatagaaatctgaagagtcatttctcgagcatttttagcttattcccatgtaaagaggcactgagctcctgcagttctagcctgcctctgctcccctccttggggaatggtggagtttctaggataaccagcaacccattaggctccaccacacttagcctatggtacattctgagtaaatcacagtagttggtatgtgaatacagaagaatttaccataaccacttctccaaataacctcctttgacttggaaataagatcatctttcagttttacagatgagaagtcaaagcacaaaattggataattagccaaaagtaagattatacagaaaattcttgacagaaccaaaacttggctgaaccaaaacttgtccaaatttctaactctcagtctagctcagcgagtaatgctgcctgaattgtctgcccccactgtaggttttcagcatctagcagtggagaaaagtcacgaaatctaggcagctgatttagccagatcttatctatgaaatttccctttgtagacacacacacactccacatacatctacagagacaagtcaaaaagagcaagaagaaagcaaaaatttgaaaatcagaaaggttagagaggtttccacggtgaagaaaacttggtcaaataaaaatgtttttgaattctatagggtaagatattgtgaataattttttattattaaaaattttttttaggtagcatgtaatccacataaataaaaaactcaagaataaactgggacagaggatttcttccagagtgctacatggcaaaagagccttcaggaacgtgtgcaggggtgtcatgatactccgaaggtgtcagtagttttggtcagcccacagtgagcagggcagcctcaagggagagccccttacatccttttctgggcacctctgtctaattaagttcaaacatacaagcctgattctaggattaaggcataagttagttctgaacagaaaaatataaggcagttcacatacacaatgaattcttgaagaaagaacctatagcccccagaccgataataaataattactgcctgccaaaatcctgaagaaagggaagcatgggggctccaaaattaatagtctcctgagaatacttatgagaccttgattttgtcacaaggttgcaatggtgaattatttattaagcacccgcagatcagagaatcttgcaacaaccttctcttacaacccacctgttcacttatgaatgatatcaagctcaggatataatccatctttccaaagattttagtatctttagtttgggctgcagaagaaattttggctcacagcattatgcttaaaccaaaaacagtgaaagagctctagtgtcctgcttaatgtagagtaactttttttttttatcagtccttcctagccctagagggaagataggagaggaggtaggaagatggaaaagtccttagatgaatgagtgaggagacttctataccatcaacttcagagtgtactgatccccggagcctggttcaggaggctagtttcagatgatcggaggaaatggaggaggtagcttttattcccatgcatgaagatggggggaggaggtgggcactagactaattttttaatctaaaaaaaatcaagcctattacaaatctcatttttcccttgtccttttgcctcccaataattcacataaaatcgtgttatcatagtaagctaagagagaggggcagtagctatttctaccttgactccgtggtgacttcatctttttcatgagtgtcattacagatacctggatcatgatgatcctgaaaaacaggtcacagggccaacagctgatgagtatttggagcatcttattcccccaagatgaccactccctgtcttctgctacacctatattcatcgggggggggaggtgggaaaatagcaggattcttggggactctgagggcatgaatggagaattatttgattgaaaccacagagctcttgtacttagtattaaatattaaaatagaaatgaaaagttcagcttttctgagctgtaccatagcggccaatggaggaagtcttacaaagaaaatctatatctgcacaagactgaagccactaaaccgagtatacacaacataaagatatcttcctatttcaagtatcccttagggggcatgggtgcttagctatcctatgaaagacagagaagataagctcaattttagagcccagagcttgctccggaacagcaagatccacatgaacttaaactctttcccactgagcctaggggtggaatgtaattcctctgatggttttgatttatttccaagctagacttctctatttgatcattggcaccttggcagctcacacatctccgtggtctcttctgtagctttcagaaaaaaaaaaaaaatatatatatatatatatatatacacacacatacatacatacatacatatacataaccctgtttgggtaaggcctattgacagaagccagatatctgggtggaagttagaagatgggcaaggaattcttatctcagagtttcaacactgcgacaatgtggagagaagtctcctgggaaaatgcagatgcccaataacttccaaaagaatcagggaagttggagtatttttgagatttacagtgtctttacttcagtaaaacaagccatagcaacattatgctctgcagagtcttctgttcacctttggatggaaaagagctgcttctcctagggagacaactaagaccaagaacaaaactcccatctcctaggccaattattgttttctcctttcctttcttttttattctctttgttacataatggtgaaatctacctggccattgccagtcaaacattctaattgctaaatatcatacagaaattcatgaaaaaagagtagaatcagcagatttcatttaatcccaagggtctttgcagttttcatcctctccctcaaagttatctcttctttgagacacatgatcacccctttcctcttctgggtggccatgattccaaaatgaacttcagtggttggtgcttcacaaaaggaaagacagctataatataaaatagaccaaaatacttatatttttagccactgcaaagtgggttttatcgttgagaacaaccttccaagctccttacttggaaacccttcctcacctcccagcctcctggcagctctcctggttccccttcatgtttttggctcccctccccgactttcctttcctatgaaaatgggatatatcccttaaactgtattcttatctaaactatcagactgttaaaagaaacccttgacagtaatttttcatggttttctcatcattttttaacttaggaagttggagaaagaatgacaagcaggcaaatgaggtcttgttcctgagtgcttcaactcaagatcaagtgctgggatagtgagtggctcttagtggagagggatgtgctctggaatattaagccacctctgagcatgtgtcctggtgctctggtcaagatgcctgttgtgtatgtggaggtattttgtggcttttcttgttctctctttttaaatttatttcaaggcacaagccctttgtgatggaggatgtctagcttgaacatgctggtaatgtgacactatcctcagctccccttggccctgggttcataggaggcaagtgtttctaaatttctcgcccagtgagttgttgcatgttatttttaaccattaatattgtgtgtctattggaatgagaaacagaaggttgaatgggaaatagattcagtgacaagcagacaaaaagcttggttctgagaaatgttcttcactgagttgaaaaaaaaataatctagaaacaaagaagagggaaattggggtagaatggtttggtggtgaagagacgatgacacccacatccagatgctctggtgtattccctcagagatttgtcattccctgtgagctctggcagaaggagaggctgtgctgccattgatggctcagaaatggtgacaggctggctttagaaagagacgtaggctttcttccagacagacattgataagcattgtagctcgattcttcaaaaccttgtctacaaacctttagggcagcccctctccaatgatttccattctccagtcaagaagattctgagtggaagagccttgtgtgcattgtgattacattgacttaaattgggaagccaaggggcactgagaactgaatatatcaggggaatggagttagctgaacctttttttttcaatattggaatgattttggatcacaaagttaggtcacctctgagagagaaaatctgttaaataaaattatatcttcccatctccagtgaaatcactaggttgttaatgtgattactgtttacttcagaaagaaaattgctagattcgattacaaataggcattttacagattgatttaatcctgagtcttacacatattaacatggaatttactgactcagacatgatcttctaagctataaaatattactggcgggtagtagatcatatgttctaagcaaaccaggaaagctaaaacgttaagtaatcctcccaaatattcagcgtctgtgtatttcactatagctgaaggggatttgggagttaggccgcaggggagaggagggacaaagtgccatagattaatgaaactcagagtaacttttttcttacctattaaaaataataattaacccaaggacaattctcaaaccagaaaaatcatgaaaagtgagctctgcacttgccattggttaaaatttagaaacacttagaataaatatccaggttttgggggaggagttgtttccttgcttgcattgttttgtttactggagctcttattttggggatatttggtctgtggcttcagagcatgttttggataaatgacttatccatgttgatatttattgagtggaaacccatgccaggctgttctaggtgctggaatataagaacgaaccacacaaagtccataccctcttgaagtttgtatgttgatgagaggaaatggacaaaaaagcaaatcaatagatctcatgtcagatagtgcaaagtgtcatgcagaaaaatgaggcagattaagggggatagatgataggatgggtgtggggttgctatttttgagtaagcaaagatgacatttaagtaaaggtttggaggaaatgagggagtgagacttggggctttctatgcaaaggcaaagagaaagcaattgcaaaggccctgctgtcaaaccaaatgcttggcaaacttgaggaagagccgggaggccaatgagggaggaggagagtatgagaggtgaggtcagagagggggcaataacgcaagtcaggtagggccttgtaggacactgtcaggatttggcttttaccaagagcaagatgagaagttgctagaaggttcggagcatagagtgatatgatctgacttcagttgaagaggaagctttgggactgctgtgttgagagtataccctgagagggcagacaatggaagcggctgaaagaccggttaggaagctcttgcaataatcctggtaagagatcatagttgcttgggccatgatgttagcaggggaggtgataagaagcagttggattccagaaatgttttaaagaatcgatatcacacagtttgctgatgaattagacattgaataagagaaagaaaaatcttaagaataaccttagaatgtttggcctgagctattgaaagtttggagttgccatcagtgtaagacaggaatcctgcaggtgaggctgactgggaaggaaagccttatagtttaaggtgtctacagatgttgcaagtagaaatgatgattaggcaattagatatatggacctggagttcagggaaaatgtatagcctgaagatacatatttaaaatttgtatgcgtttggttggtatttgaagccatgatactggaactagagaatgagtagcgacagaagaggattctctagactgaggcccagggtggaggattgttcaaagctccaggagatgagaagggaccagcaatgggaggagtggttaatgggtaaagcaagtactattattgagtaggataagactatctggaaacatggaggtcatcccattgatgacctggaagagagctgtttcagtggactggtgggggcaaaagcatgatggggtggattcaagaaagaggggaaggagaggaggtagagacaacaggaataggcaacgctttaggagtttggctgtaaagaggacatggaaatagcagatcatagagaatgtgacgcccagggagggacttctttttttaagatgggaaaaataacagcccattttatgttgacaagactaatccaggagaaaggaaaaattgatgatgcctagggagagaggacaattgctggagtaatgtctttgatgaagtgagagggcatgggattcaatacaaacatagagggactggcttcaggggactaaccaggtttgtttgtattaatagcagggagatagtgcatttgggcacagatgcaagtgggctggtaaatgggataatgggagtatgctttttctgattgatttttagtaaactatgaaaggagttcatcagttaagagtgagtataggggaagagtattggaggttttggaaggaagaaagcatgaatgagtcatatagccatccggcaggaagagtgagaacaaaaatgtcggagacaccaaaaatataggagacatgctagggggcataaaggaattatttgagtttttatgattatgagtttaaagaaatttgttttcttcagtcaccttcagctgcttaaacagggtggcaagttagattggaacagggttggggtataaccaggtgaatataatgaaagcaagagatgtggagtcaagggcaactgcagtgtgttaactataatgtttggtcatggaatctaagctgggtgtagaggaaagtgaggatttttagggaaggaggaacaatgaagcatattagaggcagaggattgagattcaagctgggatcactcagttagtgagtcagaagcaataacctagaaattaggaggtgggttggagaggtggatgcttgaggttatggagggcttgcagttattggtggtttggggtctgttgttggggtggtgggctgagataagatagaggaaaaggttatagaaggagcagggtcaaggaactgagaggccaggatatgggaattatatagatattgaagtcaacaaaatgttgacttccatatgataggaatgtaaattatgacaggaatgagggagagtgattcgagaacatttcaatcattgcatcaagtaaggggtgcagctagcctagtctgatgtgcatcaaagctggattttatggttgttgcatgttatttttttttaaaaaggagggaggatggtctggaatggcaatgaggggcaagaagggcatctccacctccaggccccagggcatgaggaaggtgcaagtggaaatgctcaccacctgggagtgattcagggtcctcaaagaggagccaggtttctgtaagagcaagaggaaaggaattgccagggttgtggctggtgatgaaccactgattcttaggcaggatttgggagttggtaaaggaagggaaatgagctgagatgggagatgtgcatgggtatctggggatgaaagtccaagtgataagagggactgggggtcttgggcttctcgtggtgattgccctaagcgaggctgtgggcatttggggttggccctaattgtctctatgtcagattgaggtggtgatgctgcaagtgcccggggcagggacttgatggcagcacatggaactctggtacctcttcctcagtcctgatatttgcttttttaacttctactaaaaaccccactgctaactgtgataggccacaacatgtttttatagatgtcaacaaatgttatcctggattgagaccacattttgactatttatcctggaaagtacacattttcacaggaaatcttgtcctttctaaggttcccaactaagctagtctcgttgtgggggggtcataattatttgttcttacttaccttactccttgttcatctttaaaaaaaaaatcaaataaaaaggattggaaagcaactttgcttctgcccaattctgctaaatgaaagttttctctgacagatcattttgattttgtattttcttttgtgacagaaacagtgggacaggagcatggaaatgaatgaaagtctttaaaagccttgagagagagttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaaacatttcaagggagctagaggcaatgttacagtggagatcagagaagggatggggcagtgagctcttgtccctaggggaaatctcttttcctccacgtgacaggagccagtgctccaacagcatcagaattacacttagccacaatgactgatgcgtgtgtgtgcctgtgcacatgtgtgtgagcgtgtgtgtgagcgcacgtgtgtaagggggtgatgatggaaacatgatatgcatccactatggggttgcgttgcaaattcacagctgcacccctcccaaagtcacatggcagaggggaaatggtcatagctttcctgtgtgatgtcctctccagggagcaccgacgactcaggcttgcctcagctctgcgaggcccagactccacactcctccctggggccggctctccttcctcttgactctcagatccccagcccatccacctccaagttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacaaaagaaataagttgatttcattcttttgatttatcttgtttctcattggggtcgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcactttatattcaaaaaataaagaaacctaccacaaattatcagggttaaaaaaaatccagaatcagagtttttttcttggtctttgtgctttctttactgtgattccaaaaagattgttaaaagtgctgtttgggaaaaaccccttgcccagttggtttccaattgttggtaggagtcttggactggcgaatctacttgggttgggatctgtttctactatagctggtgctggagcccttggttacactcatctccccctcatgtattattctgaaacaaatcccataattatatggtttcatctgtaaacattacagtatatatctcttttactaaggactcttttttagtttaacaataccattgtgacatcataaggtagccataattccttgataagaaatatccagtgttcactaattgtctcaaatgtaatactgttttatggggtggtggtgggtttttttcccataagtcataaggtccatacaattagttgctatttctcaaatgtattttaaatctaaagatttgctttctaactttttcttgacatatacttgttaaaggaatagagcactttatcctttagaggttcccacagttggattttgctggttcttcccaatattaatgaagacaatgtaaattggtaattgttttactctttaatgcatacttccattgcttggaggtgtcagaaaagcaaaccagcccttgttttgctgattgtttcccaccccactcccagtcccagtcctgttactggctttatatatggattctaaatgatctctctttctataccttgattgctaaattatccaagttaaataatagtatctcccccttagctatcttggtaagaaaatagcatagacatatttagcttttcacatgccaatcatgaggcacatttcaacatcactttattaaaagccacatgctcctcctatagtcctagtactggaaaggaccttctagagaccatttagaagaactctgtctcatggccaaggagcctgggtgagctcatgtatggcagccctggctagaagccagcagggctaatccctagttccaggaatctcccaggataatgtattgttatctctttgaagttactgtctcagagagattatctgtgagggtctctcttgtactttcctttgtactgaacaaaaattcttgtttctccctgaacattccagaaagtagcaagctctaacataaagccagattcttcccagatatagtgattctctttacttctggagatacttccttaaaccccaaattttttttggacaacagaactgctttaacaataatctgaaaattatacagtaagtttgatttgaaaatctgagatttgtttaaaaaaaaaagggggaagacaagacttgaaatcttggctctgatttttctgttgtttttgtttttttgtttgttttttttttgtttgtttgttttttaagagggtcttgctctgtcatccaggctggagtggagaggtatgattacggctcactgcagccttgacctcccaggctcaagtgattctaccacctccgcctcctgtgtagctgggtactactggtgcataccaccacactgggctgattttgtattttttgtagagacggggtttcaccatgttgtccaggctgattctgaactcctgggttcaagtgatctgcctgcctcggcttcctatgatgctaggattacaggtgtgagccactgtgcccatcttggctctagttttaaataaggaagcttgcgagtatttatctggattatggtgggaacctccagtaggatatcatgaaagctttgatcatgatcacaacaccttcaataaaacaaagactccaatgacaagggtgagtgccagaacttcctgagactatgccaagtgtctgttctttatacagcctgcctcacccacacctggaatctcttaaatggattagctcagagcacctgtgtcctacatgcccttgtgccaccctgaagtccactgcaagggactatcagtaagaccagtctaatgaaaggctgagggagcacccggttgtgtccccatcagccaactgttccggaaagatgagcctccttggctgtcccaggattgacactcttcccctgcatacatcactaggaaggtagaacctaccctgaacacttgatttgaatatttctattcccctattcttttacaaatgcaaactaattcattcaaaaatataaatgatcctctgaaagaaatttcttgtggaattctggaatgaccaagaagatgggaagagaccaccagaaaagtggttctgagagtctgcagggcctgtcaaaaaaattatgccaaagctatcatttgtggcctgcatcaaatcatctagacttccgttttcttatcttgaaacccagatgttggtctatctgccctccccatcaaaggttacctggagcagtagttctcagttttacatagtggagtcatctgagtatttctgaaatgctgatgcctgagtctcatcccctagagagtctcattcaattgtcctgggtggctggaggggttaggggttgaaaacttgcccaggtgattttaatatacagccagaatgtgaaccactatgtatgtgcatctggggaaagcgggcctcctatttacttctaatcccattatatgtggcagctgtttgttgtcactctcctctcaccatggacaactattcacagcacagacagtcaccctttggaactccaggacctctttcctcttccatttggagctgaagaatggacataacggaggcaccattttatgattacagcctcgttctctaattctgcctatccccagcatacacggctagatatagacatactgcaaagctcctctatgtaaaggaaattctacacataaaatttaaacttgaaatcgaccttaaatgtgactattctcatgattatgggaagaaaatcaaaactataaacttactccacaaggttggttcattggccataattcctggacttactcctcaatttaaaatctatgatcttctaaaaaggcaccttttttttcagctctacatagcctgggtcttgattctctaaccccctcagttagggaaacctatccacattgatgttctttgcctggaaattagtcccttcccctcttccaggcaaactctaggacactgtagttccctcaagcacatgccccatagtcggaataattgtctgacatcacagggggcttcatcaggacaacaaaaggtgggctttgctcctccacatccaatcttcttttagatgtgcccacgagagcagggggtatattttttcctggttgaccagtggacacctctggtattattccacaaataagggattctaaatcaaaggtcaaaaactggtgtcctgaagactgattctgacctcaaaatcagtcaggaaactggttttgtgagacgggcactgctttttgaatattcagatttgtgtgcctccagagagtatctgctctctagtttggggcagcccctaccatttcttatgacctgtctcacctcaggaagcaagtgagtctgcagtaacttcccctttcccaccactggccctcaacacacccacgtacacaggtcccttctcctagctgcagcaatagactcttcaaagccgtatttataccagagaaatagtatttcttctttcagagaaaagcagtgccaatttttttgtttttccttctgctgtcggtctaggtactgacgtccctcaaatgaataataaaacagccaccatgtgggggctattttattagtcattgatgggacctcagtacctcattaccatggggctacttacatggtgtctacactgcttagctatacacactctcgaaagctttgaacgtcaagattgttctctttctcttttgccttttcttgaaattaatgtttgtatagatttttctctaatcccactgcacacaacagtgtgattatttatcctatccaagaaacctctcagttatcagagaagaggaaatttttttctttcaagttacatccaaaataactatcatttaatgtgcacctaccatattctagtccctttcattcattatctcatgtgatcctcttaatacctcattttacaaatgttattacagtattgaggtttggagagatttgtcaacttgctcaaagtcatacagctattaagtgaaagatcagcagttcaaaaccagtgatgcacatttccaagctcttatcactcaaaccacctcacagatctactgcaaaaagtaaactagacaatgaacatgaagctattctgcaaactgtaaagtgctgaggataaatgtaatgtggtatcattctgtctagcaacaccttgatcattgacttgcccctttctgatgctcaacaattagttccttatactcccttaggcaccaatcttggcagatcttgtccctttgtaactctttgtgtttgagggtttttgctttgttcagagtatcacgttgggtagccattctgagaaagtcatgaagaaatggtctttgcaagagagaatcaccaccaccactgtcaacataaacattaactattggatacttaataatggccagcactgcactaaacattttacatatattgtcacatctgctgtttataataacgctggggaaaatgtatttccctcccaactcctcattttacaaaggaggaaatcaaggtgcagtgatgttacttagccagcttggagttgcacagtggaacagatctatcttaacccagaatttttctgttatggagcctttgaaggccacagtgctcctaaaaatgtcatttctgaggcagctttatttcttgtcaacgtctagtccagaggttttcaactctggctgtatattagcgttacctaaggagattttgaagttgcagatgctaaatactcagtaatttgtaaaaactctttggggggtgctcagctggagccagggctagaaacaagtggtctcagttaatgccagcaaaaatgaatcagggccaggagaagggaaagaggctggtgcaaatacctacagccagagggaatgcacagagggttcacagtaagaatataggaaacccagaaatattatttacccaatatgtcctttgaggtgtgtcagttactaatctggggcttccacattcacccgtgtccttcttgccttactttgtgatcctggtggtctctgtaagctacagctctcctttgccagcctctctatgctaggctctgccaatagagggcgccagagggagcctgggagactggtggatgaaaggttttttgttttgttttgttcagttagcaagccagcccctctgtgggcatctggctcctgacgtctccctaactctcgtgggcagttcccccatcccaggatggctttctgcccgtttctttcttgtgcagcagccatgcccttgccatggtcttagtcttgaatctcagccttgcagagctcccctctcagcagaaagtcccttccttgttcacgttccctctatcccagagtggaagtcattctctgtagttgctactcacattacaactcagggttctctttcaccctttcacaaaaccattatgcagttaacaattccttaacttttccctgctcaaattcttgctttggtcagttgcctcaactggaccatggcaggtatattggaacactctctttataactctgctgtcagatcacaaagtgagatgaaggaaaagtttgcacaggctcccctcatgaagcctgggagagcatgcccctttaaggaatgggatccgtttcaatgattctggttaagaaaaggctgcatgagctactggcgtatttattctgtaaccaaccgctaatgccagactttttctttgctttcattgctatatcacaatggtaaaagaattgacttaattaatttgcagcctgtacataatgagaagaatatttcctgacagctttatagagaggatgatagttacataacattagttacataatatataatttataatttattttctataaaactcatttaataataatatcacttatataagtagatgcttgtatatctatctgctttatatttattctgttggttgtggtggcagtggaggaaaaaaggatatcttcattactttgtctgtgtagcttttttcttaggataaacctactggcagattttgataaagctgttctgatctaagttaacaacgatcacaaaggttatgtggggactgtggagatgattatggcgcaggacctatgagaaaattctaggggaagagcaggtctgccactgcttctactcatttgcattcactcattcatccgaatatttattgagtgagcatgcaatgtctgctatgtgccaggcattgttctaggagttaaagatctagcagcttgcaaaagagaccagcagtcctgccctcaggaatatacatgccagtgcttccttgggcaaagtcttggaaagccatatatggccccgacaaacttgggtttgtcccaagtgggaggctacttgtgcccactgcatttggtctcgcagagccttaaggatgtaggtctgattactcatcctggaaagtgctacctgtgcatgtggtgccagcttcagtggagaagcctttgagtctggggtggaagcatgaaatcctctttagagaaggggatactcttgcagaagactcattttgaaagagtatcttcacagcagattaggaaagccacacctgaattgaagtgaaaaagagacacaggcatatataaaagtacagaaaatgctagacttggggatgtgggaggggagagatagaaaagggcaggtgactcaggaagagaaatcgcttctatacattggtctttttgagtctcaccacagccttgacaggtaggtaggcaggcagcattatcatcatgttacagatgaggaaactaggggaagtgacttttccaaggccacacagtgagaagtggaccccaggtttcccaagtccagtgcactctccattgtaccatgcaactctcatgatgattggcatggataattgcagaaatttaggagaggaaaaatgtaacatacggtgatgagaatgatgccgcagaagcgaaggtataatggaaccaaatatacagacagaagcatacccttcctcataactttgatctagtcactactataaaaccttcacatgaagaaaacaacttagcagatcctttctaaacatttaccagcaagaaatggattgcatgaacccacaaaacttgccctggctctccttacctcaccataacagtgtcatggtgctgacatcttattgcgccgacatgcctgaggaaataccaaagtgagagctgaatgtagtcacgtttctgctactctacaatttgatctccccactctgcttgcactgtgtccctccccattctccctatgaaatcaacaagtacacaatttttcctagggacaggaaaatgtaccagattcttggcgaagtcattgcctcctggtatttcaggctctaaattatttctacgtcatcctgtagtgtctgtaaggtggtcatcccctctctcccacatcactccacaagtcactgccatttctatttaatcggaaaagaaaaaatgagggagggagtctctaggctgccatgtagccgctagaggaattcatgtcaccctccccaaaccagccttggccaccgggaagctctcatgccgtattgaatccgaagcgcgtggacccttattatcagaagatgaagctcccagattcacccagcatcactgatcttgtgccctgcagtgggccctgagccatagtggcttttaccttcaagggtgaacatcagggaagtgggattcaaagaagagattgcaaagcaattgaggggaaaggaaaggtgaaggcaacagctcacttggggagagaggtcttctcaagagagtttggaaaaaggattgaatgcttcactatatgattttgtgaggactggcagaagggagggtacaatgaaaccaaatatagatacagacatccttccttccctatgattaagtcacccatcccagtagcaaaacaaaacaaaacaaaaacatagaatgccaaatcttcctctccttttccacatggaggtgaatgtcagacatgggtcaggtctctatttttaattcaaagctttgtcttcctacttagttttcttatttaacctacttcaggccttaacttcatcaccctggcatgagaatccctaggaaggaagatgacaggattctccaaattggcaggatcagacagacaccatgaccccaagggaatgctttccaggttaggcaggctgtcccccaggcctgccttcaaggaggccctcccagctctcctgtctaacttttcatcctaagaatgttggctcacaaaccagagggggtcacaccatgggcctggaggctgtgtcaatgtgctgatgcttccggatagatcacagccatctcttgtaccagcttctccccctgcaaagcctggacccaggttctcctttaatctacatgaactccttttagccactctgcccatcagattagagccctgcttttcagggaaaggggcacaaaatgcctccagtctttcaccatctccatagcaaagagcaaaaagcttcacttcttagcatcttgtgggaaagtaataggcactgtactcttagcttccatttcacagcagcgactgcattcacatggggcctgggctctgcaggccaccttcaacccattataatttcctgttcttttcccaattaccccaagtcaattggtccaacgcagactcaaagcttagcctttgcaatttagatgccacaggtagcttcgtgtttggatggtagagaaaggaaaaataataaccttgccttactcaggcccctgccatgtccccgtgtcctggagcggcgcagctgtgtctcttggacccacttagtggcctttgtctcctctcacaagtgccacttcttgcccggtagaggctggcaagagtgaaaccatctgcatagaacagagcagagctgctgagagccaacagcgagaagggaggggtgcacaagaaaccagaagggcagcggaggaaggctcacagggagagggtaattccattagctggaatctggcctgatccaacataaccccacctccaccccaccttaccttatgaatagctcggcaggaccttaattacactcctaacataataagtactttatgtggatggaccaactgtgtttccatcacagtcccttttaggccaggagttcaatgtacataacaaactttgtttgccattagacttttatgctgcagagcaggttggtgaatatcaacattacccaattccaacagaaaggagaaactgaggaacccattggttcaggcacttgcctaaggtaagtcagaattcggaagcactatgaaggtcttttgacgtcgaaatcgatgttctgttgcccagcacatcaccgcacagcctgttgtgtgtagctctaagtctcaggtgttctaaaagattacagaaaagatggacaaagtgggaacagttgcttactttaacatcttagtcctagggctttcctactcaaaatgagggtgaaccagtgggtgcatccacatggcctctgcaaattctccctccttatatgccttttcccttctcccatgccgaggctcaaagtctgggtcagctttgactcgttgactctctttgtccccactccaatatgcatcagtttccaagtcctgttaaatctgcttctgaaatacatctaaatgctctccctccttctgaattaggccctctgtatctccctaaggaatgaacgcaatgaagtcctgaaggatccgctcccctcagagtccctcacacccatccatccttcaaatctgctcagatgaccttcttatgacacaaaacggtcctggccattcggctccccaggccagctatggcttcccactgcctgtgaatgagcatgaacacttccccgacatcgtgggcttgtttccccttctggctttcttgtctggggttccctcacacaccaggagctgaagctcacttagtctatttactattctccaatcgcatcccatccttccctactttcacgcagatactcccatttgcactcccaataccccaagaaacaccatctcaaatgtcacctcctccttgcagccttttccagtcaccctagcaatgtgggctcctcttcctttgatgctcacatctcttttatgccacttgttttctacctgatctcaagaacacagcctgactggacggtcctgagtgacagatacctgcactaatgcctctctgcactcaagggtgtgagcagaggctctgcatagagtacaaggttaaacaatgtaaaattggaagctcttaggcaaaaaatgcaactttgccttttttatatgtttgttttccctttccattccctcctttccttccttccaacaagtatctgagcatctactatatgccaggtaaattcttgtgactgatggtacagcagtgatcggatctgacaaaaatcccttccttagtgaagtgtgagatctggtgagtggaggcaaataaaaaacaaacatgtaagatgtttactgtgccaaagagtaatcaatgctatggagaagagtaaacagaaggaagtggggagagtccagggtgagtggtcaaggaggcctccgagaaggttccacatgagcagagtgggagagagccatgaaggattctaggggaagagcattctatgcagaaggaacggccagtgcaaaggctctgtgaaagggataatgtgggggtgtgttggggaaacaggagagaggaggaatcgtatgtataacattctctttttctcttttacccttgctgacttctaagattggtgcaccatcagggcagacagaattgatattactcaggttaatggcttagactggttaaacccaaagttggagtgaaaaacccaaatttagagtggagaaaccaaagggagtggcagaaacccctgtagcctagcgaagggcagtgagcacacccctacatgtaagagggtggtgtatctgtgtctacagaagagggatgaccatgccagcaacaaccaggctgtttggagatgctactgctggattcctatgttaacatctgtcgggggctaaatttgggttcctttttgacattatgaggaaatatcttactgatggcctgtcctgcctgtgttccttcctggcctttgacttgtctggatatatctttattctcaacctcttccatgctgacagttttggcacaaaacccgacatcactgcttaggcaggcccagtctgcgcaaaactgggaattgtcttcagaactccatgctactgggtcagtctatctcaggtctctaagttagccctgggagtgacggctggaatgcaaacaaccctactggaagtttaaggcacacactgtcttttggtttaaggattctcatattcaacgtagaacacacttcagttttccatctcactgtagcatctagtaccagaacttctcaccccaccaagatttcagtcctgatggaaaagtagacctggagcattttcatgtttgccttcatgagtgcaaaagtcaaaataaccacaaagatgtgacactgcatatttatgctattgttactcccattttataggttagaaattgttaagtaaattatcgtgtaatattctgtgagtctttgtgtttgtcattttaaggtaagtattaaatgattgtatgcttagggactattgggataagaaaaacaaatatcgccggtgcagtggctcaggcctgtaaacccagcactttgggaggccgaggcaggtggatcatttgtggtcaggagtttgagaccagcctggccaacatggtgaaaccccgtcgctactaaaaatataaaagttagctgggtgtggtggtgggcacctgtaatcccagctacttgggaggctgaggcaggagaatcgcttgaacccaggaggcgaaggttgcagtgagccgggatcatgccactgcactccagctgggcagcagaatgagactcctctcaaaaaacaaaacaaaaaacaaaagaaaaacaaatatttatggagcacttagtgtgtgccaggcagtggaattgatagtttccattttcaggtttgatgtttccataacaccacgaagggagtagcattctcatgttcacaatggaggaaataagggctcagagaagttgaggaactttaccaaagctacacagctagttggtgaacaggggattttgatctatattagctccatagttagtgtggtcttgcaacacccacagctcttgagtctggggaaggaagagactttaaaatgtgggaagaactgaaatcataggctgatgtgaaaaagagagtgctgggacatgtgggtaaatggtcaccccagtaatggggctgctgcctctggcgtgggccaacagcacactgaggggctaatcccctcggtggtcaaagaagcctggatccagaaataggcaataagaagatggtgaaaatacaggaacatgggaggttgtgagcatggccattttgtttcacccagttgagactctggatgatgtggtaagtgtgaggcgcgactgcccaccgaatgggaacgcacaggccctatcgtctcctccaggctttcatgccatggattagatttctccttgacttgagtcacacttcccacatacacaattaagccagacctctcccatcatgaaaaatgtcctccctgaatcctggttgcacttttagccattatcagatctcttttaattaccattataggcatgtctctgaaaaagtagcccacagtctacttaacttagttaacatttattgagagataattaagagcagacactgggccaagtggtttatgttacttttctgttctcacaactacccagtgacagaggtactattgccataccattttatggactagtaaacaaagaccaactaagattaaagaatttcccaaggctacacagaaggaagtggcacaactggtattcatttccaggtcatttgagaatgtaagtaagctttataagggaagggattttcatcttctctcattcactgatgtatccctaggactgagacaaatgccccaaacacagtgggtattcaatcactgttagttgaacaaatgaacctgtgatggtatctccacttaatcatgatgccaggctgcccactgatcctgtggccttcccctctgctgcattttctacagctgcatgactgttttcctcttctgcagtcccattttcccctgtgggattcccatgtctctctaatgcattctccttcccctttgctgcattccatttcccactcctgcattcccatctcccactcctgcattccatctccctctgctgcattccatttccctctgctgcattccatctccctctgctgcattccatctccctctgctgcattccatctccctctgctgcattccatctccctctgctgcattcccatctcccactcctgcattccatctccctctgctgcattccatctccctctgctgcattccatctccctctgctgcattccatctccctctgctgcattccatttccctctgctgcattcccatctcccactcctgcattccatctccctctgctgcattccatctccctctgctgcattcccatttcccactcttgcattccatctccctctgctgcattcccatctcccactcctgcattccatctccctctgctgcattcccatttccctctgctgcaatcccatttaccattccagcattcccatttcccactgctgcattccatctccctctgcttcatcttcccatttctgactcctgaattccaccgccctctgctgcaatccctatcccactgctgcattccatctccctctgctgcattcccatttcccactcctgcattccatctccctctgctgcaatcccattcccctctgctggattcccattttccaattctttattccatctcccactcctgcatttccatttcccatgcctgcattccatctccctctgctgcattcccatttccctctgctgcaatcccatttaccattccagcattcccatttcccactgctgaattccatctccctttgctgcaatcccattttccactcctgcattccctctctctgctgtattcccatttcccattcctgcattccatctctctctgctgcaaacccatttttctctgctgcattccatctccctctgctgcattcccattccccactcctgcattcccatttccaactcctgaattccgtctccctctgcctcattcccatttcccactcctgcgttccatctccccctgctgcattcccatttcccactcctgcattccatttccctctgctgcaatcctatctaccactgctgcactcccatttcccactgctgcattccattttcttactctgcaatcccctctgctgcattcccatgttttccacttctgcaaccccattttcctctgctgtattcccatgtccctctactacattctcaatttcctttgctgcatttccatttccctttgctacactcccctctgctgcatttccattttccactcatgcattcctattatcttctgctgcattcccatttccatccctccatttccccctgatgaattcccatttctcactactacattctctccattgcctttcccagtgctgcattcccctttctccatttctcttctcctctgcctcattcccatttccgagcgctccattcccattttccactaacacatttccctctgctgtattcttatttcccactgctgcatttccattttccactgatgcatttccctctgctacattcccctttgctgcatgtttcactgctgcaatgataggctgttcattcttgcaatccagctttctccccacctccctatgctttgccccacccctaaacttggctctgatcaagccagtgaacactgcaggctttctctgttatttgatgctgttgaaaattcctggttgaaattttctttcctttgtggtatccataatggcaatgattcccaattatcttcctgcctcttgagctgatatatacagggatttttttttcctatcttaatatgttactcctcttcagctcacctcctacaaataggcaggctcttcctaatttagcgctcttatttttattgcacacacacactcatttagatctaatgctctaactaccaactataacctataagctccaaatctatacctgtaaccagatccatgtctgaactccagagtaatatttctgccttcctgttgtaatttacacctgaaatctcttggtggcctcagatgcaacctccatacaatagaatgtattagtttgtcccccatacctgttcattctcctgcagctcttgtcttggcaaatcacaccaccatctgcctggccccccaaagcagactccaagtgccattgtccacactgaatagacactaactccagtcccttctactacctatctctctcaaacctggcccttgtcttcaatccacttccaggatggttcaccctgtgtcatcccccggcctacacaacactagtgctctctttccaaaacgctgcactgtccatcattcagctgccaaacatttgttcgtagctccttgtcacctatggaataaattcaaaactacttgtatatcatgaagatcttcataatcaatccccactcatttttcctgcctcatgtcccatgagtaccacatgctccactatagctgcattttcctgaacataccaggatcagctacttggaatgttctctccctgcctcccagccctaccctgacttctccagcttctccttccatgtgaaatcctgatcactccaaggtgcattgtcagcatcatcccctctttgatgtctttcctgacccctttcccttcaggcacaatgaagagcctcctcccttagtcctcccccagtgcctgagtcatttttccctttcagtgctatgacactgaattttaaactgcaggcagtgcccatcgtgaaaactaagcacggtccttagctctcacttttaatggatcttttataaataaatgagttggtaagtaactaaatgaaagcaagaatgagaaaaactgaattcagggttctacctaccaaagagttgctcgatcagtgtgatgtaaatgagaacagatcttctggtaggagagtgatttgcttcagagacagttgacttctctgaacttaattatatttctttttcaattagaattgtcttaactaatcctccagcaattctgtagctgagttacttgtaactcagaagggaatatgtcatttaacttatgctcaacactgtgtaattacagcagcttcagtgcatgttatttcccatgcacaccagttaggatacttctttcttaaagaaatgaaacttgatccagtggtttaggagaattacaggaggattgtgaatcactcatcgattcaagcaagggaaaacagtaaaagcattggtgagggcatctttttcctgcctatgagtcttaacctgtatgtaagttgtaaaatcaatttagggagttccatttagcatttaaaatgaaacagaataaaatcaaacgggaagtaccaaagtatattgcatatagtaaaggtaagtattaatttgtgaaactttaatttcagatgcacatgtgtgtatgtctttgtcatgggctgtagtgtaatattcttaccatgtgtcataatcaaaaagttagaaaacagtggttaaaagcatttattgaattttactgataattaggtctgctgccagctccctctgtgactttgaacaattgtttaaccttaaacaggaataacaacacccacttcttaatgctattatagtgcttaatgcttatcacaaagtattatatgagatttaatataattatatatatttatataattattaattaacagtgatatgttacatatattactattatggtctataattaataactggactggtctcaaactattaacctcacaaagaagtgagaatagatttgctgtagtgctggttcatggatatatgagtctaatgtggaaaatataaaatgatatttcctaatgtgttgagttcaccaattcaattcaatagttgtttactgagcatctactacacagtttctatacttaggaaattagaatctatatttttcctgtttctactggcaggaaggcactaggccaagcctggaacagaataccaagttgcagggttatacttcttgcccttgagcacttaagacctagtaaagtatctaagacacgaaaacaaatgtctcattaaaaggcaatatataatatatgaagagtaaaaacggtaccacaagagaacaaaggaaataacttctggctaaagacatcacagtatgggaagatggggtaacaaaggtggttctatttgaggaaggacatgaagaatgggtactattcaaatgagagaagacaggagaaaatgtatcctgagcaaggcgaggagcatgaagtctatcacgagaattataagaggtaagaatggaaacagagagcaaactgggttttatgcctttgccttcattaacactgataactgcatcttctccaaaagttttttcccagcatctgagcaccatctcccatcctttcagctcaacttcttgttgagtgctttgacctagaatacccttccagtccactgaggctgccatttcccccattgcccccacacatcttcactgtcctatctccagccaagcaacatcatcatactcattccctcacaagcatcatgaactcctttgccctattctctgtccaagaacttgccaggcaatgccaaagcctggttaaacaaaactgtgtggctattctgagcctcctctgtaattggtgaactctgaagaaaagtgtatactgggctgttttgccttaaattcatgaacacacattttaaatggcattcaaaattgatgaatggcaatcctataacacttccatagtatctcaactctcgcaatcttcgagactactatttcacacttagtcgctggagacagttcaaacaattgttctgtcacttaccagctatgtgagtttaatcttgatgtgccttagtttcttcacatgtaaatatgtacctatatggtttcctcatatgaaccactatataggattattatgaaaattaaatgggttaatagatgtaaaacatttgtgtactacccagaacatggtaagttctataaaaatatttgttataattattgttcttctctctctttaaagtcccctatttctttttctcttttcacttaattattgaccttatctcatactttatttggaaataagaacaattgaagccaggtatagtgtgcatgcctgtagtcccagctacttgggaggcagaagtgggaggatcgtttgagcccagaagttcaaggccagcctcagcaacatagtgagatctgtttctattaaataaataattttaaaaaaatgaaatttaaaaatagaaacaactgggagaggactctggaaagatgaaggagtgggaagcaccaagaatctgtctcccacctagacaatgatagcacaaaagaattctggagttttttgaagactttcagcttccagggaaaggcttgcatagtaaattgcaatcaattgtggtcaatttcagttgttagtttaacagtagctacccatctcctactcccagccctgtggcaggcaattgtgcacatgttcctggagcagcctgcatgtagcttgcaggagccagagtgggcaaaaaggaccctgtcctttaaatatcagggatgtatgccctgaccactgattgctgcttctgataacaaagtacagatacagaagcagttggccatttttgttacaccttaccctattgttacaagtccttcccccactgactcaagtaacttccaggggatttaatgagaacaaagagacagtgtaccagaatctctgcgacacagctaaagcagtgttaagagggaaatttatagcactaaatgcccacatcaaaactaacaacctaacatcacaactaaaagaactagagaatcaagagcaaataaaccccaatgctagcagaagacaagaaataaccaagatcagagtggaactgaaggaaatagagacatgaaaaacccttcaaaaaatcaacaaatttgggagttggtttttttgaaaaaaattaataaaatagaccactagctagactaataaagtagaaaagagagaagaatcaaataaacataaccagaaattatggttctgggggatatcaccagtgaccctacagaaatacaaccatcagagaatactataaacatctctatgcacgtgaactagaaaatctagaagaaacggataaatttctgaacacatacaccctcccaagactgaaccaagaagaaactgaatccatgaatagaccaacaagttctgaaattgaggcaataacaaatagcctaccaaccaaaaaaagcccaggaccatacaaatttacaggtgaattctatcagagatacaaagaagagctggtaccatttctactgaaacaattccaaaaaactgaaaaggagggactcctccctgactcattctatggggccagcatcatcctgataccaaagcctggcagaaatatgacaaaaaaaagaaaacttcaggccaatacccttgatgaacattgatgcaaaaatccttaataaaatactggcaaactgaatccagcagcacatcaaaaaacttatttaccacaatcaagttggcttcatccccaggatgcaaggtttattcaacatacacaaatcaataaatgtaactaatcatataaacagatataaagacaaaaaccacatgattatctcaacagacacagaaaacgtctttgataatattcaacatcctttcatgttaaaaactctccataaactaggtattgaaggaacatacctcaaaataataagagccatatatgacaaaccgacagacaatatcatactgaatgggaaaaagctggaagcattccccttgaaaaccagcacaagacaaggatgccctctctcaccattcctattcagtatagcattggaacttctggccagggaaatcaggaaagagaaagaaagtattcaaataggaagagaggaagttgaattacctttatttgcagatgacatgattctatatctagaaaaccccgtcatctcagcccaaaagcttcttaagctgatgaacaaattcagcaaagtcttagggtataaaatcaatgtgcaaaaatcgctagcatgcctatacaccaacaacagccaagcagagagccaaatcatcagtgcactcctgttcacaattactacaaaaagaataaatacctaggaatatagctaacaagggaagtgaaggacttctttaaggagaactacaaaccactgctcaagaaaatcagagaggacacaaacaaatggaaaaacattccattttcattaataggaagaatcaatattgtaaaaatggccatactgccccaaataagttatagattcaatgcaattctcattaaactaccactgacattctttatagaattagaggaaactattttaaaattcatatgcaacccaaaaagagcctgaatagccaagacaatcctaagcaaaaaagaactaagctggaggcatcacactggtggacttcaaactattctacaaggctacagtaaccaaaacagcatggtactggtacaaaagtagatatatagaccaatggaatcgaatagagaactcagagataaagttgcacatctatgaccatctgatcttcaacaaacctgaaaaaaaacagcaatgtggaaaggattccctacttaataaatggtgctgggagaactgactagtcatatgcagaaaactgaaactagaccccttccttatgccttgtacaaacattaactcaagatgaattaaagacttaaatataaaacccaaaactataaaaaaagtagaagaaaatctaagcaatgccattcaagacataggcacaggaaaagatttcatgacaaaaatgcaaaaagcagtagccacaaaagcaaaaattggcaaatgagatctaattaaactaaagagcttctgcacagcaaaagaaactatcgtcagagtgaacagacaacctatggaatgaaataaaatttttgccatctatctatctgacaaaggtctaccatccagaggctacaaggaactaaagcaaatttatgaggaaaaaaaaaaaaaacattaaaaagtggtcaaaggacgtgtcttctcaaaagaagacatccaagtggccaaaaaacacatgaaaaaaagctcaacataactcattattggagaaatgcaaattaaaaccacaatgagataccatcccatgccagtcagaatgatgattattaaaaagtctaaaaacaactagtggtgaggttatgaagaaaacggaatgctcttacactgttggtgggaatataaattagttcaaccattgtggaagaaagtttggcagttcctcaaagatctagagacagaaacaccatttgacccagcaacccctttactgggtatatacccaaaagaatataaatcattctattataaagttacatgcatgtgtatattcattgcagcactgttcacaatagcaaagacatggaatcaacccaaatgcccatcaatgatggactggataaagacaatatggtacatatacaccacggaatattatgcagccatgaaaagtaatgagatcgtatctttgcagggtcatggatggagctgaaagctgtcatcctcagcaacctaatgcaggaacagaaaaccaaataccacatgttctcacttataaatgggagacgaattatgagaacacatgaacacaggggagaaacaacactcactgggacctgccaggggtcgggggagagcatcaggaagaatagctaatggatgctaggcttaatacctaggtgatgggatgatctgtacaacaaaccaccagggcacacatttacctatgtaacaaacctgcacatcatgcacatgtaccctgaaatgtaaaataaaagttgaagagaaaaaaagttcaggaaatttatgaaaaacaaaacctcttcaggccaggcataggtagctcacgcctgtaatcttagcactttgggaggccaaggtgagcagatcacttgaggtcaggagttggagaccagcctggccaacatagcaaaacactgttctactaaaaatacaaaaactagccaggcatggtagtccatacctgtagtcccagctactcaggaggctgaggcacaagaatagcttgaacaggggaggcggaggttgcagtgagccaagatcttgcccctcactccagcatgggtaattaaatgagactctgtctcaaaaacaaaaaacaaaacaaaacaaaaaaaaacaaaaaaaaaaacccttcaatatttcttaattatagtggtcatagggaacactcatatgaacattctgaaatcagggaaaaataaagccttagttattttgtgaaagcaaaaaaagccagcaccctttcttttttcccttttgggagctaaacagtaacctttaggacatgcaaaaataactgcaactatggggaaaattagaaagtaaccatgcacactcaggaaaggggcaggctcagaagaccttaagtttataccacaggctgatccttggcactgagagacatcatctacaacaataaaaataaaaacaataacaaaaaacagcaaactttggggaagaagcaaaatctgaattccagaattaccacatttttaggtcctaatgttcagttttcaacaaagaacatcccaaggcatatgaagaaacagagaagtatgacccaaagaaaaaaaaataaatcaacagaaaatgtccctgaaaaatatctgatggcaaatgtgctagacaaataattttaaacaactgttttaaagatgttcaaaaaactaaacaaagacatggagaaagtcaagaaaatgacgtaggaacaaaatgaaaatatcaataaagagactgtattactctattctcacactgctataaagatactacccgagactgggtaatttttaaaggaaagaggtttaattgacttacagttccacataactggggaggcctcgggaaacttacaatcatggtggaaggtgaaagggaagcaaggacctttttcccatggcagcaggagagagaagagagaagggccccttataaaaccatcagatctcatgagaactaactcactatcatgagaagagcatgggggaaaccactccctgattcaatcatctccctccctcgacatgtggggattatatgtctctcctttgacatatggggattacaatttaagatgagatttgggtggagacacagagccaaacaatattgagatagacaacctaaaaaaaattctgtaaaacacaagaacaaaactgaaatgaaaaatctattagagggattcaaaggcagatttaagcaggcagaaaaatcagcaaacttgaagataggctaacagaagttatcaagtctggaacagaaataaaaaacattaaagaaaagtgaatagagcctatgggacctgtggaacaccatcaagtgaaccaacatacacattgcgggagacccagaagcagaaaagagagaacatgtgaagaaataatggcttcaaacttcccaaatttggtgaaaggcatgaatataaacattcaggaatgtcagtgaaagtcaagaaagatgaattttaaaagattcatgctgagacacattacaatcaaacagtgaaaatccaaaaacaaagagaaaatattgaaagcagcaagagagaagagagaaacacataaaggattcttagtatgattatcagcaggtttctcatcagaaactttggaaaccaggaggcagggcagtgggcccatatattcaaagtgctaaaaggaaataatctgttaccaagaattctatatctagcaaaactgtcttttaaaagtaagggagaaattaagatattcccaaataagcaacagctgagagagtttattatcattagaactgccctgtgagaaatgctcattttcatttcactcttaagaaagtcctgcagggtgaaatgaaaaaatactagacagtaacttgaagccatatgaagaaatacagatctgaataaaggtaagtacatggccaattataaaagcaaatattattgtaacaaatgttcataatgtgactttttgttttctagaatattagaaactaatactttttttaaaacacacaattactagtctaaaagctaatattattatagccatggtttgtaactctacattctgttttcacttaattgactaatgaatttaaaatcattatttgacataatataattctgtttcaaggcacacaatgtattaagatgtaattttgtgacatcaacagctgaaagaggtgggtctaactctatagaaaccagaggttttgcatgttactgaagttatactagtaaaattcaaattagagtgttataactttaggtcattaaatgtaatccccatcgtagccacaaagaatatagctgtgggatatatacgaaacaaaatgagaaagaaatttaaacacttcactactaaaaaaaaaatcaaacacaaaagaagacagtaatgcacaaattaagggacaaaaagagctgtaaagccatagaaaacaaatagcaaaatacagaaacagatgctcccttattggtaactggctattttaaatgtaaactcttttgtaaactttgatagagaattaaactctatatcaaaatgcagaaattgacagaatggataacagcaaatgatccaactatatgctgtctgtaagagaatcacttcagattcaaagacacaaatagatttaaagtgaaaaaaaatagaaaaagatattccatgcaaatagtaaccaagagatggcaggggtggttatcctaatgtgagaataagtggactttaaatttaaaaaaaaagagttataagagacaaaacattatatattaatatgtttcaatatagcaagaatatagaaaaattatgaacatatatgtacctaataacaaaccataaatatatatgaagcaaaaactgatggaattgaagaaaaacatagttttactaataatagttggatactttaatattcccctctgaataatggatagaacaactgcacagaagtaaagaagcagaagacttaaaggacacataaaaccaactagatctaacagacatatactgaacactttacccaacagcaatagcatacatatttctcttgagacatttgtgatattttccagtatagaccatatttaggccacaaattaagtatcagtacattttaaaagatagatttcatacagggtaccctctctgactataatgggatgaagttagaaatctgtaagagaagtaaagtcagaaaaaattaaaaatttgtggaaattatacaatgtactcttaaacaatggatcaaagaaaaaaatcacaaaggaaattgaaaaatattgacaaatttaaatgaaaacacaacataacgaaacttatgggacatagcaaaagcagtgctaaggagaaaatgcacagctataaatacattaaaaacctagaaagatctcaaattaacaacctaactttaaaacttaaggaactagaaacaaacaaacaaactaaacccaaagctagcagaaggaaagaaataataattagagataaataaaatagaaaatagaaaaataatagagaaagtaaatgaaaccaaaagttggttttttcaaaagatcaacaaaattgacaaacctttatttagatggactaaaaagaaggactcaaactattacaatgataattgagagtagagagattacaaagtatatagaaataaaaaagattataagggagcactatgaattactgtataccaacaaattggataagatagataaaatggacaaattcatagaaacacaaaacctatgaagactaaattataaagatataaaacacctgaataggcctataactagtaaggcaattgaatcaataatttaaaatctcccagtgaagaaaagtcctgtacctgatggctttgctggtgaattctaccaaacatttaaaaaagctaacactaatccttctcaaatttttgcaggaaattgaagaaggaggatttcctaacttattctatgaggccagcatgactttgacaccaaagccagaaaaagatactataaggggaaaaactacagatgaatataccttataagcgttgacacaaaaatcctcaacaaaattcagcagcctatcaaaaggattatgtcaatgaccaagtgagatttatttctgaaatgcaaggatggttcaatatatgaaaatcaattaatgtaatacatcacattaacacaattaagggagtaaaacacatgataatctcaactggtacagaaaaaaaacatttgacaaaattcaacactttttccatggttaaaacactcaacaaactaggaatagaagaaaactacctcaacataataaaaaccatatatgaaaaaccaacagtaaacatcatccttaatggtaaaagacttaaatatttccttctaagatcaggaacaaggaaaagatgcctcctttcaccacttctatttaatacagtattggaagttctagccagagaaatcaggtgataaaaaggactaaaagacatccaaattataaagaagtaaaattatctgtttgcagatgatatgctcttttatagtatatagaaaattctaaagattccaccatgaaataattaggacaaatgtatgaattcagcaaagtagcaggatacaaagttgacacataaaaatcagttgcatttatatgcactgacaatgaacaatctgaaaagagaattatgaaaacaatttcatttacaatcacgccaaaaagaataaaatacttaggaattaactaaaaaactcaaagaattatacagcgaaaacaataacacattgctgaaagaaattagagaagacataagtaaatgaaaacacagcccaagttcatgaattgaaagacttattataaaaaatgtcaatactaacccaaggagatcacagatccaatgcagttcctacctatccaaatttcaatgactttttattattgcagaaatagaaaaactcatgctaaaatttatataaaatctcaggggacctcaaagagccaaagcagtcttgaaaaaagagaacatagctggaagactcacacttcctgattttaagacttaccataaagctatagtaatcaaaacagtgtgatactggcataaaaataaactaatggaatagacaagaaagcccagaaattaactcttgcattacggtcaaatgatttttgacaagtatgtcgaaaacattcaatgagaaaaagacagtcttttcaacaaacggcactgagaaaactggatatccaggtggaaaggaatgaagctggacccttacctaacaccattttcaaattaactgaacatggatcaaaaaacttacatgtaagtactaaaatacattttttagaagcaaatgtaagacaaaatcttaacaacattggatttggcaatgatttcttggatatgaagccaaaggcataggcaacaaaagaaaaacatagacaaattgagcctcatgaaaatgtaaaaattgtgtgcatcaacactatcaaaatgggggaggttaggcatgtgtgggagcagaggacatatgggaaatctctgtaccctcctgattttgctgtgaacctaaaacttttcttttaaataaatattttttaaaaccatcaaagtaacagcaacaacaacaaaaaagacactatcaacagagtaaaaaggcaacccacagaatgggagaaaatagttgcaaatcatttatctgggaagagattaatatccagaatatacagagaacttctaaaactcaacaataaccaacaaactaaattcacaaatagtcaaaagacttgaatagacatttctttaaagaagatatataaatgaccaatacgcacataaaaagatgcgcactgtcattaatcattagggaaatacaaatcaaagctataatgagatatcacctcaaccaattaggatggctactatcaaaaaacagaaaataacacatgttgatgaggtcggagaaactgaaaccacggtgcactgttagtaggtatataaaatggtacagctgctgtggaaagcgatagggcagtttctcaaaaaattaaaaatagaattatcatataatccggcaattacacttctaggtatatacccaaaataattgaatgcagggtcttaaagagatatttgtacacccatgttcatggtcagcatttttcacaatagctaaaatgtggaagccacccaagtgttcatcaacgaatgaataagaaaaatgtggtatatgtatacagtagaatattattcagccttaaaaggaaggagattctgcaatatgctttaacatggatggatcttgaagacattaatgctaagtaaaataagccagtagcaaaaacacaaatactgtacagttatatattacataaggtacttagaagagtcaaaatcattccattgttaatgggaacaaagtttcagttttacaaaaaaaagtgatagtcgcacaacattatgaatgtatttaataccactaaaa

SEQ ID NO: 11870 - DNA, 67902 bp, Human
attgtcctttcatttgcaagtgtgaaagtaatgtacatttaaatgctttcatgctgttgtcaattgtgggttgtaggtacaagaaaaacaaagcatcttgagaggaaataaaaatttcttgagcttttctgccagcatcaacatggctaaggagattgctttacactgagtaattttccttgttaacatttttattaagttgtcatgacaactttcttattctccataaagtggaggaaagtaggttttaacccataagtcaactataagaaagaagattggacctggaagatgatgaaatattcaggtattcatttatccactcagcaggcattttagtgaatcccgttatgaaccattttcattactaggaaattaggctgtgaagattagtatttccctaacaacaaggaactcttgttacttttttagagcatatcaaacatccagattacagaatgtcttttgcagtcaccttttggtggttctagccacccttatgtttagattggttgcttcctcttcttacccattgtctgacagtcagaaaggatagaggaggaagaagacaagacactatccagttgagagtctactcttagtaaaactcggtagctcctggcagaatgtactggggtcaaatgcaatactaatcaaggagtttggtgtgccataaaacttgagaatggtaaaagtagaaattaatgggttaaacaagtcattttccagaatgaaaggaatattggtaatggtatcaacagacgaggacaacagcaacaacaaagtctttatacaagcctgcaacacgtgacaactgcggatcaggcatctgaacccggcctatctttccaccgtatcttcctacacttttctttatgtactttttatttctaccagatggtattactccttgtttcttgaataacagtgtcatgcctttccaacctctgtatgtttgctcacaagtttccctctgtcagagaaaagcaaaaacaacaaaaaagtcctctattttatctttttccaaacataaccaatccttcaagtcctatctctagtactgttcctttatgaaccctgtcagacaatatctcattttcttctgaatgttcatagcatttacttaaaaatagtatgacttccctcttctttttactaatgaattactgtgtattttttaagtttccttctacatctgaagttctaaatattcttagtacaaatgtcctactgatctaagagagtatcatgggttaaatgtagaggaagagaagtttctgagatggcaggaaggcaaaagtttctgtgactacctgtgcttatattgctgactttcttaactgttcctgacttatttaaatgtatttttttcctgattctgattaatgttcactatgaggcaagcacagtaggcaagactgggagaaagtttgcaaatgtgatgagcttacaaatgggaccagattagatggtgtacttgggggagatataaaagaggaagataaccatgaattgaactgaattgaaaatggatcacataaagatcatgattaattgttaattcacaatggaacagcatgatgggatttttttaagtcagaaaggtgactaaaagcataatatcacaacacacacaacggtaacaaatataactaaatgcactgaaccaggcagaagccagaccttactgaaaagatgtaaaatctctgtaaccataaaactgcatctgcaaatgagtagattggcttcaaatctgaaaaccaggacaagagagtcatcagcgcagatgtcaacttccccagcagaaatgttggagtttttaactgtggaaaactacagtttttccacaccagtgcatagtggagaagacatgtttttgtttttctttttaagtgtgccaaattttcctggagtcccctccaatttttttctttctctctctctctctcttttttttttttgtcccctgcccctaggtctctgtctccacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagcgtaagtgccgctgccgcgagtgcccagggtgcactcgcgcggggaccgacaggtgccactgcagggtcccctctcccgctcactgcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtgcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacagcaaaagctgcgatcgctgggctgcccagagaaggcagccggctaactgcccagcggctccacgaggtgtgcgcgtgtgtgcgagagagacaaatgatttactgcttagcagtcccatttctgttttcgttaggactgcggctcttggagaaagcgtgagcagggggccaccgcggtctccgcgcctgtctgcaccctgtcgcctgagctgcctgacagtgacaatggtgtgaggggctgcgttgcaatgtggtcatgtgatttcaggctatggatttcgtgcgtctttctctgctcactgattttcacatggttattctttcattttgcactcgataaacagtttacatcttctgaagtaagccagaagattgtatggctcacttaacgatgactggttgaaggcatcttgatttggaacctatggaaacagtgctgagttttaaataggacagatttttttttctttcatttgaacttcatttataacatatcaatagtgatgttttaggatcagttctcctatggtaatttcactaaatgcctatttaatgaattgatttgatttcatacatctctaccacttactagaactgtctttgtacaaacgtcaaactttcctgttacatatgggtaagcgtagaagcacttgatataatttttttttatcttggttcatagtgtagaagtggtctgttgcttttcctaaaattgctatacatattttttctttaagagtgatcatttcaggtaccctattatgtacagtggtaaaaagtaaactcgttatgatagcaacgacgatgtaaccaaaataagcaacacttaattggtctgaaagttatacatataagctttattattgcttcagtggaagttgtctatgcattctgtgctttgttcagccattaaacaactgggtccgtgatcttcttcaaggggccgtgaagtccctaaaattgtatttaaacattagagtggctgcattttaagggagatagtacatagtcaaatatccaaaatggacctgtgtcctaatagaaaattaagaaccacggggtaaaaacacgtaagccatactttttcttatcaaaacaacaggctgtctacatacagcctgcagacataggctagaaggaaaattctagaacaattaaatggtgttacagtagttaaatatttcacataaaatagaccagatgtatgtattttaatgtattaggaaacaggtctgtgaacgtatttagtagaaatttgtaattaatagatgggtaccttatatttatatttataaggtatatttatactttatattgtaagatctctttctattatacgacagaaaataaaaattatatttttgtctttgaaatccaatcaaaatataaagtacttatgcttggtatagtgtctcatagtgtatgaaatataaatagccccttaaaggtcttgcttctagatattcaggtattaaataacatgattaaaatcgttttctgtcattcggagaatgaggaaggaaatataaaattattttatttatttatggcaataccaaaaacaaaagtgtgaaaaacttcacaatgcttagtacttataactcttataattatgtcttattaagggatctttcttaagacattttgaaaagctattttaatatttcactacaaacaagtgataatattaaaattaaagtatatctattacaaatacatcagtaaaatattttgtgaccgaattttaagaattttgttatatttttcaaatgaaattgaaaaaaattaaatgtttatctaacatcacttttattgacacattgatattgcataactttgaattttttcagaaactatacaagggaaattaaatcctgcatttacatttgctagcaactaatgagtgtggactgaggataatatttcttgctttacaggttagtttaaaataacacgatctgcacccccataatttctaattaaccttttttcagaactaaataaacatcaaattagccatcagaatgaatctctacaagtaaggggaaatggaaaggtaaagcaacatttcagtaatacaagccaaaaagtatgtgcattaatgggaaaaatttttggaggaagctgttactgagaatgactttttctgtcagattcactaagaagttgcttggcttttatttgtgagaatattccattttgaaggcactatttttacactggttaattaaaaatatttacccaagccacttttcttaaacatttctatttattacttttctgcacatttgtaaaaacaaattttttccccaaagtattaataattaaaaatatgtttgtctcttgaccatctacattcattctgcaatagtttgttttgggtgtctacatcttgacttgatataagaagagcttttgtcaatgtttagttactagttgatttactttgggtgaagtaatttcctggctatcctgaatcatatctgcttcttttattttctttcagaacattttgaaatgtcttacctattatatatgtaatttttcttcttccctgggttcatgccaataggcttcatcttcctatagcctcgaaggcttacagaggatgaacagagttattttggaggggtgaaagaagagctgtagagtgggcttccctctcagcccacagtaggagagaatggctacatcttaaaacttgagggactctggagcaggctcttccttgccacaagaatgtgcctcacagcctgtagtttctaacttctggtatgctttctggccattaaacaatatttcattaaaacaaatcctccattttaaaaattgaggccaagtcaaattaattaactcacataccaagtcatctatctcaccatactaagaattagcaggaagtcgacacgagacaatggctttgagagtgaacaccttcttaggggggaagcaaatggggcagacccatttcttaatcctgacctttttttctaggtccagcctatctatttatccccttttgctatgtcacatgacattgaaagtacctgtttaaatgtctgcatctcccattaaactcaaatctccttcacggtatccaatgttggatccatagtgcttggtgcatagtaggtgtctaaagagcttaacattgttgtcattgttattcttgaattaaggcttgtttatgctttgatgctaccacatggagctatggtcttggtgacagagacccttgtgtgctcttccgtcatatagtttgtggcctcttcagaattgcttgtaaactgttatttatttcaccaacaattttaactctgctccaacccttaaatctcttgccactagacctaccagaacctgccttcccaatgtcagcttcacttttaatgtttgctttaccttccttgctgttgatttagctggacaaagagagacataactgtatcttgtagccaactaccaattgcttcactccaatgtcagcttggaggatactttgtgcagctattttattcttttttagttaatgtcatatcaaattctccatggtacatattctggatttttccaggttttctagtctgcccagattatctccagactcttcattcttagcagaggaccatactttttaattcacagaggatgttaaggtcagtttgggcaaattatttgtcaacactcatcttgaatacagtaagcatttctttgaccagctgtgagcataagaactcttttcttatattcagctatcgaatttgtctctataatatttatatctttaattttttacctcttagagtatttatagaaaatgcttttacatctaacaactcttaatagtgtctaagataatattcagtttcttcaacccatgcttatttaccatgggttgagagtctcattgttaccagggcttttctcttttggatgcacttctgtttttattaaagtgtgatccccagagtttaacatagaggactgtcctctgatatatttatcttctctggatatcatgtagtaaatcaacctgaaatctattctactcttcccccctccgttttttttttgcactcatacaacactgtttaattatgtatcttttttgcacattcttctgcaaatacacttattttccccatcgaattttatgtttggccacttgatttgggacttttacaaatacttactgcaattaaatttaatcattacctttagttagcctgttgttccagaaagtcaaggtcatcttggattctgagtccttgatacagaatagccattttcaccaatttagaggaattaacagatttgatcaggatataattaacatcttcatccaagtaactatctacaatgctgaactggaactacctttggcatattcctagacaccgtcctttacgttagactcctgctttacattagtccataaattattcctctttataaggctgttcaaccagttatatagtcaaataactctctttgaagttgacattcctttgtgtgacttaagagagtatactgagacagacttggtcaaattcctccctgaaatgagtctccactttctgcagaatagatgtcaagtaactgctattaaaaacaaaaggagataactaggttagttgacaaggataggttcctgtgacctctccttatcttgtagataacagcacttcacattttgaatgcttgcatgccatgtttttaatcatctctttggaatagtacctgcaattaatgtccagctctctaaattatagctgatggaatccaccttcccaattttgaaaattgaggcaatggttggactctgtcaacacttctcttcatcacaatatttttaaagatgactttaacaattcctttattttatccacacatgctttcaatattttgtagtgtaatttctccaaattaatggatttaaactcatttagaatatttgctatcattctacatgctggacctttgttatttttagttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcacttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtgtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacacctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcctgggcgacagagcgagactccatctaaaaaaaaaaagaaagaaagaaagaaacaaagaaacaaagaaaacatgtgctatcatgagcctacttggaacagtgaagttatgtggagagtacttgtaaaaaaaaaatgtttaaaataaagaagggttagattacaagtccagcatcttcgttctttatatgcttattctaacagattttttctatttttaaaatttatttctttttacatcttaagcttttttattaaaaataaagacaaaaacacacaccttagcatggacctacacaaggtcaggatcttcagtttcactgtcttccactgccacatttctcactggaagatctttagggacaataacaagcatggaacagtcctcgcctatgaatacaatgccttcttctggaataccttctgatgaaactgcctgaggctgttttacggttaacttatttttataagtaaaactagtaccctctaaaataacaataaaaggcataatatagtaaatacataaaccaataaaatagtactttattatcactatcgagttttatataccgtaggtaattgtatgtactatgctttttatatgactggcagcacagtaggtttgcctgcacgaacatctccacgagcatttcagttatgcattgtgctatgacattacaatggctatcagtcactaaggaatgggaatttttcagccccattataaacatatgggaacatgattgtgtatgtggtccatagctgacagaaacattgttatttggcacgtgacagtatatgcactggaatttttagctgcttatttttctccatttgcaatatcactttgcagcttcaaatatgctcattataagcagttaaatgatatgtggtttttattacattattaagttaataaaataagtgacaaggagtttcagtattccatagtataacataaacttttaaattgtgtatttgtgagcataaagttatatcaagatctttagcactatatatgaagtatttagagagttacaaatgtagcattgaaggaaatttgggtaaatgcaataaaattgtcagtacatgagttgtaaagcaagatatccatatattagattagcactatacatttgtaaatatgattagcaaaaggcaggcttcccagcgaaaacaaacgtctttgggtaaaattctatttcttttaatgttttaaaatatttgtagtcactaattgtaagtcatattcctctttgtccagctctatcccaaataacaatttaatacaccgcagcatctatttctgcttcttttctgtgtcactggctcagaataattcataagcccttgttgtttcatcttatgctaacaaaaatccagcagtggtatgtaggagagctgtgatatgccctgataagagtttatactttggagaacaaattatcctaattaaagtcactgcttttcttctcttctctctctcctcctctttgaagctgtgagagtttatcttaacctagactggttaccacctatggctttatggcttgcctgctggcttggctgagagcaagaaagttgtatatgagggatatcacaaggccaccttccacaaaaattgctctcccacttggtcctgtcctaaggcctaaatctcctttgggttgatgcaatcttttggagtgtctcctggagtcaataagatgcctgttttaccgtgaagagcagcacaatgaagaggttgcccaatagcagtggttacttttattatgttgtctttctgccttcaatcaagagcatgacacttggacatagctttttaaagtaaaaaggaaactgaaaggctcagtatgtgggacatagataagaaaatgagacctaaatagggtgtattgggcaacaatacagggcttaaatagaaagaggaagaccaaaagaaagcaaagaatgtcctaagaagagctgggtttttttttttttttttttaacaattttgttgcctattagttttcttcattcctggggatggttgggacatttttccacatcggcatgttatggccttgattatctacctaaatcaaaccagaggaaaatcattttagtttatttttatcttaacattggatctgtttcagcgcgtcctggaaattagtagttgcatgttgtcaccgtctattttgtacacagtgaaaaggtatttggctgtgtttctatttacattcactgtccttgataaatactaattggccagtgattgtaagtctcaagaatttttgctgcagagcgtgtgttaaaactcattttaagtggtgtaggagtcatgcagtgtttatcacttaagtgggtaatctgacagctgtattttactgcctgactgcagctttattcttgatcattctcttccttgagtagtgtgttatggtcatgttgtcttagctgcaattaattcccaacctttttttgttttccagtctttgtcttttgcatttatttttctgctcctgcaatgccttactttgttgtctctgccttgctatttcctatttattctacaaagctcaccttaagtgtcacgttttcagggacatgtttgccaatgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgaatgagtgaataaataatcagattagttgatgaaagattctaagggaagattaggtagtgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggcagtcctagatagtgcagccgtggattgaaaaagtgttctagtttcctctttttaagccaagaatccatccttaaatataagaagaaaatcaggccgggcaccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactgaggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaagtatactgatagttaggaaaaataatagagttctgagaacaaactgcgttaatctccaaaaatgtacacttatactttaaacctactaatttagaaaattctacacaaatataaattccattagaatgattacatcatcacatgtcatgtagtctctggagaactctgctgcaatctgtgagagaatgagaatgaaaaaggtgcataatattagaatattgttatgaaaatagttctgaccatgcatatcctctgaaaaggtctcaggacatccccaagagtttgcaaaccacatttcgagaaatgctgctttaactcaaatgtgtcttgaacaaggtaaacataaaggtttttacaataattttatatcaagtccagtttataatagtgaacatttcttaggtacattttacattccaagcattaatacaactgcattactttaatcaaatcccttgaggaatgttctattctcatcactgttctacagatgaaaaaatggatgatgcacagagtagataagtcacttgcctaatgtcatacatttaattaataatggaaccggtatttgtagccagggagggttcacacttttacttactatggtaattactatggtaacctttctgcccacattgcaagttttcctgatgatttgtgaattacccaagttttgcttataaacaatagcatttgttgaatgtctagcattttaagaaactgccaaactgttttccattcccaccagtaatctgtgagatttccagttattccacattgccaataactcttgacattgctgaactctagaattttagccattctaatgggtttttgtttaataactaataatattgagcatatgaagaaatgtttatgactgtttatataccttctttaatgattgtctattcagatgttttgcccattttaaaatggaattgtttattttcttactgagttggaaaactgtatattctgaattaaactcccttgctgttgtgtgttacatatattttcttctagtatatgacttgtgtttttgtttatgtaataatgtcttttgaagagccaaagtattttttttattttgatgaagtccactttatcatgctctttttaaatatttcatgttttttttttcaaatttaagcatctttgcttcaaacctggtcacaaagaatttcttttatgttttcttctgtaagttttatagttgtaactttcgtacttaggtttacgatttgtcgtagtctgtttattttgctataaaagaatacccgatgttggataatttatttacaaaagaggtttatttggctcaatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacaccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagattagatttcaacataaagtttggaaggttcgaatatccaaaccatggcatggtccattaagatttaatttttgtatatggtatgatgtgtggataaaagtttatttctatttctatatggatttccagttgttccaatggcatttttattaaaaaacaaacaaacatattttctttcctgattttattgccttgacacctttgttgtaaacacaattgtggatctctatctcattgatctctttgtcacccctttcaaactgatacctcactttcttgattactttaactttttaagttttgaagcaggtatataagtccttcagtgctattttttcttctttaatattaatttggctatcctatgtcatcagtgaaatcttagcctcattttttcaatttttactaaaatgatggctgagatgttgattggaattgcattgaatctataaaccagtttagagaaaatttgtaccttaacaatattatacatggtatatatctctccatatatttagaccttccttaatttatctcgtgaatgttcgtagttttcagtgtaaaagtcttgtaagcctttggttagatttattgctaagtatttattaacagtatcataaatgagtttttaaaataattattttccagtatttgtggctagtacagaagttataatggaattttgtatatcagtcttgtatcctgaaacattgcttaatttacttcttagttctagttattttgtatatccactgggaattcctacatgaacaattttaagtatatgtgtgtgtgtgtgtgtgtgtgtgcacatgcatgtgtatgatccttgaacaacacaggggttggggcactgacactcctgcacagtcaacaatccacataaaagttttgactcctcaaaaacttaactactaatagcttactggtgactggaagctttaccgataacataaacagttgattgacatgtattatatactgtattcttaaaataaagtaagctagagaaaagaaaatgttacaaagaaaatcataaaggaagagaaaatatatttaccatttattaagtgcaagtgggtcattataaaaaatcttcaccctcgttgtcttcattttgagcaggaggaggaagaagaagataaggggttggttttgctacatctgggatggcagaggcagaagaaaatttgcatatgagtggacccatggagtttgaatctgtgttgttcaagggtcgattggatacacacacacacacacacacacacatgcacacacacacacacatgcacacacacacacacgtgcacataaacctgcaaccttttggccttttgtttaactgattgcaatggctaggacctaacttctgtacaatattgattagaagtggtgagagcaggcatctttgcttggtcctgaataatagtggaaaagtgttcagtctttcatcatcaagtatgactcaataattatagttttcatagatgctttctgatgggttaaaaaaattatgattgcagagcttgtctcacttgttctcattattagtgttggagtgggagtctcttgtgactttctgcaatttaaccagaagtcaaagaccctgtactttgagctaacttttgtgctctgtatagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttcttttcgaacacgtgtcctctttcatattcattctcattgtacttttctaattgctgcttctctgtcatagtcataatactttctccagtccttaaacatgaggattccctggagttctaaatttggttatcttctctctatatatgtagcctcttgatcttaaacagttttagttaaactcctgactataatggtttctgctatggggaggagcacaaattcatctctaatctgttacacatttctgaagtaaatactccgattttcaaaagcacctccaccctagattccctgctacctcagttcaagatccatgtatctaaaacaaattcaacatcctttctctcaggcctactgctctgtttctgttacctgtttccatgaacggtgctatatctttctacacaaaacttcagagtcattctattcctcagatctagtgagttgccacatcatgccaactttaattttataatatctctagtagccatcttttcctgcctctttcccacaatttccttcatttcttgctttcacttacactgttctttctctgtggcgtgccccttgccaaaatcttaattttcagaacttagtcatttaaaaaaataagctcaaattctgtacattccaagaaggcttccctgatgattcttttgccaccaccgcctaaatctgatatttcttataaacagttttaactctctatctttacttattctccctttttattgtagccattagctatttaataaaatttcttatatatacataagaaaattcgactgggcacggtggcttatgcctgtaattccagcactttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcacgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgtgctgagtgtttctgataaggcagtcaagtatagaaacatggatggtttttcatttagctgatttcacagcaaagtgcaaaaggaggataggaaattacatgagcattgttgatttctttatcaagcacagaccttggaaatgcataaactctatgtatagtgagatttcactttttctgaaaaaagttgaaaaacaacactaataataagtaaaatagaaaaagagaatatataggaaaacaaaaaaaatggcttgtcaaattgtgtgtcatttacataggtgtgtttgtgtcttcacatacaaagaatccagggaaaataaatggaaaaaaattgaataaatttaataataacaatttagttagcctatctatgtcacttccgtgtttataccagatgactcagagccagtagttctttcaatttcagcagaaaataattattggcagtcccaaagttggataaactgtgacctgcattggctggtttgattaaggctggaaaatagcaaacttgattaagtgacaaagacaagataatgaggaaagttatttagaaaatgtgtttagagatttgaaaagggactaaaagatagtttctcaagaaagtgcaaaagaagatgagaaaattatgaaaaagagtctggggcaacattttaggaactgtagacagtgaaagcaattttataatgtatgttaatattagcatgatatatagacgaaaggtaatcttctgattggtctgagatgaagtagttatgttaaccctcaaaagatgatgaagtgtgaaatttgaattcagataactaagttttcaagttttctcaaagtattccctgcagtggctggtggtccacaaagaaaggagggcttctcagcattttcagtagaggaggtcatcagggtatattgggtgaactcaatacacctatacacctcctgagctttggggtttgagccacatcactgaagtctgcactctgtcatctgcaaatggaagggactgcaataaataatctctaactcctcttccagttctaaactcctattatgcaaatgactctgtctttatattgacttttatgtaagaggtactgaaatgaataggaaaaattgtttggtatttctttaaattttctctattttgaatcaattagatggcagaggcattaaaagaatatagttgtgggtttggatttaatgggaaaagactcagcctttctcaatatggactttgcaagcatccaaatatatacctgcaaagtatatgttcagaagtccaaattcatttctggtaatgattcttctaaactaatcattatgtaaaaacttggcagaattgagtttgtgttggaatttgccacatgtcttttgctaacctgattccagcataagcatcaaggatctgtgtcccagtgttatgacaaaagttcatttcctgtcttaagaatcagaaagagctttactgctggtcagaaaactagaaaaggtacctgactacccatcaattactaataccttagtagcctggtcccctgggccacctccaaagaaacatctgctgagtctccaggcctcgaatctcacacttcacttttatgagccttttctctggggtcataaaagaaaatttctctgagaaacgtactttgccaaagtttatcccttggctttgttgtaaagatcctttaaatgtggcagagacaccaacagcctttttagctgcctttcaattcttctctgatgcctaaaactagagaggctcaaagtgaagttttcaaagggagtctccttagagttcactgggaccctggaagcatctctcatgccttcattttgggaatatctaaacttcattaccttaattgacatgcccaacaacctgatctttcattttattctgtacactaatttaacagatacaatttagtctttgttttcccagattacattttttagtaggggaacttgaataataatcaccatgatatgtcaaaagctcctggtttctcaaggcagctccacagcaggagctctgtagttagatagggttgggttcatttcctgtttctgccactcaccagctatggccaaggacaagttacatgatcgatgtttcagattcttcttgtgtaaaaaatactaaaatacacaaacacacactcacacacccttcccataagattgttgtgaagattaaataagataatgtatgtgatgtccccaacagctctttaaagcaggagtcagtcaacagaccccatcaaggacaagatagtagctacttaaggctttgccagtcatgtgacctccatagcagttactcaactgcacagtttgaacacagtagccatagacagtgcataaatgagtgggtgtggttgtgctccaataaaagtttatttatggacatagaaatttaggtctcatataatgctcatgtatcactgagctcctggtgttctcctgcatgacagcttagctttgtctgaccctctcagccccgctccagcttccgcagctcctccaccgcctgaaccgcctccattgatgcatctgttcttgttctccttgtgttttttttttttttttttttttttctctttgctgttctttctgtacccaggcctatacttctccattaatgggttcttgattaggttgggtaaaattctatctccagcattgcataaatgtcttaatttttcataactgtataagtttcttgtcctttctctcaaagagcttggaaaaatttccaaaggctggattagaagaactgtgaaagtcactagtgtctcttattccaaaatcttctttccaaatatgacaagttagagtccacccagtttgtctttcccctaccattcggtgagttctgtactcacaaggtcactccttccttcccatcaaggatgaattgaccttggtatctcctcattgctcagaaaggtaattcaagtgttccacaggtcaatcccagagtcacttcacttttgtcaggaatccctgtgtctcttactttaactggactctgggtgacctatcttgtttgcacaaatatcttaaagtgaacatgccaattagtgtctcacctctacctgctcacaacctaaacctttccaccaaactaacattgagaaagtaagtagataaaagaattattggccaggcgtgatggctcatacctgtagtcccaacactttgggaggccaaggtgggtggattgcctgagttcaggagttcgtgaccagcctgggcaacacggtgaaacctagtctctactaaaatacaaaaaaaaaaattagccgggcgtggtggcgtgcgcctgtcgtcccagctactcaggaggctgaagcaggagaatgacttgaacccgggaggcagaggttgcagtgagccaggagtgtgccactgcactccagcctgggctacagagcgagactccgtctcaaaaaaaagaattatcactgaatccatatttagaagaacagttagcttataaaagcaataattagagacaggattccttgtataacaaatactaatcatttcccaatatggcattctgggaaaataaaatcagataccacaggatttctatttaagtttggttgttatgagattttgttttgttttcaaatttccacattgggaataatatgaattaataaaaaatagtgagtagtgcaatggcataaggcttgcttgatttataaaatagttttggcttaacgagtagaaaatgaggtttaaaattcaacatagtcacccagtttttatattctaatatttcattaaaggaattagacatgcaacttattatataatagaattagataagataaaaccaaaatagaatctttctgctctaagctgtgctgcaaattctataattttttagttcaataaaaagaactgttgacttagatataactttcttggtatattctctaatgctcatcaagtaaagattgctttctatatttgtaggataatgagcattggatatattattagagttcccttaaacaagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcatttgtgatagtcaacatgtattcctcccatactgggtagcagtgcttttctaagtgctttctatttattgctttgtttaatctcacaacacatttatgagatagttgctattattatccttatttttcagatggagaaaattgaggtgaagttcagttaagaacttcactaatgtcgcagagttagcacatggtagacgcagggagcaaacacaggccatctgttcatgtagcctaagcttttaactgctacgccaactccactgcctcagggaacaactgggcatggcacctacatttatgtgaacccaaccctccaaattatgaagtctctgtcatgctaattatctgcatgagacatgagacatcaggcacttaaaaactcaccattacagggccgggtgcggtggctcacatctgtaatcccagcactttgggaggccgaagtgggcggatcatgaggtcaggagatcgagaccatcctggctgacacagtgaaaccccgtctctactaaaaatacaaaaaaaaaaattagcctggcgtggtggcgggcgcctgtagtcccagctgctcgggaggctgaggcaggagaatggcgtgaacccgggaggtggagcttgcagtgagccgagatcgcaccactgcactccagcctgggcgacagagcgagactcctcaaacaaacaaacaaacaaacaaaaaaaaaaactcatcattacagaagagggaaaataagggtgtgtgtatgtaagtatgtatgtgtgtgtgtgtgtttatgtatgtctctacatcaaggatgtagaggttttactttacttccaggccttcctgcctgaccaaaatttaaaagaggagaaattatgatgtcatgtaatcatcaagttcattatgtcacctaaaagaaatctatcaattagcccaattatttaatcaaggatttgttgtcactttaaaagtttcatcagattattttacctaaattataatgtactctgtggagtctcagaaaatgtgatcttgttgagtgtttcttccaggttggtaggttggcttttcaccttatatgcaaacttaaatcaaacattgattagtgtagaagtatttctgatataacacagcatagatgttcttggaaaacctcatatgcttcaaaactgtgcactaaaaataaaaggacttagggaaaaaatgtgtttgagtgaaatcattcaatgcttacgagcactaacaaaagcaaaaaagaaaaaaaacaaaacaaaacaaaatccccaaaatataaaagtttagttaaaagatacattgaattctaatgaatactgcacctcagcaattgtaggccttgacctaaggggaaaaaagtgaaagtagttggtaggaaagaactataagacagccttgagtctgctgagttatggagacaagagaaaaatacaggaaaattgtccaacagtacttctacgacagagcatatggtcagactgggctaagaggaagaatggggagcaaaggggatctagcatgcctgcattttatcctgacattatttccctagcgatagatgtgcctgagccaattgacattcctgaaatgtacagtacttatttgaaaacagataaaaacaaaatggctttttacagagtaaaaaggaattacatttcttccttaactcatttcataatcattactatattttcagtaagtatattttaaagtgactaagcctctgcaaggaactattttagcaatgtaactatgatgagaatcatagaaaaagatgcaagaaattgttttatatattttagggaaaattggttgaaaagtttatctgatttcctcatgatcagcatgatgcatcataagtagtgatgatacttaatttgaagatgtttaactgcatgtattcaaattgtagtcatcacacgggagagtttttaaaatatattttaggatttataatcccaaaggtttttctcttaaattagttataaaacattctgtaaatactttgataaaaactgagaaacaaaatgtgaatttgaatacttaaaatctccctactatagagttgagtgtactgaattttgctattatttcaaagatgccacagaattgcctcttaaatctaattttaaaagattgtagattgcactcatcttattttaaataaagatttaatgcagcttattaaacacaatttgtgtccagtactgtagttttatcaaggcggttgccacccggcgagtcggggggcaggggcactccaatatgattattgaaagtgaggttgccgttgtctttagagttgacctctctgttttgggagaatcatcagtatgggctcttgagttacaaaaatttaaggtaagcatcctcctctttaaaaatagcttgagacagctcacacttacatgtagatgcagtccgttaggaaggtgaatgccctactcagtaatagaaattggagtgaacaattactgggcttttgaacaaggagaaattgcttcccaaaatgagattttaacagaagaattggagtaacctaactcccacaaggtgttatataatattagaaatccaagctctaggcttggttaagattgaataaccagagtcatgggaaatgtattatggactattttgattgtgcactatggtccctagagtttttccttggctgggatattgagaagtaaagtcagaggaatgtgtcttccctctgctttggtccccacacccagtcagtagcccaggcctgcggattctctctcagaattacttctgcaattgattcattttttccccccagggtcctgtttttgcccaacccagatctaccatctgtcctactctgacccatttttcattctacattccaaataatcttctaaaaatgcagtctaattcacttactctcttgcttattagttatttagttgattgcccttagaatagagtattatcttgtttaatgcggtttgtagaactctgcaaaatcctgacctctgcctattttgtctctcaccaccattatcttgctctgtcttaacctcattcatgcctttgctacactggaattacttctgttcctagaacattggctcccaagcatgctgttctttctggaactctcttggcctgacgcagctcagatgtttctgagaggactaggttcagatctctgatttacattcccagagcgctatatccctcccctttttgcagcagaggccacccttggaactgatacatcagaaatagttttcctcctggattgtaagttcttgagagcaaggggtgttctttacacatcactctgaccttgtgtctagaaaaatgcctggcacagagcaagaccttcgtaaatatttgttgaataggaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagagtcttgagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactggtttatgggattttatgtaatatttttcaatttttgagtaaggaaaactttctaagttttcagtctacctgaaaattaagcctttttccttatttatgaaaatagttgttacaatttgtactgaagtatacaaactttatccttactaaggcaatttgcttttaagttttctcctccttttggctactcttaaaaatctggactttcaagtttaatcttaaaaagctcatatctttttaatcacagatattggcatgtccaggtaccaggtatgatggtagacatttgatacagctaattgcttttgtgatggatacataatttttaggcttgcctcttccctgtaacttttttcgatttttttattatttatttatttcaacttttattttaagtttaggggtacaagtgcagtttgttacataagtaaacttgtgtcatgggagtttgttgcacagattatttcatcagccaggttttaagcctagtacccattagttatttttcttgatcccctccctcctttcaccctttacagtccaaaaggccccagtgagtgttgttcccctctatgtgtccatgcgttctcattgtttagctctcacttataagtgagaacatgcggtgtttggttttctgttcctgggttagtttgcccaggataatggcctccagctccatccatcttcctgcaaaggacatgatctcattcttttttataactacatattattccatggtgtatatgtacgacattttctttatccagtttatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgttacatgtctacatgatcttgttacatgtagtaaacaagatgttcatgcctaattgaattctaggatgggcatggtggctcacgtctgtaatcccagtgctttgggagactgaggcacgtggatcacctgaggtcaggagttcgagaccagcctggccagcatggcgaaaccccatctctactaaaaatacaaaaattagctgggcatggtggctgccacctgtaatcccagctacttgggaggctgaggcagaagaattgcttgagcccaggaggcggaggtttcagtgatccaagatcatgccactgcactccagcttgcatgacagagtgagactctgtctccaacaacaaaaaaaaaagttcatgcttcattaaattttaaattctagagtttaaatgattgagggttgccttacttgcacaataatctgtccctgttattaatactaggccagtagctgggtcattattctcaccacggcaaagttaatcactcactagtaaaaagagagtgagcattaagtttatttggaggctgtttaattatcaacttttggaatgagaagtacctcttcaagtttctgagaacatattattccacttcttgccaaggcctgtcgccaaatttattattttaatttatttgtttttcccttaccatgttactaccatctctacaaccaactatgtactgaattcacccactgaccaaaccatttctgaagttactgctaacgttacccataaaaatcatcactagtttacttgaggaacaatcttttgcctgccaggaatattctgtattctgtattcctggcaggcaaaagcaagacaaacaggtttccaaggtatcaacactgcgtgcatctgcttcatagtgtaatttcatcagttgagcagatgaagaatgctaattagtttgtttatacatatgtaatttaatgagactaaacacttaactatcttaaagtaagcacaacttacttcctgttggctgtttttgctttaataaaaaacactgttcggcttatttcctggaaattatagtaccgtgcagtacaggaaaagaaattatttcaaggaaggttgactggtcaattgtattctactgcagctggattcagtaggaagataagaattaaaatattgggcttgggtaccagcgttgaaatccaatgtgaatgagagagttaagtttaatggaaagatctattataaactatattatggcaaacttctaagtccaatactaaaattctaatatataccagaataattcgttttagtaataattctatgccatcctcagacctaacctataatcttccatttcttattgtcttccttttgtttttatgtacccttttttgctagttattgtagttagattttgatataactgaaatagtggcattcagttaataaagctcttttccctgaaaattaatacaaaatagtggtactattatttgtataaatagttatttagtattatctattacactctttttgattactttgaagttgttcaaaaactggatcccagccaggcacagtggctcatgcctgtaattccagcactttgtgaagccagggcaggaggattgcttgagcccaggagttacagaccagcctgggtaacatagtgagaccttttctctactaataataatgaaaaaaactctccaagctccccaaccccaaccaaaactggacctgcgtaggctgttatttttggagaggagtgactagaggagatgaggaaataactttgctcctatagtcaaaattatattttaattaaaatgctttagttaatatactcggttttctacaaccaggggtcagcaaactactggctatgttcacagtctgcttttacaaacaaggttgtattggaacacatctgtgcccattcatttgtatatcatctctggctggcttcacactgcaatggtagggttgaatacttgcaataaagaccatgtaacctgcaaagctgacagtatctattctcaggccctttacagaaaaggttaaagcacttttaaagcttaaagctgatcattgatttgaagcttaaatcagaagagaagttattaaacaataatagaattatgttgagatgtagtaaagactaagaaacaaatatttattacattaagtcccaaaacaaatgtgggtaaaattattagatatttaggttttgtagaacctaagtaatcattccccctatagccatattacctttggaccacttcagtagtctattgaggtagaccgcttccattctgttctggcagaacaaattttctactcataaatgcataggattttcttttgtcccttcttgaagttccataaattatatatgagcatagattttgtttataactttaggtaacagagccttggcagcttcttctggcctgccagcatccataatcttcctctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattgaggagcatagaaaataaaaaaaaaaaacctaattgaacttcaactctaaagattcaaatataaggctgaatcttggatgtttcagataccactagccaatgaacaggaaattatgttcctcactgaattttaatataaatttgtaaaccatattttgaagataaaaatctaagttgattaacaaagcccgattgtgtagaaactgctctaatttagtaatattagtttggagttatagaaaacacattggctttggagtcagctgaatctgcatttgaaccctagttcagtcattctctagcatttgaaatgagagaaaactacctaaacttttgagcttctcacccattggggataataatacctgtgttatgtggttgctgtgaggattaattgtaaacatagagttcccagcactgtgtcaggcacatagtacttagtacatgtggggattagcaaatatgggttcttttccactctttgtttttcttccccaagagtaggaaatagctggtagacccagttaatcaagataattagtattgttgatgaactgaattcacaacttgacagttccagtaacaaatagctaatgataaatgggttgtgaattgtgggagaatttacaaccacagcatcaacaaaaacaaaagtactgggggaaatatgctggaatggcgatgcttatgatttcagtgggaagtggggtagtctttgactcaccgcagtctagatttgtttccagagacccctgcaaatcccatggtatgttcttggggatcaggagttctgatgtttttttcattttgatgataatatttttaaattgctttaccatttaaagtgataaaatttttcttttgccataatcatcttcattgaactttttttcattgaactttttttttctaagttggtgtttcaaatctgaaaacatatacttggggatcattatacatattgttttgctttaggtatttttggaagccattggtttttactgttctgacttttcagaaaggagagcataatgagaatgtagtagtacaagcatgaataaaacataaacttagatgtggcttttgtcataaaaccgtggtgttccactcttgtgaaatcaaactggaccagatgagtgtaaaaaatggaaatcagtagttgatgctaagaacattttggaaaaatatattttattttaaaagttaaaatagtaagaggaagtattttgctaatattgtgaaattcacacatattaagtaaagatctttgccaaatgtcctgctcattttataattggcatttccagcagaatttttttaacttgagaatgacatgactattgcttttgctcacctgtctttttctgttttcatccgtgcataaagtcactcctctttctgttctgactttttgctgtccatagacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagaggtgagtgcgtgctctttagattttgaaattgtaatactttgaaattgtagaagaatgtttttccaaggaaaatttaaacacttcctttctcactttcaaggctacaataaatgtagaatattttcttgaaacacataaaaatattcttttaaagcaattgtgttcttaagttgtgttttatcttaaaatgtttatgatcttgaattcttttcaaaagaacactgcagtctgacaaactttatgattttgggcaacaggcttaatgcctctttacctcagcttccttatccctaaaatggaaataatagtagtacccaccttctacagttttaatgagttttaagtgaaaccatccatagctcttgccataacataagtgatcagtagttgttagctattatcttaaaattaaattcttcaaagaataacttattttctgctcaaattttctctcctaattttaaagagcatcatacgtcccctgccagttttcagagttgtgaaaatctcccttggccacttgctctgattctgaagttctgctcaagccagtcttgactttctcccttgggtcggagtcatgagcctgtgattgcctacacctgcgtgttattaggtctcacacttcttcatatagccctgcaagctgcatagcatagtgtcatgttgagatctagagcaccttctgtcaatccaccttgaaggaaacttctgggaagaggacacagacctaaataaatagaagagcagttgaaggtcttcatgatgtcttcctccctctgtcagtcttcatagttttatatagatttgcttaacctatgaatttggctggacattgacttaatcagacaccagctaacataatacattgataatttttaattgactcaataccaaccctctactgtgtgcaaagcaccaaagaaacacggactggctgattttcagaactgaaaggaatttaacagataatcttgtttcactcccaggaagtgctagggaagttcagtgacttgaccaaaattacacagctttcaaagggtagagcaattaattcctgctgtaaacagtccaggctggaatgactgagaaagaagaaattgaagtttgaaagatggataaattagacttagcagaaagttgagggagtttatttcagatataatattaacacaatagtactttggcagataacctttgaaatggaaatgtttaattattcttaccacactctagttgctagacagccagcattggctaggataaaggatatagccctcctcagggagttggtttgtagcacagtctgggaaacaatcggtgctctcatttcaaggacagagtgaaatgaacagaaatgaaccaaaggtgatgatgaggaagctgagattgcttctatgttttccctgaatcctgtccttactatgttggctttatcattttgtttggtaaattttgaatttctgcaatggaagtcatacacatattggactcttttttaaaaaacattatggttcacctccagcctgggcgacagagcgagactctgtctcaacaacaacaacaaaaaaattctggttcacttgatggtgccaccaaaagttccacaggcttccttcattctttttcattcattcttctttttgcccttctgactgaataacttcaaatgacctctcttgaatttgctgattctttggcttaagtctgctgttaatgctttccattgagtttttcagttcagttattctttcattccagaatttttacttggctctatttttgtggttatctctttgttgatgtttacattttgctcatgcatagttttcttattttatttagttgtctgtctgtgttttcttataacccactaaatttcattatattgaattttttgtcaggtaattcattgttcttcatttctttagggctggttactgtagatttatttatttatttatttatttggttgtatcatatttccctgatttttcgtgtcccttgtagctttgcattggtgcctgcacacttgagtatgcagtcacctctttgcttcttttcagactggttttcacaggaaaagacattcaccaattggctcagctagagattttgagagcctctcaaacattttctatggatgtgcatgttccattcctctcttttcctgctgagggagaagtttctgggtggtgtgccttctcctgatcctgaagagccatacaggctgctataaacttcccttctctttttcctaggaaaatgtactgaaagactaggatgcaataccaaattaaaattgtatataaaaaatttagtagtctatgttgtttgttcatgagtttgtaagaataagcattaagatttgactacagtgtcatgtaacagagagggcaagactataggagatggaagaggtatgtttggcattagtaactaaaactcctctccaactgagatattatcgttatggcagtaaatgttccagtgttgaatacatttgagctgtgtagtcctcaatctagatgacttcaaacatctgcttatctttgataaatacttgttatgtttttttactgattatttgttaagtttatagatttaatgcttagactgctatttagtgtcagttgtattaataatacaaaagaagatatttaaaatagcatttgacatcacaatttttgttttagataatcagaattaacttcctggttatatttttattagtgaacaggcaagtataaaaatgtattatccttagaaaatgtaacatgagagaggtcgttctcaagtaatggaatactagagctttaaaaagtcttcttgatcatctaatgcaaacttatcatttctattttaagaaatagagacacataaatttagatctcttgcttaaagcaaaagataactggagaaatggaaaactctctgcatttcattcacaacccattgctcttcataatataatattgtttgctcttttttcatgggtattgtttcccaataattctgtaagctccttcaggcatactgtcttgaaggagcttttaatggagccacagtcaaagcaaatcagaaaccacttactgaattgaaataattgaattggatatgcttacataaatgataagatcccaaatcaagtacctagtaagagtaggatttgaagagaatcacgaggtctgtagatgtgttctagaatattaggttgaaagaagaaaaagaaacagtattacaatttatcttatgaattaaaatattattggtctagaaaaacgttaagcactgtaggaaaattaaaaagccaatgaaaatagtgacttatccataaaccacaccaatgatatttttattaaaattcacattgttgacagcaatgttgcatcaaatagcagtttttcctgaagtattcatatatggtatatttgtggcaaaagtacttgttttaataatttaatcagatctattctttatgagccaaaagataattgtttagtcaagagaaacaaacttgagagcactacaaactatttgcattggggaacaagtgtcccctctgtgaatcagaaagtccacaatctacaatacttcaggttccagtgattgtacaaataagaggatctgttcccccaaaattcaaaataaaggctttcccaaatagtagggtgttttagtgatagacaactaaaagatttacaaaagactgctacacaatgtttacatatattgaactgtaaggaatgaatttggaaggaaatattggatttagttctaaaatctgaaaccaaaaattaatatatagaattgttggggtatggagcagtcctgaagtggttgattttatgttatgaggccctgaggttggctgtgtgtgacagatctcacttatagttgaatcctgcttataattttattgtggactcatattatctcagggtcaggatatatcacaggaagtacagcaccaaggtaggaaactcgatgcaccagcagcctctaccaataaatattctgcctggaaaacatgtgagttctgtctcttatgggttttgttttgaatttacaaaaattttccagaagagcaatggtataagatgaatgtcaatttccataaaagcctattcactcataatattggtcaagtatgctactaatgctttgcacggactttattcctttttttctttaggaaaataagttttgattcaaaatggaaagccaaacatacatttgctccaccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcattgaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgaaagagcaaaactctatatccaaaaaaaaaaaaaaaaagaagttcctggttcaagaagcaattaatatatatataaacaaatataattgaaatagtttacattggaaacaacctaaatttgtttgtaaacaagctaagagagtaacacctctatatctggctttatcacttcacagataaaattttatagattaagccttcaagactttgaatagctggcaggtggacatcattcattcattcattcattcattcattcaataaatatgtattgaacatctcctatggataggtaccattgtaggttttggatggaggggtaagcaaaaccgacactctctgcccttttggagcttctgttgtaatggaagagacagattatgaaaaatttacaaagttggcgagcaaatgctatgaagaaaaactgagagctcaggcacaaaggcagcaacccttattttattaaagacttcttttttcatatgaatgtattttgcaggaacaaataattcatagccactcatgctttcatggatttgtatccacattgatactctgttaactggagtaactttctactgtaccaagtagatggttcttgaaatatttaaacatttcaagcaccctggctgatttacttcatgtatagtgtcactaatttaatgttaccttcctttttccttgatgagaaagatgtctaggaaatatgcccatagtttctttcttgaacatgtttctcaactgccctttgcctttacatagctcaccaagcccgactcagaatctgccctctgggtgcgtcttccaccagcttttctttcatcctgtggcagatagtatcctttctctctatatctgaacagtctgaaaaattgttccacattgtaaatttaaattctctttaattttttttcagcaattgtgttttctttcaatacatttttaaattttctttctaagctttgtatgtgtatatttaaaactaaaagcccttttcataactcatgtcattaaaacagaaccttgatctattttggtttactccagtacctcacttgactggtggaaactctacaagagatataaatagtttttaaggaaaaaggaatttcttaacttgggacagcaaaaaatttttcactttcctctggggaaactatagaaagaatcaatggttctatatatataatatatagttttatatatatctctatatatacacacatatatagtgagagggaggtacatacatagatacatatgatttttacatggaatatataaaaatggacaacactgcttatcaatgctctactttccacttatttattagagacaatcagctgttaagataaattaatagctactcaacatgtatttattaagtataaaagcttacatacaaatgtcttgcaaaataaggaaactcatgaaattctcagaaatcaataaaagaaaataaaaccataagtatttgatgaggattattagttcaaagaaaggaaatcagtgtaagccaaggtaaacccaaggctcatttcaaataaatgatcaactaactttggtgacagattggatttaagagatcaaaaaaggaagagacagagataactccagagtttgctagacaagaagatgatatgaatgtatagttaagggcagagagtcactggggcagctgggtgtggagtttgtgaaaggaacagaaatttgcttggcttggtccatgctgagattgaagtattggccgcccgtccagagggatttcctgactcagaggaagtgatgcccatggaatcctatattgcagaagacctaacactaccaaactgaaatcttctgtttgggttcacactcagctcaactattctgtggctgtcagtgagaccaccaccaaaggctaaacctgtgggccacaacacatatccaatctcagattagtctcagcacattgcttcctctccagtttgaaaaacacatagaaaatcacttccagtttccaaagtgaaaattcataacatttatcattcaagcaattgtataatgtgctttattctcgaaaataaatcttcaggatgcatttttaaatatataattccaaacaaattattatataagggaatgtttaaaacatttcttttgaactttcagtttgaacggctgaatgttgcacttcagagaacattggcaaagcacaaaataaaagaaagcaggtaagtcaaaccactttagttgtgtgaacctcttattacaatgactaatactgctactaatggccagcagttactgaatgtgtcagccctttattgaatcattgtggtatgtcagaaactggacttagtactttagctgatactaatttcaaagtaagtgcatctatttatcacattttataaatgattaaactcaggtttatatgaagtatttagaattttatagccgtttaaggaaaagacagagctggggttcgagcctgggtttttcagagccattattttaagcatgtagttataaactgctgctttaacaagctcctgtaaggccgattcttttgtactaattggtaacttctaaaatatttaacaacaggtaagtcatggatcccaaacaatcaagacttcctgcctgaaggatgctgccaaagttttgagcagggtcccagcaggtaccccatccccaacacacatctcaacaacatgttaatactttagtatctgcatcaggaggaggtagaaggatcaagtgcttaagaggagggggactcagggttccggggggtagcagctgtttattaatccttagggaagtgtttctgtattctcctaactagtttggttgcactgcagaacatcagtttgtttatactttttttctagtattctttgaaattttcctttaaagcatttctgaagaggcttaatataaagttactttttattttttattttttttttagaaacagggtctcactctgtcatccaggctgaatgcagtggtgtgatcatagctcactgctgcccagaactcctgggctcaggccatccttctgcctcagcctcccaaaaaactgagattaagggcatggacctaaagttacttttttaaaatttatttttatttttttgagacagggtcttgctctgtcgcctaggctggagtgcagtgcaatcttggctcactacaacctctgcctccctggctcaagccattttcccacatcaacctctcgagcagctgggactacaggcatgtgccaccatgctcacctaatttttgttttggtttttgttttgtagagatggggtttcaccgtgttgctcaggctggtctcaaactcatgagctcaagcattcacccgcgttggcctccaaaactgctaggattacaggcatgcgccactgcgccttgtctctaaagttacattttttaaatctgatttatttagtgaatcaaatacaatttagcacatttactgctgacagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagctaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgtgtctgacagaagctttgtttacacgagtaacatgagaagcattccagaacacctctgaccttaataaccagtcaagctgataagatagtcttaagtctctcactgtgctactgtgtctgtctgcttaagtccttggcagccagtttactcaaaatttattctcagggctttgtgttctgaatcgttcctacagcttcttgcaatactcagttatgatgtgtttccagcagtgtgcctcttaaaataatctcaaaacttaagccaacaataattatttttttgaaattttgaaatttttgtttaccacttccctgatgtccctaaatataaaaaaaagaaatctgattatacttttaaattttcttgatgagaactattcagttgttgaaacaagatttttgctcataagcctgcctgctgatatgttaagtggttcctctgtgcttttttagttttggggtatcctcttgtttaaagattttttacttcactttcttattggtaagtcactgccatttttattgctgtcagtttgccaactgctgaacacaacttaactcttttttgtgctgcttattctcttctacgaattgacaaacaaaaatccaatatatcaaccaataaactgcccttgaatgaaggactagagctgcccccctcctcttttttttttttcagtgaatgagtgttagtatagccatcatgtccctcaggattggttgcccagagagttcttgcttagtttctttttctgggatcttttgatcacatcattatatgtatgaactcatgctggtgtgtgtgtgtgtgtgtgtatttgtataaggcacacatgtgttggctggtgcatgtgcaatgcttacacccacttgcattttttgaaggtgagggtaggaattgtagtttgaattgcactatgtgctgtttggacaaactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattatagtctcaatttctatgctgtaaaacaagtgcagtaattgcatgaagaataggtttctttcattactaattttttatacaaaatcaaggattaaagtttaatataatgatatctgagagataaacacagccttaaactaagaagcaaaagattctatgtatttgctttaggaaaatatataatattacttaaaagtgaattctatctgtatgtaggtttttcttggttatcagaattaccatcctcttcttggccacttcacatttgaggttgctagccagggaaggttctcctgagtacagagtctccttgacctacagtggagttacgtccagataaacccatcgtaacttgaaaacaccctaagtggaaaatgcatttaacacgcttaacctactgaatagcttagccttgcctaccttacatgtcctcagcaacttaaagtagcatagagttaggcaaaatcatctggcaacacagtgcactgtagagtaccggttgtttaccctcacaatttcatggccacatgagagctgtggctcactgccactgcccagcatcacatgagagcattgtactccatacctgtagcatgggagaaaatcaaaattcaaactttgaagtacagtttccactgaatacttacagcttttgcaccgatataaaggtaaaaaaaaaaaaaatcctaagtctgagactgtctgtattagtctatgtaaagttcactttaaaggtaaatatttcttatgaagaataacaaaacattctatgtcatatatattttggggttttccaacattgttctggatggtatatgtcattgctcctttctcataaaattgatagtcaagatttgcttctacagaaaagggaatttaaactattttctttctttctttctttcttttttttttttttgagacagtttccctgtgttggccaggctagagtgcagtggtggctgatctcggctcactgctacctctgccccgccaggtcccggttcaagtaattcttctgcctcagcctcccaagtagctgggattataggcacacgccaccatgcccagctaatttttgtatttttagcagagatggggtttcaccatattggccaggctgctcttgaactcctgaccttgtgatccacccacctcggcctcccaaagtgctgggattacaggcgtgagccgctgtgcctggcctaatttaaactattttctatcattgtttctgtatattataatctgaacttttagcatgtatttataagtttataacttaaaatattgaaatatttccaggaaatctttggaaagagaagactttgaaaaaacaattgcagagcaagcagttgcagcaggtaatagaattgtttatgtaattagaaagtatgccatatacctgtagaactcacattttctccaaaaatattcatatttatttgttggtgactcccagtatgaagtgttcaatattatgtattctgttaacgtaaagagtaactctttttgatactatatgtttttgtttgacctaaaacattttctctgtttatgtttacttgctgaggagtagataaggctagatgggaagctgtctcacagatattcacaggctttgatcttgaacctaactaactgttcctcatttatacatcaaaaattctactcaacaaggtaaaataaagaatgcttttaaaggttaggagcagtcatgggaaaaaagttaacagtattctcacattaatgattagtttgagagaaaaaattgatatgtgactttgtcttgctgtcctttccaaagtttcagtacatgaaccacgaggttgcatctttctaaaagtataagatattgataataataataatgactaacgtatattgaggcccccctaggagcaaggccctattctgaatataagccccacaacagtgctatgaagagggcactattctttttcccacattacagataagaaaaaatgtggtactcagagtgtaaagattaaaggagattatagaaagggaagatcatacagagcacccttgacataactaactccatctttaaaaaagactccattttgtattttgtagggcattttgccaacaaaaatagcatgttttatttaataaacaaatttaaaaaaatgaaaactacatacaacaagataaaaacacaaacacacttttccactatcagttctcaccagaggactctgtaactataaaaaattaaaccttcaacaactcaaaacggtcgtcctaactgacaccttcttacattcactcgtgataaaaactggacatctgccaccaaaggctctgccatctcaaagagtctttcttataagacggcctgacccaaaccaagactccttttgtcttcttcaccatacccaccctcctttgttaattctttctcctatctctttttccttttgatgttaagtgttactttgttacaaaatatttaacctataacatttatattttctatattaattaagcatactattatgtatcgtttacaatactaactgatttgtggagtgacttgagcctgtgtgcctgcagctctaagaaacaagtaaacagaaagtactaaaaaaactgcctcttggcaaggcatggtggttcacgcctataatcccagcactttaggaggccgaggtgggcagatcacctgaggtcaggagttcaagaccagcctggccaacatggtgaaaacccgtctctactaaaagtacaaaaattaggcaggcatgctcgtgtgcacctgtagtcccagctactctggaggtgaggcataagaatcacctaaacctgggaggcagagcttacagtgagccgagatcgcaccactgcactccagcctgggcgacagagcgagactctgtctcaaagaagaaaaaaaaaattgcctccttaaaaacttcatgtaactcatggcttttatgataaaaaataatattaataaaagcctaacattgtaaaaagacacagacatacagaggcttatttctaaccttatagcactcgtgaaaatgctatagaaagtaaattatatactccaagcagacattcattcagctaacactaaacaacaagaatgcgatttgattcaggaaaaaatgctttgtaatcatttctagacaaaactgagtttcatgccagtaattttaaattaacttccgtgtctgacccttttgctgctggaaaccctcatagaggaagatcctcttcatgaggatggattgcttttgttgttaacagaaagattggaggacttttgccaaaatgtacttaatactggaattcaaattattcttttgtagttaggtttcagggagataaaaagttgtgtattatactcaaccggtcattcttttttaatgaactagtttgggatttttcttcagttactagaattttagaagctaacctaggtagataatttggatataggggtttcattttggttggaaatgttattagcagatataaagggagctaaatcagcaaataacgcaagttgaaaataggaataatggcacagctttaccaaggtggcatatttgatatggcagaacatgtattatgtgatttcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaattgtaaagctgtaataaactgaaaacaaaattctttctgcatttgtttgcttacttgattcattactccaaaaatatttattgaatgcagtctgccttttaatatctttatggaatgttttataatgaaatttgataaatgtttatataaaaatgttttcaattatcaaatagctgacttaggttgaataataagaggtattgttttacaacaaacaaaagtcacttgtttcttgtaggaggcaactaaatggatttttaatcaacatttaatagacatgaaaaaaacaaataatttatttgattaattgttaccgaatgtggaagttaaaacatattctgtcatctcatggtagagagctttggtaattatttagtctcaggaaagaaagtttgctaactcatagttgataatacaagcaaagctaagagagaagtttcacacatgtataactttaacagaagcaccatttgttccccaaaaggaaaacagctttattattgcttttctatcataaaaataataaaatatattgagatgtttaaaaaatgagtaatattgaaaggtgtttattgtagcaaaaaaatgaaaaactaattatatacattttttgtttaaaacaaaaaaatgctattttacaactgcttttatcatgaaacagtgtattttgtgcatcctcccatgtcattagatataggtctatttggctttcttggagtcttagtggtatcccatcatatggttgtgctctattttattttatttatttagactgcgtcttgctctgtcgcccaggctggagtgcagtggcgtgttctcagctcactgcaacctccaactccggggttcaagcagttctccccgcttcagcctctcgagtagctgggattacaggcttgcaccaccacatccggctaatttttgtattttttatacagacaaagtttcgccatgttggccaggctggtcttgaactcctgaccttgggtgatccatccgcctcgttctcctaagctctactttatttaactagtaccctactgaaggatatttgggttgcttttggctttttgctgcaagaacacacatgcacatctttgtccacacatgtgcaagtaaaccttcttgtggtccaggatgatcacttgaagccccatctctctcacgacagaaaaaaaaattaagataaaaatcttacctttggaggctttttcacttccatacctgccagatggagcaagtacttatgggagaagtggggaagagaagagaaacatgctaaaagagaaggaagccaaaaaaatagaacaaagaaaaaagtaagagggagggaagaaggaagaaagaaaggacacattttcctgactaccatattatacaaaaaatagaacttcagattaatcaagtgagaccattaagaagaatatagtagcaaaagcatcagcatgctgcttagtgagaaagccttgaagcaagagcgttttgcattgttcattgtaaatcttgatttctgtgtagagtatactctaatatactcttcaaacatctgcacgcattttagaactcatagaaaataggaactataagaaagcaaattgttccttttcagcaggtttaaacacaaagggtttattactgtatctacttccccttcttttgtctcagaaagatgtgggaaacttgaataaaccacaattggttatcctttccttcataggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtatggtgcattcattatgtgggtgttttccagccagcaatagctctgaatctgcccagaaacagagataattgttctgggaggactgccacactgtcctctcaaagaatgaggagagaatggagggaggatagggtgctcaaagaatggaggatggggtgtaggacctgtgaataggagaagtttaatagtgaatctgccacttcactgtggaaaccgagttgaattattaagtgtgagataattcaaagtatggcttatacaaggaaacattatcctttgtatctgtaagagtaaagacacatgaggattataaaaattgcctttaaatagattacttcaatatagagttaacatgatacttttcatggccagttaacagaaatcaaaatcacctacttaaggcatttttgcagcttggccaagggcagagacatttgaaaaagaaagacctatcttcaaatcttgttctctgccttacttgctttgtaaactgaccaagttaaaaaacctttctcatcacttctaagacagagaaaataatattcactcacagagtttatatgcatgaataacacacattatctcccataatcttcatgaacaggattgttataaagattatgttaggtaatacatgatattcatcagtcatacaggatgagccaggcatcattgtaggcactggggatacagcagtgaccatccctgataccttttctttttaaacgtaactactattagtaagagagctaatgaagagatttcaagttctgcctgcttctttagaattaaaagtttttactgatttaaattactttgctttcttttagacattggcactaagaataaagcgtatttctcatttgtatggcttgaatcatcttctgaacttgccacataacaatctgacatttcagagctgaacccaacaggaaataaataaattattgtggaagaaacgaatattattcatgataatacataagctcttgtcttgttttattctagatgccagaagtaaaaccttacttttaaaaattcctaacaggaaagtccaaacagagccatgattcccttggggaaaaagaggtccatgtatacttacagaaaaaataattggcttcagttacgttaagtttgatggcctcttgtggaatttactatatttatttgtagccattttctatcttgagacggtctcctgtcttagaattgtgagaaggaagtctctcttccttgcaaactgctgtaattgctaacagaagtagccctcttctacttttggttatttctatcaaggatatagggtatagtttttaagtatcctgacaagcattttgaaactatgctcctcactgtaaggtataaggacaacagccacagagttccctgattaatctaactagagttgtaactagatagtaaattaccttctatgccagccctcatttctacttttttttcacttctgattttgcttgagattacttcgagatagctgaaaataaatatagaagggtttcagatacacaaaatgtataatcgtagcctaccctatgagtgccaatggctttgaaagaatagtcagcgttatttattccaagactggattatactagggctttatttaattttattttctctctgtctttcttgggtttttggccatttttctgtttctctctgtgttcatttacccattgtttcagcgaatatgtactggttatccagcatttgccagcatgggtgcgcagtggctacagagctagagggtacaatccctgtgaggaaagttcacatatggagagggagaagagggcacaatggaccaatgccagatttccatatgacgtgacgaagggatgcagtatgcacaaagggctgcaaaagcagatatggtaggcccctaacatcaggtaggggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagacaaactcaaagggcttacatatgattaggggaaacaaagacaataaacaaatgagtaaatttatagtatttaagtcagtataataatgtgaaagaaaaataaagtaggttaaggggaagaagaagggcagtgggtaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatggaaggcagtgacattggaactaagtgagcaatatggagaataagaagataaagtcagagattaggagaaagacaggtaaagaagaaatctggagccataataagggtatcagcatctactctgaggggaatttctgaagatttgtgcctcctttcttttttcctttctcaccctcatcctttcacaattgaggctttgtgtaagaataatagggtcttatagttacaataaacatttggagaagaagaaaaatgaagctcttagaattagggggttatttctggactaaaattaactatctgctttttgcagccagcatcacagacagataaaaattgcctgtaacgacaacaataatgatgatgataatgataaggttaatacttagatttttgataatagcttgatttccagtggtctttcaaacaccaccgttgtttttacctgctggttcaacatcttggtttttataattgtgattagtatccattagatatgtaattgctatgaggaccccaagggtcctttagaagaaccgtttctctttactcttatgactattaatatcttggttttacattgcacaattttactgcattgatgtgacatttattgagtagtgacttgaggcaaaatactattttatgatgaggaggatataaaacgagtaaatgatcccaacatctttaaacaatttattataattcaaaaatatattgtttctacaaaaactatcttatatggtgaaaaaaaagagatgaaatgatatgatgagtcagtgtgcaaatctgggagtagaagtcaactgttactgtgttcataggactgtactgcctctcagtgcagtgcctcaatgtaatgggtctaaaccttgcgcatttcctgaaaaagaaagccatttctgggcgtatctgattaaccctgatcctccagaaggcctgagcaatgagaattctgctatatgacttaatttcttctatccgatgtaggctgtgattcttcctgagcatttatttatagtatggaaaatatattatgtctaggtggagaccattggcgatgcctattgtgtagctgggggattacacaaagagagtgatactcatgctgttcagatagcgctgatggccctgaagatgatggagctctctgatgaagttatgtctccccatggagaacctatcaaggtaaggcagatgatatattgtccaaaagatgtcacaagagcaaatgcgtatagttgattaccaaaaccatggtgtatcagttgggggttagttgagagagagagagaaagcaaaatctatatagagaacacaatcttctctaacttgtttacattggaagaaatttattatagggtattaaatggcttacagaatcattgagaggacagaagaacccatctataagttgggctttcaaaaaatgtttcccatagtatagggattttctattgtcaaagtaaaatggcttctaaaggcaaacttcagaacaactgcattttcaaaaatctggaagctgattccaaaactatcctaccaaagccacagtcaggaaactgccatgttcagaaagctgctgcctcttcaaaaccacatctactgtaataatcagcaagatggcaatcctgcatcatgacttacaaaatgagtgatgggaaaatggactctctactaagcatgctatagaaaacacaaaggcttccacaattgttcttgagttatagtggagattgtgcctgccgaatctcatgcaactgtgcatctgatttaccaagcctaactgcatttagaagctgcaagttagtttagaaaatgtagttttagttttccagcccctggaggagaggatattacatttgaatggatgttgactgttaattcaccaatattttccaaggcacgtgacatttcaaaatttctagatgagccagattccagactaatatctcaccacacatgaggaaataaagttaacatggtaggcattggtttaacagatagaatataagcagattacctttgtctcacagtgaatctgccccttaatttttataggacagtcctcagttgactaccttcagaaataagcctttgaggtattgtaaaatcttatccggtatgctataaaacatatagagaagaaagaagaaatttaaaaacaaaactatatttggagatttacccttaactctctttaaccttaatagaagccatatgtttaagccttcgtaactattttctaagtctattgtcatcccatttatatgtttctgtgcaacatacttttctaaatttaatggtataaaatcacaaacttttattatgcgtggattctgtgcatcaaaaatttggataagtcatagcaggaatacctcgtctgtgctctacaatctatgggacctcagctgggaataccgaaatgggtgagggtgcctggaatagctgggattgcaacgattgaagctggaggattcattccaagactgctgcttcacttacatgtcagattccttggtggggatggctgaaaggttgggttcagctgggattgttagcgttacatgtgatgccctaatatgtattttttatgaggtggttcatgtcccactgaacaagactggtggaagctgcatgacttagtcttggaagacacaccgcaacacttccactgcactctatcagccagagcaatcacaagtctgcccagaagagagagggctcagagcccaagaatcaataggaggagtgtaaaataatttgcaagtatgttttaaaagcatcacaatatctgactttttcagatttattttcgataattgcatttttttagaggaggactatatatttctttctctttctaatttgtttgagggggcttgtagcatcaatgtaaatgttaaaaatatctagactattaacaacattttaagtgattttcacacaaatacattttataattaagatgtgtatgtttggggtgggggaatttatggcatttttgttatttgcagaaatgtatttttagatttttctaagttggaagaattatttatagctagtttcaaagatagttacctgggtaatgatagattagtttaaaagacctataaagggaatcattaatcatacctttttatgcatactaacctgcagccctgggaaatatctgacgtccctaaaagataccggtgaaacatcacagaggcagagtggagagtatttttagtagggaaactttaacatgtatcagaaaggagcatattgtgacttaacatcgtctcatttaatccttataataacactttaaagaggcatctacactggcagacacgagcagtcaagtctcctatgtgtcagtatttggagtcatgtccatgtgacttcaaagcccaggctttttctgcttcttgccctgctacctcttggtatagaattgaagtgaaagaatagaaaatattttctttttttatttttcaaactctatgctttcctttagcacgtcacatgtgcaaatcattcatctattcatttattcccattgatttcctcactaacatccatccagtcaggcttagaaagcagcaggtgggttggtgacagagaccagtgggctgagtgtaaccgtgaaagtcagtaggtgacaagtgaacacggaagcaaacttctagtacccctcctttcctaagcctagaagcttatgatgagaaatgggctatgccacaagtggtctcaaatagaagatgcccttagtaggttcccattcaaacttttcccgggagccagaattctgcctttgcctttcattatttcacagggaagtctgttaccagtgaaaagagatatgctcagggcacgatgtgtgtcttaaacacgttgtgttttaaatcttgctgatgaatttgaaaagctctgtaagaaaatgttagggttgagagattcaaaactggagaaggggaggaaggcagcacggcatggaaggactaggagggacacttgccttgtctgcatcgtttcggtttttacgagcagaatatatttacattttaattatgaaacaagataaaaatgctatggtaaatttaatatataataagctggagtaactaagtataggaagaaaaactggtttaaccagaagagtgctcacagaaagcaaaaattcctcaatctaaatatgctgaagtcatagttgatatttatgagcagaagagctttattctatctatctatctatctatctatctatctatctatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaagccagactaccagttactagtagagcttgttagaatacaaagttcctgattcacagtctagtgcttttgtttgaaaattttgtagaactcatatgacatcttaaaagtaaatgagtctggaaagtttctagcagatatctgaaattagttattaaaactagacataactgaattcttctgatttctaaattatatccaagttactgagttcttggtcttcattcaaaacgcatacatctaatacaactttttaaaatggttgagtaaacaaagagtttgaaaataattaacatggtatcatcatcatttaaaatatctccactttagcttgttttgtagtagcagtaatttaagtgtttgtgaatcttttaagatcatcaagtaatcagacctttgaagattccattgttaaatatcctgctttggctaggcaaggtgacttacatttgtaatcctagcactttgggaagttgaggcaggaggatcacttgagcccaagagtttgagaatcagctgggcaacatagcaagaccttgtctctacaaaaaatttaaaacttatccaggtgtgatggtgcatgcctgtagttctagctactcaggaggctgagatgggaggatcatttgggcccaggggttcgaggttacagtgaactatgatggtaccgctgcactacagcctgagtgacagagcaagactctgtctctaaaaaataaataaaataaaacattctgtctcagtggctttccaaatcattggagacttccagaattcctaaaattttgccacaacacatcccagactgcctcttatatctaggcatggcacaaatctgatctttcatcagtatggatttttaatttcatgtatatagacattgtcatcgtcattggactcaagtaccttccactttctgcttcctctgtcattttctgcttaaatattacaatttcatttcctcagttgtaagtcattagaacagtgggatagtgtttggtataaagctattttgaggtaaaatgtctaaaagatatatttaatatccttagagctagcttcatttgcccttctttgtcagtgtttgggaaaatgattccaggagtccagaaattatgtctatctcacttgaatgagaggtggcagtttcacataaacagctcatatcccccttgctatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttattttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttacagggcacagaacccaacaagcctgcccttaattcagatgccagccacccttcaggacctaagtatgcatttagacgactgagctacaattttgggggttcccatgaacctctcaagttagataattatctaaaatgactcacaatacttagggaattgctatacttactattacagttttatttcgaaggatacaaatcagaaccaaccaaatgaagaaacagtttgggtaaggtttgggagggtcccaaatgcagagcttccatagaatcagaacttatctccctccagccacctcagtgggttcacaagccaggaagctccacctgattgagctttgagtttggtgtatggagtcttattgttttcattatgtaggcatgattcgttgaatcattggccatgtgattgaactcagtcaccacccccactctcctccccagaggttaggctagcacaaaaccccaaccttctatccacaagattgatttttctggggccctgcccccattctgagtcatctcattaatataaactcaaaagtgatccaagggcctcatggaaaacagatactcctataactcaaaaaatccaagagttttagaagctccctccctgcaatcaaggacaacagccagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatatatctttcatgtacattttgtctcattatattggaaactcttaagtaacaaaagagtttttcagatctatacagtagctaaattatactaagcaagttagctttcctattctcagagataactctttaatagcatcttctcccttcttcttctacatttatttatttatttatttatttatttatttatttatttatattttttgagactaagtcttgctctatggcccaggttggagtacagcagctcagtcttgcctcactgcaagctctgcctcccagtttcaagtgattctcctgcctcagcctcccaagtaggtgggattacaggcgcccgcctccacgtctggctaatttttgtatttttagtagatactgggttttgccgtgttggccaggctggtctcgaactcctgacctcaagtgatctgcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctgtaggttctctcagcagagctaccccagtactcatctcctccttctttgttcccattacattgggccagctcccctcctgcccctggttgatacagttttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaaccggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatctttcgcccatcctgtgattctctgcagagctacagactcatatatcctattccatatttccacttggatgactaattcacatattaaaatgaactggaccgaattagaatgagtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctcattatcctatttcatcttctcagttcacacctgtatctgaaattgtcttatgcagtatttatttatgtgttgattgcctgcctccctttttagaatgttagcttcctgtggtacacattccatattcccagctcctagatcagcgcgtgaaacacagaaggaaagcaagaagtatttactggttaactgttgactcctgggtatgaaaacaactcagtataacctgagaattggaaaaatccctggggttcattgtaatggtaattggcctatggtcctactgggtataataggtagggataagaatccatgccttgagataatatgattctactctctctgtaggcattaagaggaatcatcctattaagtaggagtcagttgcccatcctttcactgacacctgtgtttctctttcaatgttaagtgatgtgttatgtgtatatgtgcatactgaggaatcctaccttaaaacaaaactgctacatataaaaagcatattttcctttttcttctatattgattgtttttaacagtatgaaactaaactttttaaattcttgcattttgtatctcaaagtctggtggtcttgagtcatgttagggggcactgatattagctacttatttttcttcaaaatataattcaggatctcatgtatttcagcagaggaccacaacatgttgacatatatttctgacaacaggacaatgctcatgacttaagtcttagattcactgtattggcaatgttactagaaatgcacatataggtttttatagcatagatggtgttatcttttaaataaattttttattactgtggtaacacatgcccatttcagaaaatttacaaaattagtaaattataaagtaagtaataggaataagtcataatctcattacccagagatagtaactattaacatttctgtctttgtttcagttacgtttatatacacatgcatgaatgacattgaaattttaatttaatttatattgaacttcagctcatttgctgaagtcatttctactttttatagacaaatatgatatagcttttttccttttgtattgatttcaataatagtttactttctttttattctcgtatatgagatatttatgccttgcctaagggaaagcagtagttaatactgtcttatttaggcaaaatataaatacttaatgttaaatacttttaacaacattttaaattcctttctttcagagatacttcacttttcttccatatgctgggaaaacttaaaataatataaataaatttcaattaaacatccaatgctttgggaaatttagtcaacggtaggggcataattttagttttactcaaactatagtacaagaagcggctgctaaagaaggtgtacaagcacaaaatgcagttttctttggagagctttattgatgatacattaaattctggaatgatatttctttaataataaaataatctgtttaatattgaatgtagcttccatgatatatttctgaaatacaggtaaatttaggacacagaatacatacctataccaaaaaaaaacctgtatcttcaaatttccacttccaaattctaatcagtgattcagaatgtagcagtgtaatgacagttatacactcctgttttttaaacattgtcaggagttttactttaattttaggggataatattcgacattttgtttgcattcttgaagtaaggaaaactaatagagactagtagagactacattagatcagtgagtcagtggatccaggtctactacattagttccaggtcagtgggtcaatgttagaggattatgtggtgatccagggatcattagaaacaaaaatggcaagtggggaggatacatggatgctgtccagtttgtggggtaaacaggcctagaatctcttatttgtaggacaagtctgagcacattgtgctagagaagcaagaattgacttctgtaagaagaaggaacaaagtgaataaaggaatataggaaagataacagagaattggagcattgatgcagtaatttgcggaaaaatggtgtctggtgaagaaggtgtagagaaaaatgtccacctatgaggacatctgggctgttgctgccttttttgggtgttgctatcatcaagctttcatcgaaatggtttgtttttctaaatggtttttcttatatattctgattttttaaaaagacaatataatgaacatttcaaactccatagcattctaattatgtttgtctgttaagtgtctttaaaaagcatagaagttgtattcagaagacatgccttagagtcccacaaacagcacttaccagacgtgcaatctagagcaatgcccttaataaattcaaatgatgcactttaaagccacttctaaaggctgaatatatgtatataatacatttaaataggagattataattgtcattaccgtatttagtaggaaatgttgagttgctgtagatagaaaaaataatagataaatttttttaatcacctatagttttatacatttttatttattagactcttatagttgcatacatttttgtatttaatttttaaacatataaaaaaacaaagcaaacaagatgacactcatgtagccaatactaatatttaagtatcaacattttgccatatttctttcaggtttctgttttataaaaaaataaaatgtaaagtaaatagatattaatataataaaatataaatagaaactcttacatggtccctgttacacgctctgacacaatggatcctaagtgctttatagcttgtaggagctgagaatatgtactctctgcagacagtctcccaaatacagatgcatgttcagcagcttctccacaactcatcaataagatgtcacttctgctttccaggaaggaaaatgggtagagagaggcaggaatatcactttcatttaggtcctgccagatagaaaaataaagccagaggaaaatagattcccagtgaacatatccatatccttttaagacttgccttgaatccactcagtattatgtttctgagatagtttccttgataaaatgtaaatctagtcataaatctagattattcattttaactattgctaatggagtggtttgctggtaaaccagctttggaggatgaggtagagaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgctagagctatcagactttgaagcttatacttttaatactgtctaattctataccttttcattatgtattctcaaataatagtcactcaaaaatatttataaattcatgactaaggcatcattttcattagttttattgtttagcagattacatatttattgatgtactgatgaaaattaaactgtcattcttgagacagatttctattcagttggtttcttcaatacatagatgttgtcacagtaccaaaatctaattcaacatcatcattctatttaatgtagacatgacattacagactagtgagtagaagaccatggtctgtttgggtaaatataataaatgcttttctgtagaaattggttgagaacccacagccatgcaacatttttcatctatggcctgaatattaggttagagagaaggcttattaagttctcatttgatggaaagctagggaagcaaatggaaagagatgccaatagcttaatcagtaagattagaatttgaaataggtttagcataatgaacaagtagtaaaatagcaaacaatataatgtggtaaacagatgaatttcaggagaaaaaatattgctaataacaattagtaagtagagtggtgatatgtacaattaaatctcatttgagtcctactaatctagaattcataaaaattctattgaaagattcaaaagttgttctcacatcatttttgtcattgtaattttggttcactatttcttgcccatgattacgttttatgcccacaattagcataatatttacaaaattaatgaattgataaatggacatcttacctctttcaactcaggaaatcttaatactgttatggttatgtgtgaatactttgctactattaaatctttggattattttttcactactgcaaattgcactgttgtgtggatattatttttgcaaaaatattttataattttttccagtgtaagtgaaatacattaattgacacaattttcttgttgtgaattgattcttcattgtacttctgggaagatgtctgttaatctcgttagactttttctgtcactcacacctaaaatcactggtttataaatattctcagtaacattcagttagttatgttgtgttctttttttgagtggacaaacatttatgtcagtattatattttaatattttcagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttaattaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatattttcacagtgaagttaaatcatctgtgataggttccccagaccagcctacaaaggcccattaaatacagaataatttgtggatcttcaaagaggatgaacatacatttccatgacagagtccatacgaaattcacaatttagatgctaaaaaatttaaggaatatctttttttctctatcttatctgctttgaagcatagcgattagcgagaaacttttcagatccagaccactgatggtagccagagtagagaccctggagcatagattct

SEQ ID NO: 11871 - DNA, 29935 bp, Human
ggggcgctgaccctcatcccaggggtcaggcagaaggggccgatgggatgggtcaggtgctgcagagatgttcagtgggctggagacagaggggtcttggcatggagaacctaggagggatagtggcctgggcagtgcatctcagaggagcagtgagcttagagggcacatggtggtcgcttcagcaatggatgagtggtggagacagtaagtatataaattcttaagtgaagtttctggggcagaaaaggagggaaaatgaggccattagaagagtgtgggggccaggtgcagtggctcatgcctgtaatcccagcactttgggaggctgaggtgggtggatcacgaggtcaggagatcgagaccatcctggctaacacggtgaaaccccgtctctactaaaaatacaaaaaattagccgggcgtggtggcaggcacctgtagtcccagctactcaggaggctgaggcaggagaatggcctggatgcgggaggcagagcttgcagtgagcctagatcgcaccactgcactccagcctgggggacagagcaagactccgtctcaaaaaaaaaaaaaaaaaaaaaaaaaaaaaaaaaaaaagaagagtgtggggagtcaccttctctgcaagaagcttcctgggcctcccaaataaatccatccctcccctccccctccccctctcccattccatacattttggtgccattcactatataattcccagcagctgctttcatatctggggcatactcacaggggtcagtcaggagggcactgtcctaggactgggagcgggaggatgtgggggtctcccctttgagtttctgctatgatgtgattccaattgatgggccaacacacctctgataccttgtgttatgctgtgtactgcctcaaagtgaataatagcttgggatttagtttgtgtagtctaaggaaaatactttgtgttgaactagtcaggctgttttattgatggccattaaaaggccttgtgcttaggtcttacaagcttttcaaaggcccaaagaaatgattcagacaaaaaaaaaaattagactccaaaatactaaaagaaaactgcaaaaacaggtgaattaatggtgaaagatctgtaggacatagcagtaaggctaccacaacccagctttttgaggttgtcttaaattaatgtgatatggggtgtaggtatgttaacatgcttgataatggaagagtgaggatacctgcttcttaaacagggcctgctcatttttttctggcctctagtacatttctttctggcaaaactcaagctctgttttcacggagatgatgcactgagccatggcatccctaggtggtttgattcatttctgcaccccggtgtctagcaaagtgccacgtgcatgtgtttaatcaaaatagcttgtggttgtcaagctctttgtattcttccctccctccctgtgatttgatttcctgaaagtatcctttccccaaggattatggaacatacacttgttaaacactggacccattttcatgatcatttaaatgtcatgacctttctgacaccttgatatggtttggctctgtgtccccacccaaatctcatctaaattataatccccatgtgtccagggagggatctggtgggaggtgattagatcatgggggcagtttttcctatgctgttctcatgatagtgagtgaattctcatgagatctgatggtttaaaagtgtttggcacttccccccttgctctctctcctgctgtcatgtaagacgtgcctacttccacttccaccatgattgtaagtttcctgaggcttccccagccatgcggagctgtaagtcaattaaatcctctttcctttataaattacccagtctcagatatttctttatagcagcgtgaaaatagactaatacatgcctcttgagatcctcacagcaattggtgcctttagacctcttcattcacacttcactcatgtgttcttccttccccaggtagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatggtgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccattcaactgccagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaaggcttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctcctacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttcatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtagaaaaaccaattcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacatatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatagaatgttgcgcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgttctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattggaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatctatattactattttcttcttacttctgttatattaattatgttttttattttctgtatcttaccatattttgacattctggaagatgtttcatatctagggagagactgctccaccaggggctaagcagttcctaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatgttggccaggctggtctcaaactcctgacctcaggtgactcacccgcctcagccttgcaaagtgctgggattacaggcatgagccaccacgcctggccgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgtttattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatttgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaatgaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcttgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcagtaagtgatgcagctggacttgaatatgcttctcagactccccagataatgatcttatcacaaggctgtaaagcttttatatgtaatgtgaattgatgtatttaataatcaatgtgtttcttcgtagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatgaaacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaacttactatatgtaaggaacttttccagtcactttctaaaaatataacatttgctaaggtgaaaaaaatggagctcctttggcggtagattggggaaagttattggttattggttttcaatgcttctctctccctttatctaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacgacctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattgttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgtttttttttttttttttttttttgagatggagtctcgctctgtcacccaggctggagtgcagtggtgcgatctctgctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggctccttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggcgcatggagttatggacatgtacaattaaattaagtcaattgattcatttagttaaattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccacagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgggtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttgatgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttctcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgacccgggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttatcctgagaatctgttctttgtccagtccacagcttacctgcacatttgcacattcccaggcctcaacaaggtgaggagaccttctgcagagagttcttcctgttgtggggaagcaggtggggaggagctggaggaggggaggggagtggaggtcagaggctattggcttaacagtgagccctaactcccttcttctagctaaactctactccctctgctcatttgcttctaaaatggattaaaatgtgagccttgtcaataactgtttattaacttcttatcaatttactattaacttatcactttacctgtccaaaaaatgataaagggaatatttgtatagacttttacattttacaaagcgcttttattttttcctttgacccagaaggtgggcaaaattggtgaacttgctgtccaaaatgcatgctctaaagcttgttaactctgatggtcagagatgacacccagtcagtgcctccttcttacctcacagcaatgctaaggggcaggtgactctctcagtacctggggagaaggggcaggtggcaggttggcttagagtctgagtccagtatgagcactgcctccaccagctacctggagtgaaaccttaggcaaagtatttgagcctcaatttactcattatataggtataatatctaactcatagagttaagattaaaaagattaaatatattatgacaagcctagtgcttagcataaagcaggttctcagaaaatggttgctttgttagtagcaattctatgaattgcttatctgaagccctattagaatctgcaaatggaaggggtagagaggacttataaattagaaatgacaattgacactaaggacaaagtacacaatgtcaaactgaagttgtataaccacagaggccaggagccctgtccagcccacagcccctccactggcccccaacctgaaagaatgtttctcactggaagagttcagggagctttgcaccacattttggttatgataccagttaatgtgaaaaccattaggaaaatcagtgctaaccaccatttaaaactcacacgttttcctctctttatcagataaattttccccagtaaatgcaaaataggtttttagggagtctctggaattattttacaacaggaatgccgtctggtggaaaaagacctggaactaaattcctgcactgtcacagctttgaaaccacaacaaagcacctggttgtatggaacccccattttctcatgtgtaaaacaggacttcctatgttacaagatgtttatatgtaggaagtctctgtccagtatacgggatagaatctcaaaatatattttcttagttttatcacttgatgagtacagataaaacaaaaaacttactcatccaaaatgtatatttttcaaattctagggttttaggtgtgtgcgggggttggagagtgatataatgctggtgttaactttttaaaatgatcacagctgctacttaatcccattttagcaagtcaggatctggtttagcatttttaatatagtacgttccccaagtagtaattgaaggacttctaagtataaataccatgcaattataaaatcagagatttcctccagcttatttgtcaaaagaaaatcttttcgcctttgacgtgaggctctgggagtgtggtgaggttggcttagcgtgcagggcatagggagcgtagcaggtggggaagaatgtggattgggctggaagggaaaaattgttcctctgttactaaaataaaatacatgaatgaatcaccatcatggcaataattcataaaatggagtacacatgaaaaaatgtatgtgggaagacagaggaaagggataattttttgatgtgataacattcattttacaaccaaagattgtgtgtgtgtgtgtgggggggggcggggtgtttaaattttaaggagaggaagagttacaggaataggtggtactatttaaaatgagtattaatcattcaaaac

SEQ ID NO: 11872 - DNA, 10764 bp, Human
ttctttccttatagcattggccgagacctccacgacaatgctacacactgtgaagtagtgattgtgagctaagactgtcacttatagaaaaatcatgtattcctagaagaaggttttcatttcatcttagctagaggacatggagcacttcaggaaactatttcacaaaaatgtaaattagaaactgtgtctggtagccaataatccatttttaacagtggccctgtgctcatctaagcaacagaaattacttttgtataggagatggcccttccaggggagaaacagctcagttgtgatacacttgtcttcatcctgactttaagtacatttaactccacactaaacccttgtggccacaacacagctctgcacctgtcatttgctctagacaaactgctaaacgcaattgtttctgacaatggattactctgtatcccgtgggggaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctgagagtccctcctgcccaccctgtgttctccatactgaataaggacttggccacaccttgtcaactcttccctctgctctactcctgacccctggatccatccttcatgctgtggctgaagggatccccccatcatgcaaattctgccacatctcccgcctaaaacccaggaagactccccactactctcagcacagaaagtacactccttagtatggcatcccctgccctcatggcatggccccatccagccctccagcctcacaccctgcaaggacacctagacccccacctccctcaacccttcatgactgcgcttctgatccctgtttcccctggctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgccttgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagtgagtactcagcccgccaggtctttggctcgctcgggtgcggaggggcggctgcttgggaagagtgggtagaaactcaagtctgcctaaggagagactggaacagcagcagccgtctcctgcaaagaggaataagaataggggtctcaccgtgtgctaaatagggcatgtctcttttcatctcgaaacagcctgatgagctatcattatgcccacttcgtagaggagaaactgaggcccagcgtgggagatttcctgctttcctgcctagggtccctcagctacaaacagaaggcagatcctagccagttctaaagtcaggcttggccgggtgcaatggctcacgcctgtaatcccagcactttgggaggccaaggcggacagatctcctgaggtcaggagttcaagaccagcctgaccaacatggtgaaaccccgtctctactaacaaatacacaaattagccgagtgtggtggtgggtgcctgtaatcccatctactcgggagtctaaggcagggaaaattgcttgaactcggaggtggaggttgcagtgagccgaaatcgtgccactgcactccagtctgggccacagagtgagactccgtcttaaaaaaacaaaaaaagtcaggctttctcactccactgtttttaaaacactgggtcccaagtctgactcagccacttcaccacctggtctgggtttccctgatcaaaaacatgtaggctttctctgggtgagtgttgggttcaacacccttgtccaagctcatctctagaccctcacagggagctggcttctagccctagaatagagtggcgctttgtaataactcgagtcatctctcaggtgttgaaggaaaagtgttggaaatgggttgagggaggtgggtgccaagcatgaatggatgggtgaaggtggccagaatggagggaaggtggtgcaggcaggccatccaggctgaagctcctccacctgctcctcttccttccaggcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggtgagcctttcctgtcctctccactgtggacctgcaccctccctgaggaaggggcctctgatcctcccctctggtacctgatggaactgcagagaaattgtggaagttcattagcagctgtcaacagcaggagagggaactttacaaatggcccaagtgttaaagagtcctagtgaaattgtgtctccagagaaagcaagagtagtaataaattataatgatgttggttttggctatgtctacactgagtaaagtggatatttgcagtgttcctgtagcctgccaacagagatagaattgtgtcaggtccacatggtttctctggcaccacaccactgatcaatcccggaaatagttacttgggtgcatactctgtgttggggggcaggggtacaaagatgaaatagccttgtccctcctgctgcccaccagcttctacttggtgacacagttccttcttggagcaacacatctcagggaggactatgacagtgcacatgcagccttcattttctagggaagagttacctaattttatttacagcttcgttcttttaggtttcatattttaatgtaaaaaacattgccgttaaaaactgctccagtagctactgctgcaaaggctaaaggctaatgttttaaaagatgtcctctgcctttctgctctctaggaattttttcttgagtattttctagcttgttgccttaggaatatcttaaaataagctcaatgccaccaagccttcttaaagggctcctttcccctttcaatctttcataatgtgctgtgcattgctcctcacaattcaattaatcttaattggacagggggctcaagtgaaaactgctttgtttcccgaagaaaggttcaaaatgggtaacttttaggtgctccaattcatatagatttttttgtgcaaaagctgacacccctactcccagatatagtcctaagggtcaaaagattatagaaatcaatttaatgttttgtacatcatttgtcaaatttgctgtagtagaaaacaaatgaggtagatgcaagtgattcaccggccatatccagggcacaggtttgtagaatttgggctatatgtttattttttagtttgatgccattcaaaaaccaaacatttcaattaagatttcaaaattctagcttctcttgaaaagatctgaagaacaacactggactcacacctccaaatctaactctttataacctgctcagaatagtggggttgcccaggtctgtttaaacacctccgggaatagtgtattcatttcctactgctgctgtcacaaatgtagtgggtttaaatgacacaaatttattatcttacagctctgggcatcagaagtccaaaatgggtcctactgggctaaagtcaatgtgtcagcagagctgtagccctttctggaggctcttggggagaatctgttgccttgctttgtcaggtctagaggctgcccacattccttgacttgtggccccttccattgtccataccagcaatgtctggttgagtctttctcatgctgctccctctggactgaccttctacccgcttctacttttgaggacactgcttacactggattcacccagataatccaggatcatctctctactcttagatcagctgattagcaaattgaatgtcatctgcaccttcattcctctttggcaggtcacatagctcattaccgggttccagggattgggaggtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccaactctaggaagctttgcttcccttcctgcccctcctcagaagcttcatgcccttctcaccatgtctcacctactgatgcctcctggtcatttgggcaattgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgcgtgtgtgcactgcaaattaaatctcagcttgtcttaagggtttgcatgtttgttatatccatcaaactgtgaccttaacagttccccctttagaagttatacttgaaataggtattcatagaatacagtcactttagcaaaagaagaaacaattttcaccagaagcaagtgtcacagtgaggtgtggaggctggttagcacaggctgttgacatgatttattgtgtttacataatgaaaaaatatgtaatccagagaaacatgccccaagcttagggagaggagggtgagagacagaatgtaaggaatctattttcttttgtattatgaagaaccagaatttcctgcaagtcaaagtgacagaggtcaagggcagccagccggagccttcctggcaccctggcttaccagccttgtggggtgccaggtgcattatcaatgttataaactgagtttctccttcattttttataggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaaaaattcacgtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaatgaaaagtttcagcctgtatgatgaattcatatcactgatgtctgattattttttcctctagaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggtaagacttcattctatcagtgagagcacctttttcatgctaaagataaccagccagggtctttgataaagagatataaaaagaggtctggaggccttttaaaggcctgacagacctacattttcaagaagacagccttgagggtgccgtctatagggagcacaaatgtgagcagatcacattatgaaaagcagactccaaagtattcactctgtggtatcccccacactcggcaaatgtttttgtgcattttcttatgtcagcctcaaaacaaccatatgggatctgcacaaaggagggaaccaaaccttaggagagttaaaccacttgtctgaggctctgcctcttaaaatccttcaagaggatttcactacacttaccttctcactcacctctaaaggctccaggacgtgctccaggatttgcatgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatcaccataacacagatgctaatataaaacaaatatttatataagtgagggtgactgctttggtgacgaggacatgggataaaaatatggtggcagaaatcattgtctgaaaagtaattgttttacttttattcttttcgtgtgtgtgtgtgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtcacttaacccctctgtgcctcagtttcctccagtataaaatggggtgactttattctagctttcttttagactttttgtgaggaagatatgaaagtatttattcatcaagggtgcaaatgtaaggttttatattctgttatcaaatcaaagtgctaaacttgggaaattcattgccaggtttatctgacacaaatggcatgtcttcagtaaacaggcctgttactgatagtgagttctgatcaatagcaatccatcacctccctgtgctaaacagaagtgggctttttaatgtaacatatataaaattaattagatattgcagcagatgtcattttaaaggaactgtttctttctaagacacaactcccactgatgattttttctaaatagttttaagggtcttttcagagctcattgaagatggatgtgcttggaaaatgagtatttcttttctcattctgcctggtgatctggctgagagtagatttggattgggtttaggagtggcataagggactgagttgcaggctctgagacatgtactggcttcactcatttttatgaatgaatatttgaattttggaataccatgtaagtcatgcttactgttcattctcctaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgattctgcaatttttctaatgtacttttaagtgttaaaatatacattgtgggaaaattgaaaactctgatgagacttcaacaaaattactctggaaagaatgccacaatattcttattcctttcctagtccctttcatctcattttaaagggaccctagtaagacaagatatgctttactactaaggcagccaagtgagtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctccatttgtttaaaactgtatagaacttttgcctgaaccacatggataattgccttactttggcttaagagatgtgctcttaatgagctaaatgttaaattccatctttttaattctctaaaccaggagtccccgatccccaggccatggagtggtactggtctgtggcctgttgggcagtgggccccacagcagtaggtgagtggcaggtgagcaagtattaccacctgagctccgcctcctgtcagatcagtggcagcattagattctcataggagtgtgaaccctattgtgaactacacatgcaagggatctaggctgcatgctccttataagaatctaagtaatgcctgataatacgaggtggaacagtttcatcccgaaactatctttgccccctgccccccgggtctgtggaaaaattgtcttccacaaaaccagcccctgctgcccaaaaggttgcggaccactgctgtaaatcatgtaaatcttaggtttcatgacttagttcattttgtactgctgtaacagaatatctgagactgggccatttgtaaagaacagtgatttatttttttactgctctggaggttgggaagttcgagaacaaggggccaacatctgatgatggcctttgtgccccatcatcatatggcggaaggtgagagagagagcaagggggtgctgaacgtgtccctttataaggaatccactcccatgataacagcattaatccattcatgagggcagagtcctcattgcctaatcacctcgtaaaggtcccacatctttatactgttacaatggcaattaaacctcaacgtgaggctgggtgcagtggctcactcctctaatcccagcactttgggaggccgaggtgggtggatcacctgatgtcgggagtttgagaccagcctagccaacatagtgaaaccccatctctattaaaaatacaaaaattagccaggtgtggtgacgaacatctgtaatcccagctactcgggaggctgaggcaggagaatctcttgaacccgggaggcagagcttgtagtgagccaagatcgcaccactgcactccagcctgggcaacagagcgagactccgtctcaaaaaaaaaaaaaaaaattcaatgtgagtttgggagggggacacaccacattcaaaccatagcaattcacctgacacaatacaatttaatgttaaggctttgataatccattcctccttaatagaaaaaggacctaaaatacaaaatattttgagtgacccctttcctcagttactcctcccaactgaatcccaatctttctccctgtaaatgtgttatctccttcccaggtcctc

SEQ ID NO: 11873 - DNA, 35122 bp, Human
attgcattgctatcctcagatgttgtctgtgctctttgagaggcttgggcctctcaaagctcctccaagttgcaacaattgctcaggactagaatccccaaatttcgcgtttttcagttctcaggtgagacctggacacaaatttttctgtctcccgatccaaggtcccatcactgagaaaatctttgcaaaacagtatttcccagagcaccctatattttgctttaaagtcagtccaggtcccctgacccccaccccgtaatggcaaaaggaatatcatggtctttatacctaatccaaaagcaactgctgccccaggacagagcccctcctcagggctcagcagatgattatagtgtgtgttatctggacctgagaactgcacagccaaagcctctcccaagaactaggcaattagggaattaagaactttctccacaatagtgttaagccctgaggtcaaacaacatatggtgcagtgcgtgagcacctaggcaagctgagtcccctaaggggacacagagctttcctgttagggcctgttgcagccacatttaacaatcaccccctctacagagagaagaggggcaatcaggaggcccactctggccggaccgctctgtgctctgtcccaggggagggtgcctgggcaacgggctgtgtgtacgctggtctccgaggcaagaggacccccaggccactgttagagactaagtttccctgtcactgtccttacaggagaggatggacttggtgccctccagtattagtgacaagcatttttctcattgcaacgtaataaaccagttttctggtcgtagacatcattcacctagcacttgtgctaggtgctagggcaccccacgtttgaccagctgtgtctgccctgagagagggggctggcagggggggtgttgaccccaaaaggctgggtaacggagaggggccagaaggaacaccaccgggtgagaagggccaccccgaacagaccggtcctcagaggcacctgccggccctccccagacagcagccctccctttcagcctgccctggcagctgcctttcctacggcttccacgaattaaagaacacactctggtcatcatctgtcctcaaggcaggtaggaatccaaaagggagagccgggaggtggcgcggaggacgccggctctgcccacgcctgggcaaggttgagctccgttccctccgggctgctcccgcctcctgtccgtgcagggcgcgtttccagccatcgccgcccagccgccgccgcacgccggggagagatcgtccggggtgagcagcgagcccggggacagctagcctgggtcctgtccctggacctactccccctgcagctggcggatcaggcccccggaccctcactccacggcgggaatcagagccgtcgggcgggggatgcagcgcccagactgtggctcccccgccttcccaaaggaatccccccatctgctccatccctctcgggaaacggcgaaatgctgccaaccgtccgcttagcgcaccgcggagcgactgagcagccccgccgaggctccgagccaagatttctgccctaatagtttctcccttctttctgtctgctccaccgcacccactaaatacgcggcgctcacacacggacacgcgtgacacgcggcgctcacacacaggcatgggacgctcacacgcgcgcgcgcgggtctccgtccctggcaccccgcagcaggggtgcagccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagagagagagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttcctcctccatttctcccccagctcgcgggttctggagggcaagatgacaccctcaggtgtccatcacctgggcagcaggctttcacagggaacctgctagactgggagccaggggggataaggaaaagcttagggcaggtccaagtttaggaaattggagatctccgtggctgcaggctgccctgtgcgttgggagcccagccataaacaccttcacttctggcactagaccagggctacctgggggtgccccagatctcccagcagtggtttgagaggcaacagtggccaggagtgggtggggtgtggaggacatttttcacctggtaggactcttccttcaaatgggagcagggagggccaggatggggggcggtgcccccctcagccttagatccccagcctaatcttgctttctcttttaagtgtggccaaactggaaacacggccttgtgatttctgcccccctcgctgcccaagtcacttcctgcgtacctccctatctccttttaaagagctttcaaatggttcagaaaggccaggggtcaagcctgtgaggacagaggatagggaacagagaaggccggccttgtcattgctccccttctcttcaagtcagtgcttctccctgcagagctgttggccccctggttttatctgtgccttccctcaaacagggctctccaaccccaggggctgtggagggcctcaggtccggaccccaaagttctagggcctaccctgaacatcagggtgagcaacaccagcccaaaacctgttccaggagccttttcaaacaccagaagaagatcaacaggaacacgccaagtattttactctgtttcaatccttttaataagctgagattatcatcctcattctacaggtgaaaaattgaagcccagagaggctgtgcaatttgcctcaggtgcacagctcataaagggagattctctcctatatctgactccaaaatgtgcctcgttttcatcaaaagccatatggtttatcgggctttctggttctcaaagcacttttccatgtgaggaaaaggctaatatttatgaaaccaaggtgccgagctatatacgtttacatgagttcatcttgacaccagtcctgtggggcagagcttatttcttctgttttatagatgagagtaagggtaacagaattccaggcactaagtggcagcagcactgctatctccaaaactcttgtcctctggctttaaatccagggtctttccactaacaaaagctaattctgaaagctgctcttgtctttccacatccctgcttttcctcaaagccaggtgtaaattgcatcatctggctgaatgaggcgctcaggcttcctggaatctgaggaacgaacagggcagagcaaatgatgtgggagttagaggcccatggttggactctggcataaagagtttggtcagcttggctggtattttaaactatctatggaccccacctgagatggcaccattctgcctagaggcataaggccttcagtgggaggcctggggcacagcgtatgtgcttcttggaagagcagcagcagggccaccattgaaagacaggaaacaacacatagagaaattgctggctcaggaggctgaggtaaggggattacttgagcccaggagttcaagaccaactggggcaacatagcaagaccccatctcaaaaaaaaaagaaataaaaaagaaaaagaaaggatagaaaatttgcctatacattccacaaagcacaaggattgtccccagaacaacgttctagacctactacctagctctccaacagaaagggaaccagccactcaggcatggctgttttctggcctctccaaaagctgctataaactgccggcattactcacaggcagcattttttaagtagcctgcctgtgctctatccagtgagcagttcagctaaaggaggagccaagggtgaggggggggtcaaagcgaacctgggccacattcactctgcccagggctgtccccaaagcttagctgtcttctctgggatgaagtcagatcttagtggggttccccaccatggcttccctggagtctgctggcaagtcctgagcagtgcagagctctttgtctgtgggtccagcagagacacgtgtgtggccctgtcacagcagtactcagcctcgctgtccctggtgccaagcaaaatccctttggggctttctgcaagcacctgactgggtttcttgtccaggaatttgggagactctgaaggctgctctagtcatccgtgatgaagtaaacccccaaggagggaagaaacgactagaatgcccattctctggtttccatttccccttcaaatgacctgattcttcctgcctgcggtgggcgaagccacaaacaggtgtcctgtgctttcatgtacttgaaaactgcatccacttctgcattgtttttttttttttcttgttcaacaaccattcatttggtcacctatcatgtgccagcaatcattaatttttgaaaaccttggaatgtgatcgttggggcagcgttatgctttttgtttaggagaatgttagcaaacactcacattttctgagccaatactgattgactatttaggctggaggtggaaggatggtggagagaaggcaggggtcagggaatccataggtagttcaaaggggccatttttggatgaaaatgttcactgtgtatgagctatagacaggtcattgagggctggcagtgtttccaagtgcggatctgtcatcagataactgttaagatagtcgtcagccacgaaggaatctttctgtgttttgtttttattttctaaagaaaaaaacaagaagaatgggagttccagttcaaaagattgtagtgaggtatttgagtaagaatacctgagtgtatttctcaaaaagacttgtgaagtggctttccctggaattgttttaaaacagagtggacagcttccacttctgacattctgccagccagggctggcgtgagcggctgcctctgaaggccctgcctgtgcagcagcagcttatctagttcctcctaccttgacattctgataagggagctattctagtcaacagggcccaggatggcgggaacccttgccaagagccgtgctaagttaaatggtagagccaaagctttaatatgtgaccctggagatcctggctagtgcttaaaatgttaacttccattatcgttccaggccagagcaagctgagggcaaaggtcatggatcatctgaacagttggcaggtggcaacggcacttcctggtcaccagggatcaatcaatagggtggccagatagtatgggggacaggaaagggtgagggtgggggagaaatggaggggttggggagggaaggagagagcaaacttggagtctcattctcatcccctgtgacttggcggtccggggctgggtgtactgctcaccctacaccttctcccagatttcaggcacccgactttacagtcagggaggtccaatgccatcatcctacattatttcctgctgctcagaaaggaaaatgggagtggggtgcagtgcaagaaccaagaggacctcagatgcctcctgggaccaaacctgtgtcttccccttagagtgtgcccccacccccccccaaccccagggatgactgcactgctgagcacttggtgcctggaaccctgggcagtgggaggtgctgcttctgcttcagcaagggggctgtccagcagtgccagcagaagccatgggtgtcaggccccaggaaccagcccactggacatcacagtatgaaggcttccccggccaagtcaggttgctttgtgaagtgtccttctccagaagaactccctcaaaaatgagtagggagctcctaacacaggccagaccttgtgtaggcacctgagctagacagggggatcttccacaccgggcctgcctgccctctgagctctcagaccactgcctgggggcgggcagagctgctggagagactccagcatccgtgctgcgcgcccttagggagaggcacaggcatcgccggggcgaaggcaggctgctcttatggagcagggaaggcttctaagggggcttgagaaacaggtttgctggtgaaggggtagaaggagcccagggaggggtttggaaaggagggagccaaggccagacacagggcagtaggagggaggcctgggcctgcggctgtcccagggcacctgcccccagccccaaccacctctcctgcatctctttcaatctcccctgactcctcctagacactcacgcttggtcacattttatttcctttctcttcctctccctctctctctttctcagtttggttctttttttcccctccatttttgtcttttttcactcattctcttgatcataaatgccgtttagtgtatttatgcttctttaactcaatctctttgtctgctgcagtcattctttatttttccactaaatgctttgattttgagatcattatagattcacatgcagtttcagaaataatgaacagagatctgccattcccttcatccagtttctctcagcggtaatattttgcaaaactgtagtacactatcaaaacgaatacatagccaataagaaaacaacatttccatcaccaggaggacctcttatgtggccctattatagccacacccacttccatcccaccccaccctctccttaacctctggcaaccactggtctgtgtttgtcatctcaagaatgttatgtaagtagaattatacagtatgtaatcttttgggattggcttttttcactcaacaaaattctctggggattcatttaggagtgtgcatgtgtgcttgttgggggtgtgtgtgtgtgtgtgtgtgtgtggtttttttattgctgagtagcgggaatgtaccacagtgggaatcgtccatagtgggaaggtaccattgcttgtttaaccattcacttactgaatgacatctgggatgttttcactttgggactattatgaataaagttgctataagcatttgtgtactggttcttgtgtgaacataggtatacaggttttcatgtctctgggataaatgcccagaagtgtaattgatgggtcatctggtagttgtatgtttagttttttttattttttttcgaagaactgtccagctgttttccattgtgactatgccactttacactcccaccaacactgtatcagtgatccagtttctctgcatctttgccaacatttgttattgtcactatttcttattttagccattctagtgctatcttattgggtttcattttgcatttccctgattactaataccgtttaccactttttttttttttttttttttttgagacagagtcttactctgtcactcaggctggagtgcagtggtgcaatctcggctcactgcaacctccgcctcctgagttcaagtgattctccggcctcagcctcccaagtaactgggactacaggtgcgtgccaccatgcctggctaatttttgtatttttagtagagacaaggtttcaccatgtttgccaggctggtctcgaactcctgacttcaggtgatctgcccacctcggcctcccaaaatgctgggattacaagcatgagccaccacgcctggcctgttgaccatctttttatatgcttatttgccccccatatatcctccttagcaaaatgtcttctcatgtcttttgcccattttctaatttgattggcttttgttgttgtttctgttgagttttgagaatttttaagtatatattttagataccagtcctttgtcagtcagatatgtaatttacaaatattttctcctactttgtaattttgccttttcatcttaacagagtctttttcagagcaagtgtttttaatttgatggaagtttaattgatcagtttgtcttcttatggattgtgcttttcttgtcaagtctaagaactctttgcctgccctagatcttgaagagtgtctcccatgtttttctctagaaagttttattgttttatatttaagttcatgatccattttgaattaactttggtataaagtctgagacttaggtcaaggttcttttttttgcctaaaaatgtgcaattgctccggcaccatttgttgtaaaggctgtctttcctccactgaattccttttgcacttttgtcaaaaataagttgggcatatttgcaaaggtctatttttgggttctctgttctgttccatcaatctatgtgtctatccttctgccaataccacatagtctggagtttcctcataactgcagttatgtaatgagtcttgaacttgtgtagactgattccttccactttattcttttccaaaattgttttatctattctagttgctttcccttttcacataagttttagaataattttatctatatctataaaaaatcttgtgagattttgatagaaattgcattgaatctgtatatgaattcagagagaatcaacgtttttactatattgagtcttccaatccatgaatacagtatgtttctccatttatttgctattcttcagtttctttctttggcattttgtaattgtcagcagttctttttgctctgccatgaactaattgtgtcgccttggacattagtctttcagaccttcagttctctttctgtaaaatgtgtctaataacacctaccttgaaatgccatgggaaagtcaaataagttagcgcatgagcagtgccccatggcaagcgccaagatgcagttcccttcagctgggtctctcatctgttctttgtttcctcctcctcagctttcgttctaatgcccacatccacttacacttcactttgtctttcctttttgtcctttgcttttttaaatccttctttcattctcaactccttactctgatttttctatttctttctttctttcttttttttagacagagtctcactctgtcacccaggctggagttcagtggcgcaatctcggctcactgccaacctctgctgtctgcgattctcataccttagcctcccgaatagctgggactacaggaactcaccaccacgcccagctcattttttttgtatttttagtagagatggagtttcaccatgttcgctacgctgttctcgaactcctgaccccaggtaatccgcctgccttggcctcccacagttctgggattacaggcgtgagccgccgtgcctggcctttcctatttctttcactttgtttttctcttattctcaatggatttttctgtttcatttcttatcccatgatatttgtctatctcctctttcttgaatcatttaagcattccatttttgtggagttgctcagacactgagtgtgagtcaagggccactcagcctgggttcaactccagatcaaccacttactagatttggggcagttgactcaccctcctgcacctcagttttctcatctataaaatggggagaacagtatctacctggtaccttttctgaaatgattaaatgagtttatacatgtaaagcatttggaataaaattgggtatacggtacagccccagtaggtgacgataattactgggattttacctgttatgtccagtttctgtggctctttctcacatttaccatccctcaccatctcatccttttcacttgtatatgaatatattcaaactcacattatcttgctttcaggctgttgtctctgtgcacttctacctcatcttccctaatcatcactgataaattggcaccagcccaggaaatctgtcccttgggttatagacaggaaacaagtggtttttcattttgatttaattattaatcccttttattatttaatgtggaatacatacactgtggggttacaatgaagaaaatggattatcactgtgcggctcactttcaaagagatggcaggcttaaaaaggaaaagtaccagacagacagaaacaaacgtggggaaaaagcaaaattaattaatttgatttccgtgcccttttcatggccatgacttttcatacatcttctgtgagatccaggaggatgcatgtggattttgcaagtaagccaagcgaggtattaaagggaaggggtgtaaggagtggcgagtggcccacagtggctcaccagggagggcagaaaaatattcatcctaagcaaatgggagcctggcaggttgggaaactcagtcacaagctcacgggcctgctccatacgtacagtcctcaataatgggcttggtctgtgatgcaaagctacctgaaaggcactcacctatcactaaccctttcgaatctatattccataccttgaatcgggcctaatatctgccctttaaaaaattgctgaatatatttagactcacttagatacactgggcagagggatattttaaataccatcaaaatggtctttttgtctctgtattttctccaaagaattgaactccccaagcaaaatgccagatctgcctgcgctcctttcagactagaattctgtctccctttaaagatccttacatgaaacaccatttaatccttctctctctgcctttttgtgtttatggtgacctctcagtattttggtttctttaatgacaaagtaaccatggaattagtccacagcatttctagggtacgtgtttctctccagatatcaaaaaataatgcatgaggttttattacttccttaggcttgtggtggggaatcctccaaggatggagttaaaatgaacagccaatactctctcgctcctctgggctacccgaggctctgcaggccccaaactcaccttctgttgccccattcggcaccagccacccccctttgttgtgcagccagaagccagggccgcctggcaggcctattgctaaatctcccagtgtttgtattacataaaacttcacagtcggtgtttctgtgtctacaatgccagaatcctggaaatgagttaacccaaatttgtgtgccttctggcaagcccaactatccaactacaaaaggggactaatgtgataggattctcctgagccaacacaggagttgaaagagcccaacagaggtgcaaactgccattatgattccatgataataattccacatactaggaataccgggattatttcagaccttatatctgctcttaacctataccaatccaatccaggggggccaagtacattataccagtatttggtaggatagaatttttcctgataaaatggcagagatgtcatgaacattaggatttccacaaatatttctatttcttatataggaaagagacccagggtggtaacctgtagagtaacatgtaatgtggagcataggatgtggccaggagagtcagggttatgattcagaaccaagatggctggactcaaatgggtgtgaagtaggagggtgggaaagcgtgggttctgaagtcaggccgctgtcagttcaaacccaggttctgctgcttgcaagccatgtggtctctggcaagttccctccctgctctgaatctcagtctcctgatctgaataatggacacattacacttattccacagtgttgctgagctgatcaagtgtgttaacacgtgtaaggcacccagtccagagtagtgcacgcaaacacacacacacacacttcacttccagagctgttctgcaaagaaaaaccaaaaggcagtacaagctgctgcaggcaatgaattgatgacgtgtttaaaacaaaagcaaaaagagtgcaaaggccatggagaatgcggcacagacaggaaagatgctccctaaagagcttgcccaggtcaggatgtctccgagcaaaacgagggacactgagtgactctgggagcaacctcagtcctgcatcctcgtcaacaccctgactgttctcaacaataatcccacccatgtggggagctcccctttgagggactgaggcagcccagaaaggaggcacaggatgtactgagaaggggaaacctgggcgtcagtgacagctccccagggatggtgggtctgagcaacgctgatgcagcggagcccctcacccacctgagatgcctcgtccgccttcccagcagctcccttccgcagagtgcttaacagcttggcaatcagagaacgctgtgtgcacggacagctccgcggggatgaagtgtcccatctgacaaagactgttctgagatccgcgctgtccctgcctggctctgcgtttcactgaaagccccttgccctgattctagccctcagcccccacgcacagccaccggcgactctagccaccctggatagtaaaggtgccctttctggggcattctgcttcgagaagaggcggaagagctgtgcatgcctggagcccctgggagcccatgacagccaggagcatcctgggcataaaaatcagcacctggggcctcattccactcatctcgcacacctctgcagtcccttccacgatgccctcaccgctggtaatcagcatccattacatcggcgccaggaaccagctcaggaggccacctgatccgccctcctgtccctccagccctcctctggaaggactcagcgcttgcagtcagacatctctccccattgagaccatttttactgttggtgaactggaggactatcgcactgcccaagacactgttctctgcagcaggtttgcacagggtgccagttagggaggagaaggcagcgaggaaccccgcactttaaggaacagggatgtcatagcagccgtctgcatgggggagggggctggggagcacagggctattggcaaggagacagggctagttaggaccaccggaaccaggctgatgggcactgagggggtagcccaggcggccctctctactatcatgggccttgcagattgagttctcctcttcctgccgggccgcctgcctttgttgtcctgaggactgacaggtaatgtttgtggcagacctgttggtgcaaacagggaggctgtgagaggaattcagtggcactaccacaactcttaacagcactctcagcctaactcacaacgcagcccaacatgtccatgggcagaaaaggcctctctccgactccctagcccagaaatacgaaccggcagctgacagactgaatctgactcacacatagattctctatggcttgctcactttttcaaaaattgttgaattagtggtcaacatggaaaaaaaatttcatcttcaaaagtttaatttctggcttttctggaaaaagcaaagggaggatcttgcagtactggctccacggcatggcaaggcaataatgaactagagccgagtagcagctgccgctttagaactgcgtgtgtgtacagctcaccacagtccccaccaccccctaccatgtcccccaaacccagggcaagttttggttgcatttatcatgggtttgtatatgtgcttttcctaaaataaagagaatgcaacattttaaatgtttctctacatcaaaatatgaaaatgaagctctaagacatcccatttaaataaaaataggagaaagcctactaattgcacgtgaccaagaaggatgtagagtgtgtctgtgttggaagaacgcgatccggcagctgcactcacctcacacagccacagccgtgggtgtagacggcagagctcagcacagactcacaggttctggttactatggcatgcacatcctgcccagctgagaaattccagagtgaggaggtgttaccctcactcctgacagaggcagacctgccttagacgaaggagaatccagtgaaggggtgttaagaatgaaatcagtggctgctagttagtggtcttgtttctactgcgggggccgttgtccaagcagaccttcagagagtgacggggcactcttggtgatgatgccagaatgacaggtgttacctgggatgcatggacatcttatttcctgggagcaatcagggacctctgggggcaagtattgtgcttagaaacaccgaggagcagctgttagatgagtagggagcatgctggaggggagcaggagggagagggagaacacagccctggctggcgggaagtgacccgagctgccgggcagcttgtgcacagcggaccacatggcaggaaatcatgagttccttccctggtgctccccccggggctcagaacaaccccatcacacccagagggctcaggaggaaccaacctcccaggcagcggtggctgcacttagagcctttggaatcagacaaaacctagcccgctgcttagtaactgtgtggcctgaagcaagctaccacatcactctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccctgttctcaggcccacaaggctctgccacctcaccctgctcactggacgccttcctcaccagggccttcctgactcttcctcgcccaccccagacaagccaaattcaggactgcaccctggcctctctctcactctctacggcactgatttttttgcctgtgtactccccaccagaccaggaactccttgcggacagagaacgcatcaagggtcgtcaatctcattacctgttggagtcacctggggccagattctgggactaggcatcagcacgttgtccagctcccagctgatggcagcgtgcgtccagggcggagaggtcgtgctactcaggtgtgcactgaggaccagccgcgtcaacatcactgcggcttcttagcaaaaccgcggactctggaaaccccagacctacagaatcagaacccgcattttagccagatccccaggaagggaaagcacaggaacgaatgccagtgaagtgtgagtcgacctccttctatccccagagctcaacataattcaaacacccagtgggtgttgagtgggggttcgctgactgactaattgactgagtgagtgaagccctgtgtcagcttccactgggatttcacacctactccatcatgtgctatgaaacaaacaggctcaaaaagcaaacccgtaaaacgttcagaaattcaaaaatagacacagacctaagttgatagaacaaatagctgcaaaatggtgcggtttttaaatgaaatacctgacgggtttttaaagatttattaccaccgggctctgtgccattaaacctccgagtacactagaggataattttgttttgttttaaggttggtaattgtgaaaagctgggaaaccaggactggcccctgggaggatcctgtccaccggtgtggcttgggcacagtctctgggtggctggggccgctggcccgcccttcctccaggaagagagacccgctggcggggagtccccggcactgccaacggcctccccacgcccgttccctggggacagggcctctgtctcccctccgcaggcccctcctggctctcaccctcccaccccgcatcccccagccccgcctcctccgcagccgcagagctgcagctggccagggggccacacccaggcgtcgagcaccgccttatccagccgcactgggggcttcgtcccctgcggggtgaggggtctcccctgtgtcaccctccgaggccacgctagacgttgtggcgctcagggctcccggttcctgccgcgctggggctcccccgtcccagcctccctccccacctctcccaggctcccctcccctgtcgcagccaccctcccccgtcccaacctcctccccttctctcgcacgatccggccaagagatggcggggtggcgggaggggcgctctggcgaccccggaagcgagaagcaggcctctgcagggccagggatgaaggtgcaagggaaagccctgggacctggaccttaggcgtgggagggacgaaagggaaaggtcttagaaaattcctcaggcgtggcttctgggggggcggggcggggggaggaaaggggcacgggttcccggtctcgtagacgctgcagcggagcagagcctctaggcatgccctcatctagagcagctgctgcggaatccggggagcctgcagcactagccgtgcgattccgggcgaggtttttaaactctcacctgttttccccttttgtaaactgaagataatgcctctctcccgggagtgggagcacgatgctgacacaccgtaggaactcgggacttgctgattctccttccttatcctcaaggcgtttgaagcactcctgcccctcacccccacccctccagcccctttcccagccctgccccctggtggaaaatcctaagagctacctctcaggagggctcctgtaaaccaggcactgtacacacacctttcatttcatcttcgcagcagctctttttggtgagtactgttatccccattttgcaaataaagcaacggaagcttagagaagtaacttttccaaatgtgcctcagctccaggcaaaataggaacctaggtcatctgatgccagagtcagccttcctaactgtttatgatccgacttccctttctgtactggattttctatttctgccataacagatgaccacagacatagtggctggaaacagcacccacttatcagctcacagttctgtaggtcagaagtccaggcttgatgcgactgtgtcctctgctctgttcccacaaggccaaaaccagggtgtcagcgaggccagcattctcatgtggaactcagggcccccttcaagctcctgtggttctggcagaattcaggtctttgtggttgtaggactgaggtcctcacttttttgctggctatcatctgggggctgctctcagctcccagaggtcacccacattccttgccgtgtggccccctccatctttaaaaccagcaaaggagaagccccctctgtctaattcctctaataatttgaatctcttacttcgggaaaagcccaatcccttcaaagggcttgtgattgggtcaagctcaccccagatgaactttctttcttcagttcagctctgccatatgacatgccccagtcatgggagtgaggatttcctggggttcctcagggggtgtataccagggggcaggaatcacgagggtgtgttggaattctgcctacttacaagtgccttctctgtccccagcatgtattctggtgttacattcaagtgtaacacctcgaatgcttcctgctaaccctaaagggccttgaggggactggggcagcctgttcaccaaccagtttggagcattttcctatgagtacagtcatatatattcccacagaagagtatacaaatatctccatatgagacataagcacgccctcctccattcctcttcctccaacttcatcccgtgtttcaaagctcagagagtggtacattttgatccagcatatcttagaaagtaggaaattgataaagatgcttgtgatcacagatagggagactgagtctgtgaaaagactcccaagccagtggtctctccaggaagccctgctgacccccaagcaaggctcttaccaagttgttagggccctgactcctgacattctagaccacgccatgacaccaagttttcctccctgtgggtgcgtgatgtttgacattcttcattcagaggtccatctaaatggatgtcacattcactaacgcatcatctgaaatacaacttcctttgattttgcctcttttgagtctttctccacttgtgttttcctatcaaagggattaaaccactttgctggacttgaagctctgtcttttccaaaagctttcatcatgtctcaacacagcttcccattcacagacacaggagaggatggaagaagagaagtatcaggcttgatgaggcttaataggatttgctcaagtcagtgcctttccctgcgtcctgcagagagtagctaggatgctcagcttacctaggccagccacagcattcctccctgtctgtcctctacagacagttctgcaaaaaccctagcttcaaagaggaaatgctagaatatcaactatgggagggctggctctgcgtttatcttcttcactgctttatgtccagctcctagcacaggggtttggctatagtagttcctcaattaatgtgtgcttaatgagtgcataattaatagaacggatctcgaaaacctgattaaagaatttcatctccattgtccctgaaaatccttttgacttgataggcacacaacactggaagccagggtttcaaggatggggattttacttacccttaaaagaaatctaaacagtagaggctgcatgctggtcagctcaatgcttgccctgcaaattgcccactgggcctttagctatttgtcttagataatctctacctctctttcttcatctttaaaatggggttaatgggatattgcattaaatttcaatttgaggagagattatgaatacgtatgtttattttatttatacttatgtttgtatcatgtattctttccatgaatccctacaattggctcccagggctggaggagcagaggatattatctgggatttatagcagagtaaactgaggcaaagaaagttaagtttgtttgtatttggaccacaaagctggtttgttggacactgagtcagaatccagatgttaccctgggttgagcaagggatgacttctgcggatgattccagcgcacaggaatgcgtcccaatatcaaatcaaaagtaaaccaccctttcctatctgccagacgcaaaaagttttcctatctgggctgaagtctcctagaaaacattttcccgtttctagtacggcacaaagccttcgcctacaagaatgtatgcaagtatgtttaaaaataaagaaggaaacagtgcagaaaatcagcagcaagctgtttccccaaagagctgagtacaggaggatgtgagctcccatgtgccccggccaatgactcattcttgtggcactgtgcctgccctgcccaacctcagtggctcagggagtccgcagcggcacccccattggaagcctatcttggttccaacagctggggtgtccagaatacacggggcctcgggacagcagcattttccatcatctctgagcatctgtgattgagttttcaggatgaagtctcccacttaaggcagagcaaattcctgcttgggattctgcaaagatagccccaagcattttcctccttgtctcatttatccttgttaactgccacatgaaggagcaggaagcaggtggccctatgcagaatgggaaatggccaatggacatctgggacaaagcccttcagatgaccttttgatatgatgttttaaaggttatcttgaaattgctataatcacccaggcagcacaggaaaaggcctgccagggtcatctgactccccaggacagctgggatctaccttggtttgccattaggcagtcagctcagtggttgacaggcctttttccaggttgttctactggggacacagcttcccggtgttctgcctggtggaacctgcagctggagtcaccctcagaatggtggcaggggaattcctgcaagggactgcccaaaccatccccaaatggggtcagttgagattccaaagaagaaatcaccaagttccaaagcacttattaggggaacttacatgtagagcgctgcactggtcctcatgacagacagcaagaaaagaggtgctccgcttaagtatgtctgcggcaagggctctgggttatggagttatttggcccaaggttgggctaattcctacatgtttagcaacatgtttaatctttcagtatttcaggtaacaacctaaacagggtttcagtgccagggaatgtttccagggctcaggcctgcaggaaaagacatgcagctggccaagtgacagagcagtctaggcattctgtgtttctcgatcaggacagataagtaagtgggggttcctgggggaccctatacccgggagggagggtaactgcgaattcaaggaagacttacttataaagaggaagaagggttgaaagatagtatccctaaggtgatgtttcccagggccagaagctcatagaactttctgaagggagcaggtcatcagccttagcatgagccccggagcatcagtgtctgctggccgttgtgtggtgagtgctgtgggtcagcctttgggctgcagccagataaacctagacccaaaacctcacttggtcacatgctaagtgagcttcattcttctcttctgaaaaatggggggataataatggtatttatctaaccatgttgtgaggattaaatcagccaatggataaaaatttcctagtgcagttcctggcttctgagtgctcagaaatgttgtctgttattgttaattaaagaggtctttcccaactgaatgagagtcttaaagctcgttaaatgggttttgaggggactatcagacacctgtattgcaggtgtgtgggtatctcttggaagtgtggtaggcacccccacaaacacattacgccctttgaagagctttggggccattaacatcctgtccagttccatttcttagaggacagggaatcaaattttctaatggcgggcctacacagcaatttgtcattttaataagcactcagatggctgcagacttcacactcagacggtaggggtgaccaattgacaaatcagatacatgctgccttttcctttctgtctgctgctaaaagacctcaagataaatagagacagcaaggaatgaaagaaacagcacaggcttgggccagatgagcaggaatccaaaaatcagctctgcctgatatttggtggcctgggtgtcacttaacctctttggaagcctgtttttttatttatccatccaattactcagtaagtactttttgaatacatccatgtgccgggctgtgttctaagtgcttggaataccagagaacaaaatgaacacaaacttatgcccctgtggagcttacattctgatggtgggagagagactgtttgaattaagcctgattcataagcaaacaatatagtatttatatagtggggattccaatatctaatgccagtgaattgctgtggcgataagaagccacaatccacatgtaatgcgtgggacacagtaggtatttaataaactattgtgattattctttttaaattgctcccaggtttctcaaaccctttcaacacttaatgtgtagtttgcacctagatattgttcatttattcattcaacaaacagctagcaagcatctattttgtgctagactctgtactaggcaccagggatacaaaagaaccctataagagagtgaggcccctgcccttgaggatttcacgccctgacccctggataacagaagagaagcctgggagagccccggggtgggggtggccttccatcttgtgttctagtgaatcagaacagcccacttcactgatggtgtctttttaactcaaagcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagcggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttcctggtgtctcctctgatcatctcccacgagatcaacgagaagagccctttctgggagatgtctcaggctcagctgcatcaggaagagtttgaagttgtggtcattctagaagggatggtggaagccacaggtaaggcgctttgtcctcctcagccacaggtggccctacctacacttcagacttaggcaactgtgactccagaagatgcaggtctgtgcctgagagtcctggggtggcacaggcaacacattcaatccctaaattgtggtttgaggggtactggtactcaagattgagtaatagcaatagctaacactgacaggaacttcccaactttcaggcactgtcctaaacaataaacatctatcatctggccaaatgtcctcccacgccctatgagatatagtgggttattgttgttgttgttttgtttgtttgtttgtttatttttgaggcagggtcttgctctgtcacccaggctagagtgcagtggcccgatctcggctcactgcaacctccacctcccggattcaagcgattctcctgccccagcctctggagtagctgggattacaggtgcccgccactgcgcctggctaatttttgtatttttagtagagacagggtttcaccatgtcggccaggttggtgtcgaactcctgaccttgtgatccacctgcctcagcctcccaaagtgctgggattacacgcgtgagccacagtgcccagccaagatagtttttattaaggtacagataaagacacagggacacagacaggctaaattatttgcccaagagcaagcactttcgaatgatagagctaggatggaaattgagaccagggaccccagagccagcacttgtttccaacaggacaaactgccccttcttggaacaagtgttctacccagaagagctccctggtcagatagctctggtaatcacagggcgaaacaaaagcgaactggtttctttacagtggacttctcgctgtccttacccactgagtctcatcactgggagaggaggggatgcagaatttcctaaactcaaaaggttctcaccaaccccttacttggagagacctttgctgcaggggaagggcttttgtggctgggctccctctggggcagccagccctcagcattcttgcagaaggttggtttagtgaacccagggcaggtgaggctcctttctcacaaaaaaacagtgcatccatgctgaggcatcaacatccatgtatgcccaagaaaatgccctttgtgtggccagcatggcacctccctgctcagctactgactcaccagcagctggtagccaaggaccccccagttcctcagccactcagccatggcagacctctgtgaggtggctccagggagtccaaggcctgggaccgcctgaactctggcagaggaccctagtccccaccccactcgcagcaaaaccccacatcctgcatatttcatttcttcctcgtgccttcctttctctctctctctcttttttttttttcaaccaggtacaatgagcagctggtcaggccctaaggatgggttctagaaactcagtcacgctcagaatgatgcatgtctatttttccaattcttgcaaatgacagtgtagggctggcttcagtctcattttacagatgtcgaggctgaacctaaaaagcattatgtagacagtgagtgttcatattcagctcttccacttacaaatctggagcttctctcaccactctgccccactaaaatactagcggcctgtcagaaagatggccaagcacacattccagcccccaggaaactggctgccgggcaggggactcagacccagactgcacaagccttcccattttgaagttggtggaaccaggagagggcaatgacaagctccagggactggtgccagaggtggctgctcggccatctgctgggggctggagtctggcaggcagcatatggtggcaggtgggcagccccggggccgaggacagtcaggactcaggagggtttcccccacagagctaggggcttgcaggtcaccctgcccttgcctccagggtcagaatcaacaggctgcatttcaggggaagaactccactctgaagccacaaaaaagggattgggtgagagacatggggtcaaatcatagcacacctgaccactctccaaggccatcctcactccccagccatgcagcagggagagcgcccacaggctcgtagtggagggagccagtgctatctgccccgctgccccgctgcacccccaaccacacctccctcaaagtcaggggcccgccgttcacttgtcctcacggtttggcctccttcccctcccacaacccgggctatgcttgctctgtcccacaaactgtaggggagatccagggagatagggcaggagaccctggcccacatctgtcctggatgtgggtggtttggttgtcaagcacatgcagccaggtgtgggctgggaatccatgcctcagcttgagtagcacaactctgccgtatcctgcctgagcgggtttgagcaagctgcttaccttgtcagcaaagtgaggaaaatcaatctcttagggctgttgggaggattcaagatgaaaaggagctgtgctgatcactatacctgacacctggggaatcctttccaaacgtattgagcaatgacagggacacaccaggatctctagctacagggcagccgctgccacaccccatgaggagcaggaggatcccaaaggggaaaggtcctgcccatacctttcccaaggccctgggaggctgcagacgtctggcatggtctaggctgctcagggcccggtttgggcctctctgccaaggctgtggggacaacaagggtaacgactgaagggagaggcccggcccaggcaggcatcactgagagcagagagcaggctgtgggcgcacctgtgtgggtgcgctggggctgagaagcagccttggacctgggtctgctttgtatgagcccctcccagagaaagcccaaagtgggagctggagacggttgccttcagcacccaaccaacacagttaatgccttccttggccagaagattaaatatcagaaagctgctttcctgtgaccctaagcacagaggcctcctcatccataaacaaagctgccctcctctctggagagaaagcaacacctaaaaatagcataggcatggcacgggctgagtagacagggaaacgaggcattggagcagcctcaaatcaagaagccaagctctgtgtgtgcgtctgctcctcttcctgtgtgtatgtgtgtgtgtatgtgagtgtggagccctctctccgtatgtgtccgcccaaaacaatccccatatgttccaaatgcctgtcagattctccgtgttcattcatgctgaatttatctttgccctttcctgccttttttcccatcttaatcttctagacctgaatgctgttttcaggaacggagtccctaccttcaactattccaacatctattcactccaatctctaggaaatgactttcagaatcttgcatgtcgatttctaattttctgccaccactacgccttgaactcctccagggcaaggactgtgtcttattcagctttacatttccactatgcttagcacaaagtagatgttcatgaaatgcttgatgagtgattggatggttgaaggaatgcatgaatgtatggataattggatggatggatggatggatggatggatggatggatggatggatgactggatgggtggacgattaggtagatgagtggatggatggatggatgggtgataggatagatggatagataattggaaggatagatgaataaataattgggtggatagatagatgatgaatgattggatggatggatggatggatgattggatggatggatggatggatgattggatggatggatgaatggatggatggatggctatatctttgccctttcctgcctttttttccatatctggatggatagataattggatggatggatggatggatggatggatggatggatggatggatatatctttgccctttcctgcctttttttccatatctggatggatggatggttggatggatggatggatggatggatggttggatggatagatgattagatggatggatggatggatggatggatggatggatgaacagatgactggatggatggatggatggatagatggatggatggatggattgatggatgaatggatgaatggatggatagatggatggatgattgcatcataatgcatgtaacttccgtttccccaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtccctcattccttccaccctgaggcttgctgtggactcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttctagtgctttttggcccaagaatctcagagtgcttctaatcatcacagtagtttttgtgttttgttttgttttgttttgttttgttttgttttgtttttttcacaatctcagccagcctgtggtgtgacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcagggagattgcctggggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggaggggggcagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgttttctaggcctggggctgaaaggaagaggagtggggcagcctgggacgggaactgcctctgtgggctccccactcccagggaggggctccataagctttgctcctgggctggatcttgagaggtgggcagggtcttcccaccagtggcagggtgtgcagttgtggtcccaagccttggagggaatggggaatgggctggcacccggctcagggaaagcagaagcagacagtgccccagcaggggagctgcatgcccccaggagtctcagaaaggcaacccatcactaaggctgggtgcctttcggcagagctacagctggagccctccggctgaggccagcactcgcctgggactccctggaccccagggttactaacagcaaaaccattccacacccccttgccagatctaagcctgtcttaggaccgtcagtgcccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccgggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgccttctaccatgccagtttaaaagcaagaagactcccccttcacatcctgaggaaatccccttcctggtgaccaactgatgcaatgaaagtttgaaaagttcttcattttctagaagttcttgaataaacatggacttactaaatgcagagtctgatgatggacagagtttcaaggggtcactttcaaaacatttaattaatttatttatgtagagacagggtctcgctctgtcgcccaggctggagtgcagtggtacaacctcagctcactgcaacctctgccacctcccaggttcaagcgattctcatgcttcagcctcctgagtagctgggattacaggcatgagccaccacgcccagccattttcaaaacactgctcctgcatacaaaccactcagaggccactgcccttggttctgtgatggctctgagcccatgccatcacatctgatggaccccagagagctgagccgtggtttaagatggggtcatgcgctggtcattcccacagtcttgagtatctccaaaatcccaaagtgatatttcacttttggaccctgaaagtttggagagctggtttcttgccttaatttaagctctctgagaatgtcccctgtagggagaagcctccaggaactcagaatagaactcgttcccactcattttccttgctccaccaatctgacgcctgacagatgtcaccactgcctgaaggatcctgtccccaggccagggcagaatgggcattgcctttgactctccccttcagactcccctcccaccggcctcctgtgtagtcagagaacccactgcccatcgcctcctgctgctgctttgaggttgaggtcctggcttgagcagttaccttgctggagaagaggagcccctgccatctggggagcactgtccctgctcgtgatctgtaacagtggggcgctttttcacaccccttatctcacggcttgcttccagcccccatcaatcctgtgcctcatgtgaggtgagccccagagaaacttaaattgcttgtactgaagttgccaaaaaccaaaagttgcccgttgtcatttttaagactgtgccctgaacacacctctgcccatgcaccgtggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagcgcctcccaaacaaacagccggggccgtggtcctgcctaaactctcacatccacggcaccacgctgggcccaggcaacagagataaggagagccctggctcttgggatggggtcgcgccgattcacatgctgtgccgcggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaacaacgtctccttaaactgctgtcaaatctttttctccctgtgtaggattcatcaatcttcgtatgcaaaagaacaccactgcactgcactgctaaaaattcacacaataaaatggactttaacttgcagagctctttctcattttaaacggacggccactagttgcccgtttaaactcattgccagttgtagaaaccttgtccttcttggttttgttagcctaaaaatgtagtatcaacatctagactggtttcgaggtgggagaatgggcaaaggtggggaggagagagccggataggggcagctgcaaccaggtgttggcaggcagagcaggcagcagttgcggaagctatgggcagcatgggttctcacactaagtcattcatgccacccccaaataacttctgtacattctttaatgtcaaatattcagaacccacattacctatgtaatgagtaactttaaaaatatctacttcagggggcccttggactagcattctgctgccagggcatacatttgcaaaaggatcgttcttgcttaacagtgggaaaggggcagaggagtctgtgatatctaatgttggcaaaggatctcaggatctttcgaaagaagtcccaaagtttctgttgaaaatgtccttagcagtagaggatgtaagattggattctcttctgctctggtcacccaatggcaatatcgaagagccaatatttactgaaaatccctcaggtacaccatactgaaaggataaagtggctcaccagggctctgattcaaaatgagaagcagtatttccagttgggaaaggcagaacagctctgatgtgtgtgggggcatttcccacatctggccccatggcccacccacggtaaccaggcatcagcaaatctgtgcgtgggacttgggccaaaagcacgtgctgagcctcaaattcagccatgagcaaaactacctgatgactctgagggtgaattgccttcagggtgggaaagacccatgcaaaggccaggagctctggggatggcccttgcctggggattgcactacaattactgctcagtgtcagaatggagacatgaggtcaggagaaacgatgaatctgtgaatttgcacatttgtcagtcaagctcggattgcaatttgaggaaggagaactagacatataatctaataaaagcaaaaatctgaatgttacccttagaaaacccactcggggccggccgggcacggtggctcatgcccgtaatcccagcattttggtaggccgaggtgggcggatcacaaggtcaggagatcgagaccatcctggctaacacggtgaaaccccgctgctactaaaaatacaaaaaaaatcagcggggcgtggtggcgggcgcctgtagtcccagctactcaggaggctgaggcaggagaatggcatgaacccaggaggcggagcttgcagtgagccgagatcacgtcactgcactccagactggatgacagagcgagactccgtctcaaaaaaaaagaaaacaaagaaaaaatgaagagaaaacccacccaggcccagaagatgcgctctgccggttccagtcagaagaagaccaacgccaacgcatgcagagcagatgtctccttaggccttgttagatcccagcaataaagcgtgctgactttcttatggtaaataaatgtctaggaaggagttttgaaaacagaaacattgctgactttttctctaagtgagtatttatgttgactcagaagttgttattcaaataaccttggctcacttggtggaggcaaaaatcctacatcccagaggagaaattactgagaattgggcacattaacatatactttgagcttcatttttctaccaagtaagcaaaagtgtaagtggagagatcctcggctgtgctgggtgaggctgcagcagtgagcgaggacgaggtgacgtgtaggttgactgaggactcgtgtgtgtgcacccactggatgccacattccaaatcacctcttttatttatttatttatttttttttgagacagagtcttgctctgttgcccaggctggagtgcaatggcacaatcttggctcactgcaacccctgcctcctaagttcaagcgattctcctgcctcagcctcccgagtagctgggattataggtgcccgccaccatgcccagctaattttttgtatttttagtagaggtagggtttcctcatgttggccaggctggtcttgagctcctgacctcaggtgatccacccaccttggcctcccaaagtgctaggattacaggcgtgagccaccacgcccagcccccaaatcacctgttagataaacatgctcatggaagagactgcaaccagccctgtgtgatctgaagcgtccagggagtaactgtttctttgcctcaccatgtagttacctggggaagtgggaaggcgtgaccactcaggaatgcacccaccttctctctccttacagaggagagcccgctggttctggttcatggaaacagctaagaaagggggaaaagcatttactgaacccagactgtgccctgatggatgagaatgtggctgtttaatctcctggtgtctttcccattcagtaagtgcactgggagaggcttcacactcctcctcttcagatgaagcaccccatggacacaccctgtcttcaaatattagataaaatcttgcagggaagctgctcctgtttaggtctcccagaaccccacagcagcagcagtacctggacattagtccaggagctgatcatcctgatcattccctttggaatcggtggagctttgcagggcattccaacaaccatctcactgtgataaaggattaaaatgacatctcagaagacacagagccaactccacacaacgtccaaagggtctctgacttttcattacttcaattttcccacacatccattattcagcaaacatttaatgagcacctactatgtgcccagagcaggaagaggcactgcacactcagcagtgataagactgtcttagtccactggggctgcattacaaaaataccttagagtgggtaatttataaagaacagagacttcctgctcacagttctgaaggctgggaagtccaagatcaagatcaggccgccagcagattgggtgtctggtgagggcctgttcctcacagatggtgccttacatgtgtcctcacttggcggaaggggccaacaggctccctgaagcctcttccataagggcactcatccatcacgaggatcctcttcccacgaccgcatcactgcccaaaggccctgcctcctaatgtcgttacctaaggggttaggtttcaacaaaggaattttaaggggacataaatatttagaccatagcagagacaatatgatctcttgccctcatgaaattttctgtctggtggggacggggagagacacagacagaaaaaatacacaaatcaaagaattacagttcgcaataagggctatgagggaaact

SEQ ID NO: 11874 - DNA, 25922 bp, Human
atgagtcacagagtgggcacactatgaagagcaggtggcagcagtaggcactctttatgtagagcaggcagcagtgagtaggcactctttatcaggagcagatgatactcagtaaacactctttatatagagcaggtggcatctgtaggcactctttatctagagcaagtggcattcaataggctctctctcttttttatttttttgtgagacagagtctcactctgttgcccaggctggagtgcagtggtatgaactcaactcactgcaaactctgcctcccgggttcatgagattctcctgcctcagcctcccgagtagctgggatcataggtgcccgccaccacgcccggctaatttttgtatttttagtagagatggggtttcaccatgttggccaggctggtcttgaactcccgacctcagatgatctgcctgccttggcctcccaaagtgcttggattacaggcgtgagctactgtgcctggccagtaggcactctttatgtattgcaggtggtactgagtaggcactttttatgtagcgcaggcaagagtaggaactcttcatgtagagcaagcagcactcagtaggcaccctttatgtacagaaggcagcccacagtaggtacactttatggagcacaggcaacactcgagcaggcagcactcaatagaccctctttatgtagatcaggaaacactcagtaggaagtcaccatatagagcaggtggtatcagtaggcactgtttatgtagagcacttggcactcagtaggcatgtgttatgtagacagcaactggtgctcagtgggcactcttcatatacagggggtggcactcaataggcactcactatgtagagcaggtggcacacagtaggcactctatgaggaatatcaggaactgagtatacagggttaatgtagagcacctggcacacagtaggcacactttatggaaagcacttggcacagagtagacaggatttagcacctggcacacagtagctgcccttcatttagagtattggcacacagtagaagtactttccatgcagcctttgtgcagagtagagactggcacacagcagctcaagtgctagttgccaccctttcccttcactcctttttggggctccctcctcttaggagccctcattgtcccccgctaaggccctcatcgaacatcccatttcccagatgggaagactgcacccaggaggggcagtactgaccaaagtcagagcaaggatgaggcagaatgaggactccattcatggttccctggctctgcccttcccctgcctggaccccatccgttccctctcatcctaaccctccacgtccccgctctgtcctcctatactgagtccggcctccagatttgcttttccagctgagctcttaatctccagaatctgacccaggtaatcctcagtggggctggattctttgttcccgttcctagcagtcaggtctccaacagggccctggactgcctggaggcaagacttgaactccatccagcagcagggggatagaggcttgtctcttccaggttgcctgattcagcatccagaagtggtacacggtgtcctaccggcccagggttagagaggagcacaggagatgatctggaacaaggcttggcctggcctggctcgcttgacacctgaactctcaagttcatgcttttatctgccacacactcagtaggtgctctttaagagcaggtgtcacacagtggaaactctatctgacccctctcggcttactctccaccttatgtgggaggtgctgagacctgaggatccagtgcctgtgctgtgtcaccctgagctggttcctctgcatccagctggtctcccacacccaggttttggccagctgcccagacatgggagcggcacccaggctgtggggattggctggcccagcccagcccagcctagcctcccacagccttccctacatcaggggccaggggaaaaaacctcccagaagaaggggagaggaggttgtgtgggacaaggtgctcctgacagaaggtgccagggtgggggtggtgggcctggggcatcctagcctgtgatggagatgggcactgggcaagggattgggcgcacacataggggagccccagccttcccacattctccattgctgcccaaggcccaggcagctcctggttgctggcttggaggatgagtggttttctaactgaaaccaagcccctggcaacgtcctaatgattcaggctgggcctttctggactttaatcagtttctctgtctttctcaatctaagtgcttaccgggtaactggaggccacttggttgctggttttggctgggcctttctggactttacccctcagcccctgtttatccatccctgtttactcttactgttctatctccagcactgcccgtctctgcctctctccactgtccctggagctccctgggcccttccctgggcctcaggacctcactcaccaccccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtgagtgtggcagcaggacgggtctggggtctcagggtggatggacttcctgaggggtaagaatgaggctcaggtgagagggggtgggctggggtctggggtggcagagaagcaggggaggcgtcttactcattcctctgcttactcatttctgtgaggtgccaacccaagcccttctcacctccctgttctcccactcttggcctgtgttgaatccttttcctgcctgtctttccacattaatgcacctctgcggggctcttgggcagggggttgggtgcacagaaaggtgaacccctggcgttcccacattctccattgctggactcgaggcctcctgtacccactgttcagggtcctctccctacctggcctatttcctcttatgagggtataggtgggccagaggagaggtgtgggctgtctctcacctccaccacatccggaggcaccttcctcttatcttgttcctccccagtaagatgtcccaatggggtcctgttgccaaacccacataaaagttggccactcacttcccctttcagaagccttccctgacctttctcctcccccagaccttgccctctgacttagacctgctctcccctttgcggaacgtggtctcaatctgctcattgcaaatggcaggattgatgggtgtgtccacaggtgaagtgggagggtgcacaggatgcactagcacagagcctggtgcagaagcttctcccaggtgggagccactgtcatgatggacagttagagtcacctctgctcccctagtgactgctgagaagggaaggtcccctgtgtgcagaaccttctccatgggaggaactggaacctgtgtggctggtggaggaaccagccagggcatgaagggatgtggggaccagccttagggacatgtcctgagtccacactgctccccacaaacctcccctgtgaggacctcctcatatgcccacctctgggctgaaatgactcccagaacaaggaaatctttcctctcaagctaagtgggcctctgtgagtggacagtgtgtcttttccttctgccttgggatgcgctcttgggacttgggggtggccccaagagagatagagcaggaggaatgtagacagatagataggtaataggatagatggatggatggatgcacagatagggtgaatagatggctggctggctggataagtaggtgggtagatagacagatagatagatagataacaggatagatggatggatggacagatggatgcatggataagatggatggatggatggatggatggatggataatacatacataaagtagtagataagatggatacattaggtggatagataggtagagtggatatgtaggatggatagattagatggatggatagatagctagatgattgatagataataggataaatggatgagtggatgaatgtacagataagatggatggatggatggatggatgggcagatagatatatagatagaaaagttagataggatgaatagattagatagataaatgaatagatagataggtaggtagatagataataggctagatggatgaatggatgcacagataggatagatgaatggatagatagacagatatataagatagaatggatggattagatagatggatagatacatagaaacataggtagatagatagattagatagatagatagatagacagatagatacatacatacatacatatatagatacatagataggtagatatgtagagatatatataggtaaatagatagatagatagatagatagatagatagatagatagatagatagatagacagacaggcagacagacagatagatagatagaagagggagtttatttcgggaattggctcacaggattatagaagctgagatgcgtcatggactgctgtctgcaggctggataaacagacactggttgtgtaactgagtccaaaggcctgagacggtggagttctggtgtccaagggcaggagaagatggatgtgccagccccacaacagagcaaattagcctttcctctgcatttttgtgctacctgggctctcaacagattgaatgagctctgcccacactggggagggtgattcttccttcctcagtttaccaaattgaatgccagtctcttctggaaacaccctcacagacggatgatcaactatctgggcatcctttagcccagtcaagtggacacctagaattaaccatgacaggaggtgacggcccctgccttgcttgcaggtcacccccacggagcagggcatgagggtcctgactcagctggtggccacctacccccagggctttaaggtctggatgggccccatcttccccgtcatccgtttttgccaccccaacatcatccggtctgtcatcaacgcctcaggtaccacctggaatacttggtggtgggtgctatggtgcatttgaggcctgcaagtccctctatccccaagccgtgtgtggcccctgcagtactctggtctctcctttccttctctctcagccatcttcatctttctttcatgtattcactaattcccatctcagcatctcctctctccattgccatctgaccccctgtcctggtgttctgggctgccctggggccccaagagacctcaacccaaggccctgtcctggaggaacccccaagcttaaggaggtggatgtggacagagacatccccaacttcatggggtcaagaaagggccagagggagatggatgacagcccagagaagagcaagttctctgctggggcaggctggaagccttcctggaggaagagttactggagccatgtctggaacaatgagtagggatgtttgaaaggagagtgcagggtgatgcaattgggcatcgttagtgttcaaggccccttgccaggtctagcgtcaccttgcctgtcacaaaggttagaacaatgaggacttgtggctggtggaggatctggactgttatttctgtgatgtccatctctggtgtgggtcaagtccttttaccccatcctgtagtttgtctgccctaagttcattgcttttctgctctaggccctgggaatctccaaaaggagactccagcctagtttggggccctctccttgacccctgtgcttcccttcttggacaggccaggctgagcagggaaacaggcagcatcctacagagaccatggctctggcctcaaaatgctgagtgactctgggctggttcccagctgtctctggttactgaggtctctttcagttgtgagtggtggaaatccaacctggtgtagtctaagcaaagaaagagaatctattgattttaaagtccagggaggatggccttcaggcatggctggatccaggtctcacacagtgttacttcctctcttggctttagctttctccacgccacttttggcttgtcttcctttcttggctttagctttttccacgccacttttgctttcaagacagtctttccctcatgacgtcaacaatgagtcctagaagctcaattctcatgggaaagcccacatttcccccagagttcccagaaaaggcccatgatttacttctcctggcctggatcaccagatcaatttttcacccagtccctgtgtttctgattgcctagtctcggcaggcctgggccttctagagctactgttttgggggcacaaagaagtttgatggttaaggaatcaggccatgggtgcagatagacccagtctcaggcctcaggtttgccatggtctgggactatgggcaaattactttatcatttagagcctcagtctcttcatctggaaaatgggatgaatgagagcccagggaacatggtgtgtggatccacatggggaaagagcttttctgtctgtgtaactgaaggactggagagtcctgcatggaggatgtgaggaggaagcccagtgggggctcagcactgagagggagatgagatgctgcttgaaattctcagggagagggcttccacctcttccctgcagatccttctctctcgcagcctaggagagcatgaattgggtcctgtgtctttctctccagattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccaggtagacactgcactggccactccaggtagacactgcactggccacgccttgcccacagctggggtctctgtgctgcctccagcgggtcgcgtgcccatgtgcagacaggaggggctgtggtggagatgccactgcttccatctcccctggacttccatctgtctgacctctgttcctgtttgctcatgtctgggaagtgtctctatggtggctgttatatggtcaagtctgctgtacggctacgtcttgtcacctgtatatttacacctgggtcctggttacacctgaaatatgttatacccggttacatctggtatatcattccaactgaggtcatgtagagctggtcatgtgtggagttcatgtgtggccaaggacatttggggcatgtgaggggctgttttgttcttgtcgcaggtgctgtttgacactgccgttttctcctgctggtcacatctgggccatgtttgggggttgtgtgaggtctgggacccagggtccctaagtgaactgtctgagacattatttgagtcttgtctgaggcatgtgttgtagtatgtttgggtcatacgtgaggaacagtctgggtcacgtgttggctatgtctgggtcgttaaaggtaccatatttatattcaacctggagcctgtatgtggaacacgcttttaaggtcatgttagaccatctcatgtgcatgttagagcataccatctcatgttaggaattgtcatgtattttgtggccatgtcaggacttgtgaacacatgtcagtgtcatgtctcatgtctaggtccatgtcagaagatgccatgtgagaatatgtcagagagtgctgggacagacagggtgtcctaagtccttgtgaaggcattctgtagagtgctgagcgtgttcagggtttgcagaacatgttggatcatgtaggaggcatgtcaaggcatgctggagccctgacatagctcctacgtgccatgttaggcagtgtcattgctgtgctgtgctgccgtagcctggtctggtcttccctcccctcccccatcctgccttcttcctctccccttgaccctcttcttgctatgtggggcttggagggaagaagtgcaaacctcttgctgggagcctccccccacccccaaagttcctccttcacctgcctccatggcccctgattgtcctcatttatgtcagctgccattgtaccaaaggacaaggtcttctacagcttcctgaagccctggctgggtgagtatctgtaggtgaacagggttgggaacaacctggggggccaggggagggagatgcccttgcccatggcccttggctgccctgccaggggatgggctcctgctgagtgctggtgaaaagtggagccgccaccgtcggatgctgacgcctgccttccatttcaacatcctgaagccctatatgaagattttcaatgagagtgtgaacatcatgcatgtgagttatttgaagccaaggtcccagctgcagcctttggttggggggaaccacagacagatctagtctggaattttggctctgctgggtgcctctgggccattgtcttcctctctgagctttggtttcctcatctgtaaaatccctacttaaaagaaggtcaaggtgatgtagtggagtcatgtctctggcgcatagtaggtgcccagaaggtgtctgtttctatgttcgcgtcacccgaaccctgtaaactcaagagggtaatgacaacaattgcataatagctgttgctgataagaaacaacctgaaaactcattggtttaaaccaataaaggtttatgaatcctgataagtctgtgggacagttcgtggattcttctggatgtggatggaagggatcagtcatggtacatgagcagcctggggtcaggtaggcagccttgctggtgttggctgagttctctcacatgtttgggttttggctggcttcagaccgatacagatggcctcagcttagacccctggatgttcctccatctgattctctccctccagaaggagtcccatggtttacaatacagatagggttccagggaataagatgaggcttagcttcattagttatcacctcatcatttttaccacattgtattttgacatcaaaagccaatagtccaacacggaatcaatggcagggggtaaaataggctctgtctattattgggagttgctgaaaaagcacattgcaaagggtgtggatatggggagaagggaagaattggggcgaaggttttgtgaagtgtttagaattttttaactttaaaattgatgttaagctagttactgtttcataaattattctggaagaacaagaaactcctgggtcagagacaaaggatagttttactactcatgacacagagagcagcatgtgttgcttgttagattgcacttcttctccaagcctctcaaatcccatgggctgacacaagtgggcttctataaatgcctgctgacatcatatattgcattacagggaaggggcattaggcttaggaatctgtttttatagcaagcagaagcagcatatccagggggtgtcccttatcctcaaagttattttctgcaaacacaactctgagaaatttttcaagttaagaacatcagcgtgttgcatttgtgacatgcccagaaagggtgctcaggactcatggaggactacctctacaaacctaggatatttttataatcaatttataactgcagatgaggaaacccaacatttattgagaactcacaatatgccagaaaaaatgccatgtgcccattccatgatacgagtatatattgtctaatttgattttaacaactctgcaaaggagagattatgtatttctgccccatggtagatgatgaaactgcaggtctgagagattagggagctaacccaagttcacccagctaatgagtgagcttggcatggtggagcagagtttctaacatgaattatatggctccaaagcacatcatcttaactgttcctgaatatctgacaggtgggatataggggagggtaatgagttgactaatggcacacagagcacagaggacagagctggaacttgaacctaggtctcctgactcccaatcttgggtcttcatctcttaatagtaacagcttttgcttgcaccataacctggtgctcccgggtaaagggtccctggggagaagatgaagaggcttattctggggcgtgcatattgattgttggggttggagagctgctcaagggagcaagggacctgccccagctctgtccccttctctggctaggccaagtggcagctcctggcctcagagggtagtgcccgtctggacatgtttgagcacatcagcctcatgaccttggacagtctgcagaaatgtgtcttcagctttgacagccattgccaggagtaagttcttgcccagggtctgggatcctgggccgtggacacaaagttggtaggtggggggctggggaggactgagcagggaaatcagacaaaccttcttggaggagttgttatacctgatcgttgaaggactggtatgaattttatcttgaggtttccagggactcattaaaagggtttgaactggtgggtgtggtcaaagtgggtctctctcagggactgactgtaatgtagcactaaatggagttaacactgatgcaaagaagctagggtggaagctggaccatggaccagttggaagaggataaagtctgagctttgtggacagcttcaggaaggagaaggggcaagactgtatactgggagggagagagggaataggagcataatgtgcaaactatcctctgggtgcctagctgcatggaggcatctcacagagatgggatgcagggagagataagagagcctggagagtcgatttcatgctgatccccatcctgcatctgaggggccatctgttcctggataccccgtttactgataggaggtagctcctagctgctggtgggaggtgatcctggggcttcaggtgtattaaattgttgcctccctttctgcccttatcctgcaggaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaaggtgattgaggaagggagggacaggtcagagataggttttggagatagctctgtggactagcacctaccaggggactgctaaatgaaattgtgatgagtctgagatttactctatttataagttaataagctaattggccaccttttaatctatatatctacatctatacctatgtctgggtctatgtttatgtttttgcctatgtctttctgtatctttgtctctgagtttgtgtctctctctatgactatgactatgtctatgtctttgtctttttcattggccatatctgtatgtctttgtctgcatctgtgtcttcatctttgtttatgtttatgcctttgtgctctccctccctccctgccttctttttctttctttctttctttctttctttctttctttctttctttctttctttctttctttctttctttctttctttcttttccttccttccatctttctttctttctttttctttcgttctttctttctttctttcttttctctcttctctctctttctttctttctttctttctttctttctttctttctttctttctttctttctttttctctctctctctttcctttttttgacggagtctcgctctatcacccaggctgcagtgcaatggcatgattttggctcactggtaacccctgcctcccgggttcaagtgattctcctacctcagcctcccgagtagctaggactacaggggcacgccaccatgcctggctaacttttgcatttttagtagagacgaggtttcaccatgttggccaggctggtcttgaactcctgacttcatgatccatccaccttggcctcccaaagtactgggattacaggcgtgagccactgtgccccaccttgtcatgtcttttctatgtctgtgtttatgtctttttctatatctatattttcgttcttgtctatgtctatgtgtctgtgtctatgtctttttcttttctctgtgtttgtgtctttgtctcagtgtatgtctatgtccatgtttttttgtctgtgtctatgattatgtctatgtcaatgctatatctatatctttgtctttttttttttttgagatggagtctcgctgtgtcacccaggctggagtgcagtggtgcgatctcggcttactgcaacctccgcctcctgggttcaaatgattctcctgcctcagcctcccaactagctgggattagaggcacctggctaattttttgtatttttagtacagacggagcttcactatttttagtctcaaactcctgagctcgtgatctgcctgtctcagcctcccaaagtgctgggattacaggtgtgagccactgcacccggccatatttttgtctttgaatttgcctgtgcctgtgtctgtttttgtctgtccatgtttatgtctatgagtatttgtgtctgtgtctatgtccatgtctatgtttatgtgtatttgtgtgtctgtgtttgtgtctaagtctatgactttttccatgtgtttctgtgtctatgtctgtgtgtctatgtctttgtctatgtgtatgtctgttgtgacagaggcatttaatctctggatcagagcagctcatgtcttgcttatggcaatactatcagccagagtaggattgtggcactgactctccattcccaagtcaaattcctccaagggcaatgcgatgttttcccctgtacgtgcagcagactttgtaccctaggaaaggcaccctatattatgagtctcagcacattttctatagagagagagagagaggaagaaagagagagggcaccagctttgtgagagattatgtgctttgttctggatgccatattccatagacttacaactcaaatgtctccagggagataagattcatttaccactgtagaatgtgggcaaatatctttgaagcaatacttaatctctaatttccaagacaaattgccatttaattatcctgtaacccaggttgccagtgatttttttctcagaaagttttcatcaagcagaaacatgaaagcattcatgggtcattgagtcttcccattagggaccaaagaaaaggcaaggaagccagggaggaagcccatggggttggggctctggccatggtgaccaagaagggtctaggagagcaagatgggcttgggtttctcgaaagaggatgaatcttcagagactgtctcagattagactcaagagccctcagaggtactgtgactttttatgggggtgggggtggggggttattgccttctctccaggatgaagatgggaagaagttgtccgatgaggacataagagcagaagctgacacctttatgtttgagggtgagggccccagtgtggggctagagtggggacttggatatctccattccaggaacagggtgggtggacccctcgcacttcccatcccccttcccccatcctccctgaggtcctcaatgcaaggttgctgtacaccctcgggtgctgaagcagcccagagacccaagcctgccttgctgccccccaggccatgacaccacagccagtggtctctcctgggtcctgtaccaccttgcaaagcacccggaataccaggagcgctgtcggcaggaggtgcaagagcttctgaaggaccgtgagcctaaagagattgaatggtgagtgcaggtgctggtgccctgttcctgagcctgtctcattggctctgttccccaggtagggaggggagaaggggttgtttttgttgattctgccactattgcttagtgggaataggagcagaggaccacaggcaggacttagtacccatcctgactgtctgggcaaaggttataggcccttaggacagaaagacctgggcttctgagagaattgttgatgatatgtgaggacagataacgccacttagcatgtgttcagcaaatgaacttcccctccactctcttccttttctccaagaaatatttttttgaatgtcttcacttgttgaatgtttgctcttctgttccctaattcctacccttccatccagtccagggatttataagggagacctgggggtaaaattcatccattcttgtccagaacacctgcatcattcatccatccagtcctcgttcagcaaatactctcatactgcattccaacccccacatctgtgcacagcatctttctgtgctctggagacctgggaaggacccaaccagggatctattttccaggtgctcccagcctggtgggggaactgtccctgggcaggacagtcccagcccacgtgggcagggatggggtttacagtaagggaagcaggactaggggggtatagaaagtgtctcagttgaaagcctgaataatgatcagtagataattgggtacagttggggagcagtgctgtaggtcaagaagaccacctggggtcttcgggggaggaagagagagaggagagagagagagagagagagagagagagagagagagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcccaagggcaatagggagccatgagaagtgtttgaacaggggagggacaagtcacatctgggtaccaggaagatctttctagggctagtgtggagggtgtactggagaggaccagctatagaatgagagcgcagtggggacattctgaggctcaagccaggccaggggctggaggaaggagaggaagcattggagtggacgggtgtcttggactcagtgtcctcccgtccatgcctttgcccagcacagcagtcctgggaagggaagaaacatttttatgcttctaaaataaagaatatttttgcaattttattttttaaaacacatttttattgatgcataatagatgcacatagttttgaaatacatgtgataatctaatacattcatataattgataaagatcaaatcagtgtacttgggatatccattgcctgaaatatttgtcttttctttatgctagaaacataactaacataagcaaactactttctaatgtacagtacatattgtaaactacagtgaacctactgatctatcaagtgctaggttttatttctcctatcaaaactcaaattcgtacccattaatcaacttctccttatccttccctcccctctgccaatctatcttcttttttcatgagatccactttttcagctcccacacgtgagtgagaacatgcgatatttgtctttctgtttttggcttatttacttaccacaatgacctccagttccatccatgttgccacaaatgacaaaatttcagtcttttaaatggctgaatagtattccattgtgtatacacactacattttctttatacattcatctattgatagacacttaagttgattccatattttcgttgttgtgaatagtgctgcaataaatacagaagtacagatgtctcttccatatatttattttctttctttgggatagaaatttcttctctttcttttcagtagtggaatttctgggttatatggcagttctagttttagtttcttgaggaacctctgtgctgttctctgcagtggctgcactaatttatattcccaccaacagtgtgtgtgagttcccctttctccatatcctcaccagcatctatcattgcctgtctttttgataaaagccattttaactgggatgagatgatatctcattgtggttttgatttgcatttctctgactgttagtgacattgagcatttttccatctacctattggccatttgtatgttttattttaagaaatgtctattcagatcttttgcccattttaaaatcagatatttggttacttttcctattgagttgtttgagctgcttatgtattctggttattaatcgcttgtcagatgagtagtttgtgagtattttctgccattctgtgggttgattcttcgctttgttgattgtttcctttgctgtgcagaagcttttttgcttgatataatctcatttctctattggctctgcttttgaggtcttacatagaaagtctttgcccagacccatgtcccggagtataaaaccaagatttcaagcaaaattatgcgtgtagtttaaaaaaaatggtcgaaagactttatgacaaaaatgaagttccttattaagctccaccttagcggtgactacagtcaacagttctctgtgtattcttctagaaaatggctatcccgatgcccacatttatatgaactcacactgtgacttttatttatatgaacacttactgtgcttttctttgtaagtgaaagtccataaaatagacacgggtctgcatattatctctgagatcttttgcttttctcaaaatatacattttggaaaatgagtttgtttttaaatttgttctttgtctttaattgacaagttttaattatatatgtttagaggcacagtatgatgttgtgatatatgtatacaacctgaaattattaaatcaaggtaatgaacaaatccatcacttcatgtgtttatcatttttgtgttgagaacatttgaagtttactttcttagcaatttcaactaatacaatacattgttcactaaaggcaccaggctgggcagcagatctcaaaaacttattcctgttgtctaactgaagcttctaccctttgaccaacatttcacccttctctgtccctcccccagccctggcctctggtaaccaccattctattcctatttctatgagctcaactattttaggtcccaagataagtaagatcatgtgtgtttgtctcttctgcacctggcttacttcacttagcatgagttcctccaggttcttccatgttgtggcaaatgagataattttttcttttttaaaggctaaatgggattccattgtgtatatatatatatatatccacatggaaaaacaacattaaattacaaaatgaatgataaaaaagagttcttcttgtaccaaatgagacattacagataagactagggttttccttgacaatcctgccacctgacctaatcctttctcattctccaaaggtgtttctagagccatagatttgtttatctatctatctatctatctatctatctatctatctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaccatctatgaatcattcatttttataaatatatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtgagactagtgatccctatttccttcttttgtgtaactgtatagtattccattgtgtggctgtttatctaaacattttcccattaatgtatatttggcttgtctccaaacttttgctaaactggacatgaagctgtcagcacgtgtgcacagtgaccattccttacatgcataggcatctctgcaggacaaattctctgaagtgcaattgctgaatcaaagaccatttgcactgtataatcattatttttttgagacagtttcactcttgttgcccaggctggagtgcaatggtgtgatctcagcttactgcagtctctgcctcccagattcaagcaattctgcctcagcctcctgagtagctgggattacaggtgcccccccaccatgcctgggtaattttttttgtagagatggggtttcaccatgttggccaggctggtctcgaactcctaacctcaggtgatctgcctgcctcggtctcccaaagtgctgggattacaggcatgagccaccatacaatatgactgcaaatcctttactattagctgagttttatggcacaaactttcccataactttaccaatagtactattgtattattgaattttaaatcttggccaattttcatatttcttcttttgatggacatttaaaaaaagtaagagtgaggctgaacatcttttgcacgtgttgatgttatttgctttctttttatggaactggtattcttattatttttcctctttttctttggaccctttaaaagtatttacttttaagaatgtgtattaagattgatttttttctgcctagtgttgcaaaatattgccttttaacttttggagggtacttttgattaatttttatgacgttaagtaggtccacatttttctttcacagctgtaaaatccatcaacttcccaggattttgtttagggtgggtgggggcccctttaccaaatgtgaagttttctcttattctcatgtctttttctgagctctttatgctgttccatgggtctattttcttgtttctgcaacagtgtcacactgtttttattcctgcgactttgtaacaattcttttaaaaagtttatttcgttacagggagaaaaggtctcacttgcaaacagagagaagctggagagttgtgtctttgctcccttgataaggattggggctggggtgtttccttagggacgacctggcccagctgcccttcctgaccatgtgcattaaggagagcctgaggctgcatcccccagtccctgccgtctctcgctgctgcacccaagacattgtgctcccagacggccgggtcatccccaaaggtgccacagcctcagggggaggagcctcctgggtaggaagaggggcccctcaggcagggagcattgtcctgactgcccccttctctcccacaggcattatctgcctcatcagtgtttttggaacccatcacaacccagccgtgtggccggaccctgaggtgcgggccccccgtctctgtttttgtccattccaaggctcctagaggagggggcagggttttgatcaggagaatccaacatcacctccctccaagacacacaccactgtctctccaaggctggcggactgggagaccccacccggcaacccttcttggtctcgcctccaggtctatgacccctttcgctttgacccaaagaacatcaaggagaggtcacctctggcttttattcccttctcagcagggcccaggtaagagcggcctgtgtttgaggcggggacggggagataggtgcaggggtctgggcatgacagtggggaaaagggggacattgtagacggtccgagttccagctctccttccctcacctcctctggagtttatgggaaaaggcccacagagtaggattgggttggtcctagaaggatccctagtgagctcagagctccctcctaccccaccttggtctaggctggggggttggagctcggctaggctcgcaggatatgcaagcccacatggggatccaggcacggatacccccttctctgttcctcaaactgctctaggtggggttgggtgtcccaggccaggttaccggcttgatggggccaggatggggctcctgggtgcagtcagagtttccacccctctccccaaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcagtggcatgatctcagttcactgcaacctccgcctcctgcgttcaagtgattgtcctgtctcagcctcccaagtagctgggattacaggcacccaccaccacatccagctaattgttgtatttttaatagaggcggggtttcgccatgttgcactggctggtgttgaactcctaacctcaggtgatccacccgcctcggcctcccaaagtgctgggattacaggcccggtccagtttgatagtttgttatcatgttatacgtacacttagaataatgatccagccatctcattctaacagcaatgagaacttaggctcccctctctactaaaatacaaaagttagctggtcatggtggtgcgggcctgtaatcccagctactcgggaggctgatgcgggagaatcacttgaaacccacaggcggaggttgcagtgagctgaggtggtgccactacgctccagcctgggggagggggacatagcgagactcggtctcaaaaacaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcctttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttcagttgtttattgttaatacatggtagaagtttgtatcctgtttttgtaaaaggccacatagtcaatattttaggtcttgcatgccctatctggtttcttcttctctttctccttcttctccttgtgccaccttttaaaatataaaaaccattcttggctcataggccatacatatacagtacacaggccatatttgatccatagaccatggtttgctgaccctgggatataggaatatggttgatttttgtatattgtctgtatattggatcattcttattggaatacaataatgctgttatttcctcagtcttaaaacacttcccctcttggcctcattttcacaccagtcgatgctccatttctttgccccactatgcagcaaactccttcaaagagtgacccacatgtgggtgtcaaatgtctcctctcccactccaaacaggctttgagaatcctctcaggggagtgagggtttataaatgagacataaacccacaggactctgctacatctgtgtatgtaattctcaaaacacactcaggcctggtcttgttactggctgctatgagacctccatcttctcctgagtgagtgtgaaggaggcactctctgctggacggtttggggacaactggccctatagagtctttattagtttcattgtatgtatgtgagagagcaagagaagacagagtgtgtgggtatgtgactctatgtgtttgtgtgactgtgtgcagtgtcgtaacagcacatgtgtgtgcgtgcatacaggcgcatatgtgaggcattctgactggtgttaggtggcgtttcattgtggttttgatttgcatttttatatgatcagtgatgttgaatgtcaggacatgttaagatatattggagctatgtcacatgttccggctttatgtcaggagatggtagaaagtgccaagaaagacgaagtatactaggtccctgtagaggcattttgtagtgttgagctatgctcaggttttgcagaacatgttagactattttggagccatgtcaagtcgtactgtagcatgctgtgccatgttaggctgtcattgctgcactgtgctgctatagcctggtctagtctcctctctcctcccacatcctctcttcttcctctctctttggccctcttcctgctatgtggggcttggaggggagaagtgcaaacctctagctgggagccttcccccaaccccaaagtccctcctttacccacctccatggcccctgattgtccccattcatgtcagccaccattgcaccaaaggacaaggtcttctacagcttcctgaagccctggctgggggagtatctgcaggtgaacagggttgggaaataagttgggggaccaggggaggaagatgaccttgcccatggcccttggctgccctgctaagggatgggttcctgctgagtgctggtgacaagtggagctgccaccgtgggatgctgatgcctgccttccatttcaacatcctgaagccctatatgaagattttcgatgagagtgtgaacatcatgcacgtgagttatttgaagctaaggtcctagctgcagacttggggtggagggaccacagacagatctggtgtagaattttggctctgctgggtggcattgggccattgttcttcctctctgatccctagttttgttttgtttttttttaatctgtaaaatgggtataataatccctacttaaaaggtggtcaaggtgatgtaatggagtcatgtccctggtgcatagtaggtgcccagaaggtgtctgtttctatgattctgtcacccaagccctataaaatcaagagggtcatgacgacaattgcacagtagctgttgctgataagaaaccacttgaaaactcattggtttaaaacaataaaggtttatgaatgttaataagtctatgggacagttggcaggtccttctctatgtggaagggatcagtcatggtacatgagcaa

SEQ ID NO: 11875 - DNA, 107925 bp, Human
ttagagaccagcctgggcaacacagtcagaccctcatctaaacaaaaaaaaacgaacaacagcaacaacaacaaaaaacagaaagaaaagagaaaaagaaaaaaatatttgttctgggaaaccagttaccaatccatactgtcgactatcagctgaaagtcagagtctaaaattaactctaagtaggcattttttttttcttttgtcatacattttaagtaaatccttttttttcctttaaaagagtcctcaccgccaggcatgattgctaacacctgtaattccagcactttgggagaccgaggtgtgtagatcacttgaggccaggagtttgagaccagcctggccaatatggagaaaccccgaaagtaaaagtacacacacacacacacacacacacacacacacacgcaagcaaaattagctcggtgtggtggtgcgtgcctgtatttccagttgctcaggaggctgaggcaggagaatcgcttgaacccaggaggcagagatcacaccactgcactccagcctgggcgacagcacgagactctgtaggaaaaaaaaattccagttgagatgctttccagggcgctagtcaagccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagat

SEQ ID NO: 11876 - DNA, 27463 bp, Human
  misc_feature (1)...(27463): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcctgtaatcccagtactttgggaggccgaggcaggaggtatcacctgaggtcgggagtttaagaccagcctgactaacacagagaaaccccgtttctactaagaaatacagaattagccaggcgtggtggtgcatgcctgtaatcccagctattcgggaggctgaagcaggagaatcgcttgaacctgggaggtggaggttgcggtgagccgagatcctgccactgcactccagcctggtcaacgagagcgaaactccgtctcaaaaaataaacaacaaaaaatcccaaaaagacggtcttattttggtcctcaccatgcatgtgagaagagtgagggacttgtgccaccgttttacaaggtaaggccaagcctggtggagttacgggaaatgccgaggtcctttggcaagaggtagcctggattcagacacagatctgattcacagcgcagggccttgtagaatgagaacgtttttgatttggtatctccctcctattcaccaaaacaccctcagtgcatgaaatgcatgaaatatgaaacaccagaaactaaaaagggggagaagccagggcggatgtcccagctgcaggagtgggagccgctgctcgtgtgtttggggtctgttctgattctggagcctgcttcttccccttggcaatcatgacccaggacttggcgttatctgtgatcgcgtgggtaggattccctggcgggcgtggggatgtgagatgggaacagagctttctgtccctgccacaggaacatggcgctgctctgggggctcctggtgctcagctggtcctgcctgcaaggcccctgctccgtggtgaggctgggctgaagtcaaggtggggtggggtggaggggcaaaaaaaaacacgttgcaaaggagcaagagcgtggcgccaaggccaccacataggctcatacctttctccacagttctcccctgtgagcgccatggagcccttgcgccggcaggtactggggagtgaggagcctgtgatggggggaaggtcccgggggtctcacttggtggcttgggcagggaggggggcctgtgggaagggtcggtctccatctgcttgctcctttccgcagctaactagcgggccgaaccaggagcaggtgtccccacttaccctcctcaagttgggcaaccaggtacaaccaggtggggctggggaagagtgggcggggctagagggaggagggcccatcggcaggggtcggggggtgggggcgcgtgctgaggctgaggctctggagtccagaggccagaagggagagagggtggggaggaccgaaggtgggcgccaggccccagaatgccagtgccctccgtctgacgctccctcttccctggggctgggacaaggccctgctgtcctcaggcacaggggctgtgacaaggccttcaacacagaacctggagctgaccccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccaatggttctccgcgggcggttcctccaccagggtcacgtggctgtttggtaaaaatgcagattcctaggccggggcggtggctcacgcctgtaatcccagcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagttggaggttacagtgagccgagatggcgccactgcactccagcctgggtgacagagcaagattccgtctcaaacaacaacaacaacaaatgcagattcctgggcccccacccatctgtctatgtgaatcagatctcagggactgggccggggaatctgcttatttacaagtcctcctggtgattttttttttttttttgagacagagtcttgctctgtcacccaggctagagtgcagtggtgtgatctcagctcactgcaacctctgtctcccaggttcaagcaattctcctgcctcagcctcccaaatagctgggatcacaggcaccagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgtggggggtgaggtcacccagcctgtcagccacaggggtgagagccacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggtaggcgctgatggcagggagctccctcagtcctgccctgggtggaggagggtgagagcaaggggctgggcctctggtagcgagtaggggcgtgtctggctgtggagcctggagccctgggaacagcttgtgctgcctccgtgcaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtgcgctcctcctcctctcagatcccccaccctgtaggctgagctgggacgtgcaggcctttttgttttttgagacaagtctcgctctgtcacccagggtggagcgcagtggcgcgatctcggctccctgcaacctccgcctcccggattgaagcgattctcctggctcagcctccccagtagctgggattacaggcatctgccaccacacccagctaatttttgtattttagtagagacagggtttcaccatgttggccaggctggccttgaactcctgacctcaggtgatccacccacctcggcctcccaaagtgctgggattacaggcgtgagccaccgcgcccggccatgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggtctgaaaagatgcaggaggggctgggcgcggtggctcacgcctgtaatcccaacactttgggaggccgaggcgggcagatcatgaggtcaggagatggagtcccatcctggctaacacggtgaaacccccgtctctgctaaaaatacaaaaaaattagctgggcgtagtggcgggcacctgtagtcccagctactcgggaggctgacgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacaggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtcacccttggttgtccagcaggctgggcctgaggctgggaggtggggaagggagtggacaggctgtggagcaggcacagggatgggtggaggctgtctcgccttccttgcctccacgtcccctaggcaggcaactgcaaaaggtcccatgatcccccatcctacctggcaggaggactgaggctccaggctctttgaggtttagtaattcagtgaaaatatactgggcatttgctgtgttccagatactgttctaagcactagggtttttgtggagcatgagggaggccaggtctctgctcttaggaaggaggatacacagtgcaacagtgaatggacatcaacacaggaattccagacgctgggaagcgctgtggagggaaagctgaaaaagaaggtgattttggccgggagcggtggctcacgcctgtaatcccagcactttgggtggcccaggcaggtggatcataaggtcaggagtttgagaccagcctggccaagatttgaaaccccgtttctactaaaaatacaaaaattagccaggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggcgcctgtaatcccagatactctggaggctgaggcaggagaatcacttgaacccgggagacggaggctgcagtgggctgagatcgcaccactgcactccagcctgggagacagattgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagggcccatggactttggggcagcacagggaccaccccacggccatgtagccactcagggtctctgcagcccccagcctgggagattccacggggcgctcacacagtgctccttagaaaggaggatctgattggattggatttctcagcatcttgcgtggaacattctgattggataaacttcttttttttttttttgagacagagtcttgctctgtcaccccaggctggagtgcagtggcacgatctcggctcactgcagcctctgcctcctgggttcaagccactctcctgcctcaacctctcgagtagctggaactacaggcatgcaccaccacgcctggctaattttgttcgtttgtttgtttgtttttgagacggagtttctctctatcgcccagactggagtgcagtggtgcaatctcggttcactgcaatctctacctcccgggttcaagggattctcctgcctcagcctcccgagtagcttggactacaggcgcccgccaccatgcccagctaatttttgtatttttagtagagacggggtttcaccatattggccaggatggtctcaatctcctgacctcgtgatccgcctgcctcagcctcccaacgtgctgggattacaggtgtgagccaccgcgcccggccaatttttgtattttttttttttagtagagacaggtttcaccatgttggccaggctgatctcaaactcctgacctcaagtgatccgcccgccttggcctcccaaagtgctgggattataggcaggagccactgcgcccagctctgattggataaaattccgtgccaggctgtctcaggtgtggcctctcttgcttctagcctaaatgtggtccccttggcctgggtattgatccccgggccagacagctgtggctgagatggctgtatttgttagcttcccaaggcaagtgtgacacagagcacagccgcttctgcagggaggagccagaagccacttgggcagccctcctgggagggggctgtgggtgaggctggcccgggaacgcgtcctggcttccctgcagctcattctgaaaggccagtctgatccacctccccgaggctcccctttcctgcttcccctttcctccaggctgtgtcctgcgtactcttccttcatccttcgtctcctttccttaggccccgtcagcctttcttgtcctcaggccctctgcagacaggcccaaacagccagaacccggggcttatcctcccacgggcaggggttctccacacgggtactctgcctggaacccaaggagtcacagctgcaggaggccctcgagccctgtggtgtccacactgcttttgctgcagaatcccttcaaatcaaatcttaatggctgggcacggtggctcacgcctgtaatcccagcactgtgggaggctgaggcaggtggatcacctgaggtctggagtttgagaccagcctggcccacatggtgaaaccccgtctctactaaaaatacatcaattggccaggtgagatggtgagcgcctgtagtcccagctactcgggaggctgaggcaggagaatcacttgaacccgggtggcagaggttgcagtgagccaagatcatgccactgcactccagcctggacaataagagtgaaactctgtcttgaaaaaaaaaaaaaaagaggctgggtgtggtttacaggctcatgcctgtaatcccagcactttgggaggccaaggcaggtggatcacgaggtcaggagattgagaccatcctggctaacacggtgaaaccccatctcttctaaaaatacaaaaaattagccgggcgtagtggcgggcacctgtaatcccagctactcgggaggctgaggcagaagaatggcgtgaatccacgaggcggaggttgcggtgagccgagattgcgccactgcactccagcctgggcgacagtgcgagactccaactcaaaagaaaagaaaaaaaaagaaatcttaagccaaatcacaatatatttacacagctggcaaagtcacaagagggaggtgagggagggtggggcgggcagcactcggcagtggctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaacctctgcctcccgggttcaagcaattctcctgcctcagcctcccgagttgctgcgattacaagcgcccgtcaccacagaagcccagctcatttttgtatttttagtagagatgaggttttgccatgttggtcaggctggtcttgaactcctgacctcaggtgatctgcctgcctcggcctcccaaagtgctaggattacaggcgtgagcccccatgcccggccacactgctagaaactttaaaagcatctcattcggttacgtgtccgcctgcagtgggacaggtagtatgactccaccccactgtgaggaagtggaggagcagtggggtcagtcacacgcctggcaggatggccaggagccccattgtctgccttaggagcacctgctggccccacccccacttagcttcggggctttctgtcctcatgctcttcccttcccttttctgtaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggtaaggaggagggtgcgggcgagcccccgaggtcaggctgggcagggcgggtaaggaggaagcgtctggctggcagtggagctgagtcagagctgtcctgtgtcctgctcttttccagggcttcgggagcggggagagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgctgggtggagtggctcatgcctgtaatcccagcacgttgggaagctgaagtgggtggattgcttgagcccgggagtccgacaccagcctgtgcaacacattgaaactccgtccctacaaaaaatacaaaaattagccaggtgtggtgcatgctactggggaggttgaggtgggaggccctcttgaccccaggtggctgaggctgcagtgagccataattgtgccactgcactccagcctcagcaaaagaactaagaccttgtctcaaaaataaaaataaaggccgggcatggtggctcacgtctgtaatcctagcactttgggaggccaaagagggtggatcacctgaggtcatgagtttgagaccagcctggccaacatggccaaacccgtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggcaccgggagcccaccatgtacaaacagctgagtctaatggggtgggcagacgagcaatcacatacttactacagcataagcgataagacagagagggcttctctccagctcacctgggagaacactgaaaatgtaccttggttggactttagagctggggatcagggaaggcttcctggaggaggtggtgtttaagctgagtcttggaaaccggataggaatgaagcaggtatctgtgagttcaagctgttccctggccaggatctcagacaccctcccaagcagctccaggagcctgtgaggccaagggcagctctgaccagccatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggctggtttgatgtcaccgttctgggcatgggtggggacaagtgaggatggtggggaaggcagggaggcggccgcagggtggactgtgctgaggaaccctgggcccagcaggggtggcagcccgcgcagtgccacgtttggcctctggccgctcgccaggcatcctccaccccgtggtcccctctgacctcgccagccctcccccgggacacctccacgccagcctggctctgctcctggcttcttcttctctctatgcctcaggcagccggcaacagggcggctcagaacagcgccagcctcctggtttgggagaagaactggcaattagggagtttgtggagcttctaattacacaccagcccctctgccaggagctggtgcccgccagccgggggcaggctgccgggagtacccagctccagctggagacagtcagtgcctgaggatttgggggaagcaggtggggaaaccttggcacagggctgacaccttcctctgtgccagagcccaggagctggggcagcgtgggtgaccatgtgggtgggcacgcttccctgctgggggtgcagggggtccacgtggcagcggccacctggagccctaatgtgcagcggttaagagcaagcccctggaagtcagagaggcctggcatggagtcttgcttcttgcaaacgagccgtgtggagagagagatagtaaatcaacaaagggaaatacatggtctgtccgaggatgagctgccggagagcaatggtgaaagtgaagtgggggagggggcggggctgggaggaaaagccttgtgagaaggtgacacgagagcacggccttgaaggggaagaaggagggcactatggaggtcccggcgaagcgtggcctggccgaggaacggcatgtgcagaggtcctgccgaggagctcaagacaagtaggggacggtggggctggagtggagagagtgagtgggaggaggagtaggagtcagagaggagctcaggacagatcctttaggctctagggacacgataaacacagtgttttttgtcttgtcaagtgtgtcctttttatttttttgaaagagtctcgctctgtagcccaggctggagtgcagcggtgcgacctcggctcactgcaacctctgcctcccgggtccaagcaattctcctgcctcagcctcccgagtagctgggattacaggcacccgccaccacgcactgctaatttttgtattttagtagagaccgggttttgccatgttggtcaggctggtctcgaactcctgacctcaggtgatccgcccgcctcggcctcccagagtggtgtgagccactatgccctgcagcacttgtcaagtctttctcagcgttcccctcctctccactgcagctcccagtgccccagtctgggcctcgtcttcacttcctgggatccctgacattgcctgctaggctctccctgtctctggtctggctgccttcactgtaacctccacccagcaggtacctcttcagcacctcccatgaacccagcagaataccaagccctggggatgcagcaacgaacaggtagacgctgcactccagcctgggcgacagagcaagactccgcctgaagaaaaaaaaaaggaccaggccgggcgcggtggctcacgcctgtaatcccagcactttgggaggccgaggtgggtggatcatgaggtcaggagttcaagaccagcctggccaaaatggtgaaaccccgtctctactgaaaaatacaaaaattagctgggtgcagtggcgggcgcctgtagtctcagctactcaggaggctgaggcaggataattgcttgaccccaggaggcagaggttgcagtgaaccgagatcacgccactgcactccagcctgggcgacagagcaagactctgcctcaaaaaaaagaataaaaataaaaaaaaggaccagatacagaaaacagaaggagacgtactatgaaggaaattggagagcttttgggatactgagtaactcagggtggcctttcccaggggacatttagctgagagatagacggtatgaagacctgaccgttcagaaacaggggaagaggcagcagcccgggcaaaggcctttggggcaggaaagggcttggatcactggagaagcagaaagatggccagtgtgaccagagtgtgacaaagtcagagaaaaccaggaagatggagctggagacacaggcggggccagatcacgagggtccttgcagaccagagcaagggtttggattttattccaagtatgaagggaagctgctgaagtgtgttttcctttacaatttgtagttgaaatataatatgcaaagtacacaagtcttaactatatgtaagcttaatgaatgtttccatgaaccaaataccgctgtgcaaccatcaccagctcaagagacgaacccttctccctcctcctgactgccagtaacatagtggttcagctcaagaaacagaactcttctgacttcccctaacatagcgggttttcttttttgttttgttttttgttgttttttaagagacaatgtctttattatttttatttttttttatttttgagacggagtcttgctgtcgcccaggctggagtgcagtggtgcgatctcggctcactgcaggctctggcccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagttcgcggcagccttgacatcctgggctcaagcaaccttcctgccttggcctcccaaatgttgggattataggcatgagccactgtgcttggcatctattcatctttaatgtcaagcaggcaattgaatatttgatcagggatagaattgtctatttgggggtatgcagatgtgcttcatgtcatggaactgggccgggcgcggtggctcatgcctataatcccagcactttgggaggccgaggcaggcggatcataaggtcaggagatcgagaccatccgggccaacacggtgaaaccccgtctctactaaaaatacaaaaattaggcaggtgtggtggtgcgtgcctgtagtcccagctactcagggaggctgagacaggagaattgattgaacctgggaggcagaggttgtagtgagccaagatcgcgccactgcactccagcctgggcgacatgagcgagactccgtctcaaaaataaacaaaaaaaagtcatggaattgatggaaattgcctaaggggagatgtagaagaaaaggggtctcaggatcaagccagcagagaaggcagaaaaggtaaggtgtgtgaggtggcagaaaaagggaagagtgtggacagtgagggtttcaaggaggaggaactgtctactgcctcctgccaaggacggaggtgtccactgccagttgacataaggtcacccatgaacttggtgacaggaatttcagtggagaagtggccacagacacaagtctagaattgaaatgggagccgaggcagcgtagacaaaagaggaaactgctccttccagagcggctctgagcgagcaccgagaaatgggcagtggctttaggggatgtagcgtcaaggaagtgtcttttaaagaagtcgggggccgggcacggtggctcacgcctgtagtcccagcactttgggaggccgaggcaggcagatcacttgaggtcaggagttcgagaccagcctggctaacacgatgaaaccccgtctctactaaaaatacaaaaaattagctgggcacggtggctcgtgcctgtaatcccagcactttgggaggcagaggtgggcagatcacttgaggtcaggagtttgagaccagcctagccaacatggtgaaaccccatctctactaaaactacaaaaattagccgggagtggtggcacgtgcctgtaatcccagccagtcaggaggctgaggcaggagaatcactggaatcctggaggtggaggtggcagtgagccgagatggtacctctgtactccagcctgggggacagagtgagactccgtctcaaaaaaaaaagaaggtggggaaggatctttgagggccggacacgctgaccctgcaggagaggacacattcttctaacaggggtcggacaaaagagaactcttctgtataatttatgattttaagatttttatttattattattttttatagaggcaagcatttttcaccacgtcacccaggctggtctccaactcctgggctcaagtgtgctgggattatagccatgagtcaccacacctggcccagaaactttactaaggacttatttaaatgatttgcttatttgtgaataggtattttgttcacgtggttcacaactcaaaagcaacaaaaagcacccagtgaaaagccttcctctcattctgatttccagtcactggattctactcttgggatgcagtgtttttcatctcttttttgtatccttttggaaatagtattctgctttaaaaagcaaatacaggccaggtatggtggctcactcctgtaatcccagcactttgggaggccgaggcaggtgatcacctaaggtcaggagttcaagaccagcctggccaatatggtgaaaccctgtctgtaccaaaacacaaaaacaaaaacaaaaacaaaaattagccgggcgtggtggcgtgctcctgtaatcccagctactcaggaggctgaggcaggagaatcgcttgaacctgggaggcagaggttgcagtgagccgagattgtgccactgtactccagcctgggccacagagcaaggttccatctcaaacaaaacaaaacaaaacaaacaaaaaaacaaaacaaaagctaatacaaacacatatacaatagacaaaactgtaaatattttattatttttattttttttagtagagacagggtttcaccatgttggccaggatggtctcaaactcctgacctcaggtgatccacccacctcagcctcccgatagttaggattacaggcatgagccaccacacccggcctaaaattgtaaacgttttagaagaaagtatagatgaatcccttcgtgatctcggggaagaagagattttttaaaaaagataccaaaagaagcacaaattataaaagaaaagattgaaaatgttggtgttaaaattaaaaacttgttttaaaacaagcttgtgtaacccatgacccacaggctgcatgtggcccagaaaagctttgactgcagcccaacacaaattcgtaaactttcctaaaacattatgagattttttttgagattttgttttgttttgttttttgtttttttagctcattcggtatcattaatgttagcatattttacgtggggcccaagacaattcttcttccaatgtgtctcaggggagccaaaagattggacacccctgccataaacatgaaaagacaatggccgggcacggtggctcacgcctgtaatcccagcactttgggaggctgaggggggcgggatcacctgaggtcaggagtttgagacaagcgtgaccaatgtggtgaaaccctgtctctactaaaaatacaaaaattagccgggcatgctcgtgcacacctatagtcccaactactcagcagggtgaggcaggagaacctcttgaacccgggaagcggaggttgcagtgagccgacattgcacccctgcactccagcctgggtgacagagtgagtctccactggaaaaaaaaaaaaaagaacagtgtgatacattgacctaaggtttaagaacatgcaaactgatactatatatcacttagggacaaaaacttacatggtaaaagtaaaaagaaatgtacgaaaataataaaaatcaaattcaagatggtggttatggtgacgggaaagaactgaggcggaaatataaggttgtcactatattgagaaatttttctatctttttttcttttttctttttttgagacggggtctcgctctgtcgcccaggatggagtgcagtggtgtgatctcagctcactgcaacctccgcctcccaggtttaagtgattctcctgcctcagactcccaagtagctgggactacaggtgcgcgccaacacacctgggtaattttgtttgtatttttagtagagatggggtttcaccgtgttgactaggctggtctcgaactcctgacctcaggtgatcccccggcctcggtctcccaaagtgctgggataacaagcgtgagccactgcgcccagctttgtttgcatttttaggtgagatggggtttcaccacgttggccaggctggtcttgaactcctgacctcaggtgatgcacctgcctcagtctcccaaagtgctggattacaggcgttagcccctgcgcccggcccctgaaggaaaatctaaaggaagaggaaggtgtgcaaatgtgtgcgccttaggcgtaatggatggtggtgcagcagtgggttaaagttaacacgagacagtgatgcaatcacagaatccaaattgagtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggtgagtggatgagagagggcagagggagctggggggacaaggccgaaggccaggacccagtgatccccaaatcccactgcaccgacggaagaggctggaaaggcttttgaatgaagtgagtgggaaacagcggaggggcggtcatggggaggaaaggggagctaagctgctgggtcgggtctgagcagcaccccaagactggagcccgaggcaaggaggctcacgggagctgcttccaccaagggcagtcaggaaggcggccgccctgcagcccagccctggcccctgctccctcggctccctgctactttttcaaaatcagctggtgctgactgttaaggcaatttcccagcaccaccaaaccgctggcctcggcgccctggctgagggctgggatggaggacagctgggtccttctagccagcccccacccactctctttggctacgtgagtcaaggctgggcgaccaatgaggttgtggcctccggcaaacaatgaccactatttaggccggcaggtgtatagggcatgggggcccagctgccagtgctggagacaagggccgtccgagatgaaccctttctgctgcctgccaagccactgggaggggtaggtctcagcaggattcccagaaaccccgcccctgtccagcctaggccccccacccggtgttagctaacccaacgttagcccccaggttccgtggggttggggggcagggagtcctattcttggggctgctgcttctggggtgtggggaagtgcaactccacggcaccctgggctgactcattcagcttctaaagcttcaggaaacattgtttggggctgggtcaccatgggtgggccagagaggacccctcaatcccctccggagagccaggggagggggaggtgcccttccccatgctatctccgaggcccactgccatgtggctgaaggctgtgcggttctgggaagagggggaggtggcggtggaggctgtttgtctcctaactgggcttaatctgaaacacatgtattggcttgagttgatccgcctcacgtggaggcaagatcacaaaagcttctgtgtttcttgatgtgggcaattgtcagaaaataaggcctgaccttggcccagcagggagggtatctacctctccctgagccctcccccgcctgctaggacgagagcggggcttggatactgccctttggacaggatggcatcattgtctgtggctgcagccagccagcggtcgcctgctcagcccatgagcaaccactgtggacagggtattgcgtgtgtgctgaggggcgtccatgcagacccccacgcttgccctctcactgcccttgtagggttttcaatcatctctcctcttcccttatccagatggcttgaagtggaggattcagacttgccgttaatactctgggtccctgtgtctagctcggggccacctttggacccatgtcccttccctgccaggctccctcacctcacctcagcctacccacattgtgacaatcatctaccacctgatctggggtttgggcttagattctgtaggcaccaagactaaagtcgctccttcaagtccatttgaattgtgactttagtttccttaaatactatgccaggataatggccagggatggtggctcacgcctgtactcctggcactttgggatgctggtggatcacctgagatcaggattccaggccagcctggccaacacggtgaaaccccatctctactaaaacataaaaattaaccaggtgtggtggcgggcacctgtaatcccagctactcaggagactgaggcaggagaattgcttgaacccgggaggtggaagttgcactgagctgagatcgcgccactgcactttagcctgggcgacaagagtgaaactctgtctcaaaaacaaaaaaaactatgccgggatgagcctgtctcctcccttaatttcttacttgggccagaggaactagaactaacaacttctcttctagccttgcctcctgtgtacctcactgaatttttggtctctaataaaccagtctgcagaggctcaggggaggcaggctcctggcagctgggtggggctggccccagccgggtggagaccagctgtaggcctggatggtggtgaggcctctgtcttgcactgcagaaagcttttcctgttgtctacacgaaagttttctccctgcatgtcagggcagccacgtgcaagagcagctggctgggaacgcagaggtctgcggctcgaggcggggtttagaaagaaaaccaggctgcttcctgctgcccgtcctgccttaagctgagtaaactcaaaggcaatcttctttcatgcctcacgatattgtccagtggattatctgatttaatttgaaggacgagagccaacaatcacacaacgtcctcccaaattttctgatccactttgttctgggaagtcaaaaagtgcgtgtgctgtgtgggtggatgtttgtgtatataaatggataatgaaggatgatgtgttgggggccagggcaggggagacaacgctgttcagattctacatttttttttccttttttttttttttttgagatggagtcttgctctgttgcccagcctggagtgcagtggcgcgatctcagctcactgcaacctccacttcctggattcaagtgattctcctgccttagcctcccaagtagctgggattacaggcatgcgccaccacacccggctaatttttgtatttttagtagagatggggtttctccatgttggccaggatggtctcaaactcctgacctcaggtgatctacccgcctcggcctctcaaagtgctgggattacaggtttgagccactgcgcctggcctttttttttttttttgagatggagttttcactcttgttgcccaggctggagtgcagtggtgcgatcttggctcactgcaacctccacctcccaagttcaagtgattctccagccttagccctccaagtagctgggactacaggtgtgtgccaccatgcctggctattttattttattttattttatttatttatttttgagactaagtcttgctctgttgcccaggctggagtgcagtggcataatcggctcactgcaacctctgcctcccaggttcaagtgattctcctgcctcagcctcctgagtaactgggattacaggggcctgccaccacgcctggctactttttgtatttttagtatagatggggtttcaccatgttggccaggctggtctcgaactcctgacctcaggctatccgcctgcctcagcctcccaaagtgctgggattacaggcatgagccactgtgctcggtagttgttttattttaatagtaggttattttatttccattttacaagagaaaaaatggtgatttaaagagctactaagacacagcactgagaccatgtgtgatggcatgcgcctgcagtcccagctactcacgaggctgaggcaggaggatcacatgaggtcaggagttccaggctgtggagtgctatggttgtgtagtgaatagccactacactccagcctgggcagcacagcaagatcttgtctcccaaaaaaaaaaaaaaaaaaaaatttcaaatgtgaacccaggatctctgaccctaggccctgcactcctaaccatgggaggaagagctcttgaaagggaactgtgggagaagggaatgagctgccttgtgaggccacagaagtccaaagacagcttgagaatttggagggacagcacgtgccggactgggtgcctctatgcttggtatccggtgattccatggaggagacctgggttctgccccattctcctgggaggggttgcccaaagtcttatcaccggagtgggtcagctgcctccaggacaaagctttagcatacacttgtgctgggccatactccacgtggagaagccctgctggggctggggccccactgctctggatctttaaaagctattggttcaggggccaggtgtaatggctcacacctataaccctagcactttgggaggctgaagcaggtggatagcctgaggtcaggagtttgagacaagcctgatgaacgtggtgaaaccccatcgctattaaaatacaaaaaattagccgggcatggtggcaggtgcctgtaattccagctacttgggaggctgaggcgggagaatcgcttgaacccaggaggcggaggttgcagtgagccaagatcgctccactgtactccagcctgggcgacagagccagactctgtttcaaaaaataaaatataaataaataaataaataaataaataaataaataaataaataaaagctttaggcttaaaggagggtcccctgacgcagacagtggaacaaaagcacaagcttatggtatgactgtgggccctgaggcagggggaggggcgggagaaccttgctgggagggatgggccatcaagctgagggtccacttctgggggcctggaggggtgaggggtggtcgctgcagggggtgggggaaagtgactagccctgcccaacccctgggtcctggctggggtggccaggaaggggtagcggggcagtgcagtgtcgggggagagcggcttgctgcctcgttcttttcttgcaggccccaggatgcaggccctggtgctactcctctgcattggagccctcctcgggcacagcagctgccagaaccctgccagccccccggaggaggtcagtaggcaggcggggagggcgtggtcagcattccccgcccctccttggcaggcagcacgggaaacaggacagggaacccggacccaggttccaggccaggcttgggcctttatttctctagggctggagtttctccagcagcaaaacagagagaaaatgtcttgccttgcctttcaggggatggagtagggacatgaataagatcccaaaagagtaaaaatctgaagcacttttaacaagtccagggcaattctcctgcctcagcttcccaagcagctgggattacaggcatgcaccaccaagcccggctcattttgtatttttagtagagacggggtttctccatgttggtcaggctggtctcgaactcccgacctcaagtgattctcctgcctcggcctcccaaagtgccgggatgacaggtgtgagccaccgcacctggccaggatcttttctcattaccttgtcttcctagtgggggctccactgagcaggtcatgttcccggacatttgttcggatactgaccaggctgtggcagggagtgagggtatggagtgacctctctcctgcccagaaagggcgcagctgggttcccaaggcagatacaggcacatggagggaagcctgggccatatgagtgttatggggtgagtgttggcggaggcccacccttgagggacaagagcagctgggcatcttggcgagagccctggactttcgtgaggtcagagtatgaattctgcgtctccctcttcctagctttgtgaccctagacaacccttacctcagtctttgcttccttgcctatgaaatgggataaaaacacccattctacagggccatgtggccactcatttatttctcatctaccaaacacctactcgacaggggctggcaatgggcggaaataaaaactcagttctgccgggtgcggtggctcacacctgtaatcccagcagtgtgggaggcggagcaggacgatcccttgaatccaggagtttgagaccagcataggcaacatagtgagacccctgtctctacacaaaagcaaaaattaccaggcgtggtggcaagtgcttgtggtactacctacttgggaagctgaggtgggaggatcacttgagcccaggagattaagactgcagtgaggggccgggcgcggtggctcacgcctgtaatcccagcactttgggaggtggaggtgggtggatcacgaggtcaggagatcgagaccatcctggctaacacggtgaaaccccgtctctactaaaaatacaaaaaattagctgggtgtggtggggggcgcctgtagtcccagctactcgggaggctgaggcaggagaatggcgtgaacccgggaggtggaggttgcagtgagctgagctcgcaccactgcactccagcctgggcgacagagtgagactccgtctcaaaaaaaaaaaaaaaaagaaagaaagaaaaactgagttcttttttttaactttctttttttagagacagagtctcactccatcacccatgctggagtacagtggtgcgatcttggctcactgcaatcttggcctcctgagttcaaccaattctcatgcctcagcctcccaaatagctgggaccacaggcacgttccaccacgcccagctaattttttgggtatttttagtagagatggggcctcaccatgttgctcaggttggtctgaaactcctgagctcaagtgatccatcttcctcggcctgccaaagtgctgggattataggcataagccactgcacctggctcccaatttttatatttatatttatttttatttacttatttattttttgagacagggtctcactctgtcacccaggctggagtacagtggcactatctcagctcactgcaacctctgcctcctgggttcaagcgaatctcgtgcctcagcctcctgagtagctgggattacaggcatgcaccaccatgccccgttaatttttttgtatttttagtagagacgggtttcaccgtgttgcccaggatggtctcgaactcctgacctcaagtgattcacccacctcagcctcccaaagtgctgggattataggtgtgagccactcggctgatggtttttaaaaagtgggtcatggggctgggcgcggtggctcatgcctgtaatcccagcactttggtagaccgaggcgggtggatcacaaggtcaggagatcgagaccatcctgcctaacacggtgaaaccccgtctctactaaaaatacaaaaaattacccaggcatggtggtgggcgcctgtagtcccagctactcgggaggctgaggcaggagaatggcgtgaacctgggaggcggagcttgcagtgagccgagatcacgccaccgtactccagcctgagcgacagagcgagactccgtctcaaaaaaaaaaaaaaaaagtgggtcataggtttcggcttataggtcacaagtgtttaaacctggccatgaggccaggcgcagtggcgcatgcctgtaatcccagccatttgggaggctaaggcaggaaaatcgcttgaaccggggaggtggaggttgcagtgagctgagatcgcgccactgaactctagcctgggtgacacagtaagactctgtctcaaataaaaaaaaaacagctgatctctcttctgcgctgtctctccacagagagctcatgcgtgatcagggagtaaaactcattcccgttttaggccaaacacagaaaaattaggaaggacagccccaaggggccagaaccaccaccctacacaaagccgtgaggagacagtccctgtgcatctctgcgagtccctgaactcaaacccaagacttcctgtctcctgccagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggtgagtgctcagatgcaggaagccccaggcagacctggagaggccccctgtggcctctgcgtaaacgtggctgagtttattgacatttcagttcagcgaggggtgaagtagcaccaggggcctggcctgggggtcccagctgtgtaagcaggagctcaggggctgcacacacacgattccccagctccccgaaaggggctgggcaccactgacatggcgcttggcctcagggttcgcttattgacacagtgacttcaaggcacattcttgcattccttaaccaagctggtgctagcctaggttcctgggatgtaactgcaaacaagcaggtgtgggcttgccctcaccgaggacacagctgggttcacaggggaactaataccagctcactacagaat

SEQ ID NO: 11877 - DNA, 95566 bp, Human
tttatacgagtctcacagcacagatgttgtgactcttaacagagaaggaagaatgtcaaaataacctgaaattattagtggacttttggagtttaaacacacacacacacctgtgatgcagagaagccggtaagcattcatgaggggaacgggggtttgggagggcaggaagccaggttgtagctctccaagttcttaaagatactggagaaccaaggaagcaagaagtcaagttcaaggagtttggcaattgcaggtttggctttctggagacagatctggccaaaacaccagccattcctagcagagtccttggactcagaggactgatgctgtttgctttgtgcctagttttatgaagctgtacttgccacacatgaaaggctgttattaaggaatccatcttttagctttttttttccccttcagactaaataaaccttatttcattcttctcacaggtcatagtttccacttctttaattatttgttactcttctcagaactttctccagttttcctcttcttttaaaaaactgagaccaaaccttcaaaacagagtaataactggcttagttctgggcacaggaaatgattctttctaaaatgtcacatcccaggcaagatttctttgcagggttttccacctgtttttaatgctatcaagatgaaagcattaagttcatgttatcttgatatgttaattttagacaaaacgtgatcataatggaacacatttttccataattttctgtcttaatttcaaaggcccagagttataacgggtgttgtctcgattctgtttttttctaatttcacgaaaatttaggcaggagattccagaatggtagcagtttggttctctttctcctataaaatagcttatgtcattaaatgtatgaggcaaaactgtcaagcttttttcttaattgtgcttttgctcccactcattccaacaagttaaacccttggctagttaaaatgtgagaacagaaaaaagggaattttcttagacatcagtcaaaagtggaagcagtgggggccaaggctcagagatctcgacctctccgaccacgtctttgggagtaattttccatgcggactggagcacgatcttgtaagcacagccccggcattacacacgttgggctccgattccgcaggatttacaagcctcattactggaaagagtctaaggctctcttggcacaagcggcggagcaagaaatgttcactggacaataaaactttcggtttacggagtaaaataaaatcacggccttccttttacagggtgatgaacctgcccctgaattaatgaggggcgatccatttccatggcttaagagtctggcgaggtcccagtcagccaagattgccgcagatttgcagtcacttcagactgggtggagtatccaagtccatagaagagcaaattctcacccttcgaggctgctgtggaagctaccggggctgggacagcagagaggaacccagacgggaacaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggctccgcagcgccccgggctgctgctccgtgcctccaccgacgacctcactcagctgcgttacggccgctccggtgccggcgcgcgccttgcccgccgctcccgcccgcaatcggcggctcagggcggacccgggtctctgcgttctcgcgagaagcgcggcgctgcggggccgtgggcgcctgagcccagccagcctcgagggccgaatatggggggatgcacggtgaagcctcagctgctgctcctggcgctcgtcctccacccctggaatccctgtctgggtgcggactcggagaagccctcgagcatccccacaggtgagcagcccccggtccgccgctgtctcgcgaggctcggccggcgggagggcagttcattcatccaacagcccttgcgcggggctggccaggtgagtagtgggggcctgtccctcctctccaggaccgccggggtcttccccagaattgcggtcgggcggcgctggtccctggggaagtgtaggggcacccgccctcgttgactccttggagttctcggtgaactcagcgtgcccgaatttccctgcagaacaagttggagtttccttttggacttgcaggtcatgggcaccaacacctttcctgcagctctcctttcccctcctttccgagagttggcatggatttatccttgatggacgaggcagtactccttctgtgacctaaacacggggcttagtgtactttctaattgatggtgacacattccttccagcaccccaggaagcagccggtaacacctccctcttgccaaaaacaacgctcgctcgaaaaccttagttgttttcagtaaggctgcctggctacccagtacctccaggcggcagctttcttcctttgggatctgaaggggaagctgtggacacacagctgctccccttacctacccttttcttgagcccggtgctgtctctcgttttcagaagctgtgtaaaacaaaacgttttatatttagccagattaaagagagtttcaccacgtctgtctaaacatgctttgctgccttttgtggcacatgaaaaatccttggagttttccacatttgtgctctttgtgctcaactctctgaaattagatcttgcatttaaatgaccttctaatgtcctttttgttttgttttgttttttgttaagtcatcttggcaccattttttcccccaagtttataatagagtgcttttctacttgaacttttcttaagcctaaggacagaaatttctatttcagagttacattcagaaagtgacatttggtttgcagtccagctaatccatgtagcgatagttttgtcttcatctttaagtgtttcagaaagcgtcagcaggctgaactgcctatctttctacaaaacagtgcttgctttgttagcttgagaaacttcagcattcagatggatttctatcagttacaggatgcttttctttctgttaggtatatgtgaccatttaaaaatggatttctgaacccgtgtgattcctctaaatttgaactaaacttttgcataatttaaaaatatttcttctaacataatatctggaaagtagaaagtaaatactttcagcaaatttggaagtagagaaatttaaaaaggaaaaacagaacaaaaagccttccccagaaaaatgtctttctttgttgaaacacccaaggagactttaactgggaaataaaataacctctaaggactttgtaatatttagagaggcctctttggcctttgtatattttattccacttcattgccaacacccctaactttttaatagaggacatccctttgtatctgcctttatatttatagtcaaaatcaaattcccttctcactctggattttaaatttcatggaactggacagtaaacttttaatggattgtgatatcagagaaagagaattttaggtatgaaagtttcctcaggaaacgaccacatgaaacccactgtttaaatctgaggactggtcacttggtaagcaggcatggagaattcggttagggtcgaaatgtgggaaaatactaatttgtgataggtgaagccagcagtagtcagtttgattacaaatttcggtgtaggtaggtgttctcataggttatgtgataaactaataaatgtagaggtaaactgcttgataaagtgggcagaatcatggactgtggtctattttattctttacaagtttcaactgaaaattactaaatagaagcttattcgttgacataaatatcaagatcttctataggaccctaaattgtctagcttaatagttctttaagaagagtgcttatcatctctaaccctgtatatttgtcaacatgtcccagctaaccaagaagaaatggtttaaatcacaatttcttggccctattgacattttgagccagacacttctttgctttgagggactatcctgtgcattgatgtttagcagtatccttaacctctgtgcactagatgccagtagtataacctttctaatctgagcaccaaaaaaacaaaaaaggcctaatgtccccagagggacaaaattgcccagggttaagaatccctggattagactaatctatttgtatttgaggcaatatggcattatagtgttactggaatgataacagcaaattatttttgaaaacaaatatttatagtgattttcagtttacccactgtagttgggaatgtgatacacattcatcaatttttggagtgtagtttttcctagctctggtgctttgttgaccagagttgagaacatagatttttgttaaatttttgagagttctgtgtgctgtattgattccttttggttgccactttattcttagcatggaaagactaaataagattttggctaaaataatcattttctctgaaaataacgtataggaattgttacctgaaaattatatccttatgggagctttcagaggcagaaccttcttaatcagtgccagtaaatcaggttcataccctgatttatctttcctgccctttctgccttctagatgggataaggagaaggtggatgtattcctgccaagtctttgccgtcatgtctccagacctggataaaatttgtgtgtgttttctgaggcaccttactattctatgatccaaactgggcagaaaccaagttttgggcaaaaacaaaggaaatggtttcaaatgtttctgtcaagaccagtatttttgtaccacattcattcatttataaactctctaatttactgtggtacattcaaggaaaaaaggaaaggtttgtccctatctactgatgcaaaccagcaatttatggggtggagaggaaaagagcaagggcctggagaaacctctggaagagagagggtcttgtcctctgtactttctgtattctgtgcttcagccacacagaatgacatatcatccataaacagactgtgccttttatttcacatgacaacagacatataaaactactatagagaatgtgaagacaagaaatgaaaattaaattgagctacccttttctatccaacacatgggacaaagcatcttaaaataaactctgattgtaccaaatgtcaggatgggaattgaccgttgatggaagcacagtgtctttggagaacaatttaataatatctactggaattgagaatccgcatgtcctgtaatcctagatatgtgcatgaatagcactctcaaatttctgttccttcctttttagttttttgaaatcctgtttattgtttaagtctagctcctaggaaattcttctcctggctatttttgtttggttctttttatttttaacttcttaatgtagctggtttatacaaatcatatttactttgtactataggtccttatgtttaataaattgtaaactcttcaaagtgaagggctgagttttattcatttttatgctcttcagtatctacactgttgttttgccacagacattctcaggttttgcttactgagtttctggcctgttctgagaattatgaaaagtagcgtgcagtcaatgaggttgctagtttcttcttcccccagaactttatctgaattcactgagcttcctttctctgcttgggaacccatatgctacatgatttaacagcttagaagtgaaatatctgctgccttgtttctgaaccatgtttggcaacccttctccacgggttgtatttcccgctttacctgctttactcaatacaaagtggcaccttcactattactttcaggtagttgggtgccataattttttttattggtggtgaaatggagatttgggatggttacataccttgcacaagctcacataggtggaaagcagtagaagaggggcctgtgccccttcttcaggctgtgcttgtctttcctgacctcataattgttctcttggacttttgggacctatgagaaagaaacagaaactggccatcagtgacttagagaaacaaaaggaaagctttgctaaaagggaaaaggcataatttgcaggttatgtaaaaggaggagaaaggagtaggcacaggctgaaggaaaactgggccctaggccagagtggtaaattatggcccataggccaaatctagcagaccccaaacagctacctgtgtttgtgtggtctgtgaactaacagagatgtttacatttttaaatggttgaaaaatatcaaaaggagaataatatattatgaaacatgaaaattatatgaaattaaagttttattggctctcagccacattcatttgtttacttattgtctggctgctttggtgctacaaggcagagctgagtagtagttacagagactatgaggcctgcaaagtctgagatattgactagctggtcctgtacagaaaaactttgccgaaccttgccttaggagatgacattcccacttaagttgtggctcatgccgatctgctgctctgtgggaaggagctggcttctggacagtagcagctggctctgggcatttcagagacctgtttttcattttagaatttgccggtgattcctgtggtgttttgcgttcaaacatagagtttctctgttacatctttttaaacacagcacttgaagctatcaagacatgttctttggtgtaagtagtgttctcatgatcaaaaatgaattaaaaacactgatggctagttggaaaggagatgcatatttcttcttcagagcttgagtatattctagaaatttgttctagaaacctggttatgaatttgtggctgagctcctgggaggaaataattagcacgtttatcaatgagtatttttatttttctttaatcattgctataaattaggctaaactgagaatttggtggcttttaaaatgacatattctttttaatttacatcttactcatttgcatttgttgtagaatgcttgcctccccaaactgaactgaacagaactaattttctttcttttttcttttttttttttttttttgagacagagtctcgttctgtcgcccaggctggagtgcagtggcgtgatctcggctcactgcaacctctgcctcccgggttcaagcaattgtctgcctcagcctcctgagaagctgggattacaggtgcccgccaccatgcccagctaatttttgtattttttttttagtagagatggggtttcaccatcttggctaggctggtcttgaactcctgacctcgtgatccaaccccctcggcttcccaaactgctgggattgcaggtgtgagccaccgcgcctggccaatgaaactaattttcaaagctattgagattgcagttaaaaatagttatctagaatagtagaattatagagactgttatttaattaattaattaattaatttatttatagacagggtctcactctgtaggtcaggctagaatgcagtgacgctatcatagctcactacagcctgaaactgctgggctcagatgatcctgcttatcacctcagcctcccaagtagctgggactgcaactctgttgttgttatctttattctgcttaccaccttaaagcctacatgttgcaacccatatttggtaattacactactaaagatggtgcagcagtacagaattgattactgcccgactgtgtcacaaagatacctcttcaaaaaatagtttataatttaaaaatgtagtatcttcaaataagtttttgttttcagagtaactttacaagcaattcaaagagcaaagatacatcgtttttatacacaaaaggaagattttcattacagattttcttttgtgtattaaaagagggaagtgtacttttgttaattttaatttggttttcttcaaaacaatacaatcaggtttatgcatttacatacttagttactgattgactcatgcatttttttcaggccttgattgttttagtagcacattgtggcagatttaggaaaataaaaatcattttaaaatttctattaaaatatggatatactccccctttcttgaatttatttcttaaaggagatgtgattaagtgagaaaatgcttaatttgttagtgtggaaatatgcttcatgtttacaatttcttttccgctataagaaattaggtttaaagtttagtttgtataggtttgtaattaaattttaaccaggaaaaaatctataaatagcaactggataacctttgctcttcatttcaagagcaattaacactaacttttttttttttttgctgttcttttttattattagtcttctcacaagggagtatcagtttctgtgcaagttcatgagtgatggggatactccccaggcattatcaatacagaagtgacaaggtatactacattggagtgtcctttccttttttggttgaagaactactgtatttataataaaaatctacaccagaagtttaaagaaaaaaccgtatttcaagtttgaatacaataaagaacatgattattactgtaaatatactcaatagacttttaatacaaataaaagtcttggtgaacatatggctaaaatgaggggctacttgaggcaggaaagtggtcaggaaaagtgtttcatataaacattggtgaattttcaaaaatgggccagagttgaaattaaatatcatttgttacactgatagtttattgattttaatattgcttttattatcttgtgtgcataagacatcctggtgcattaactaatcatctgctcatttaatttggggttatattctcaaatttttacaaagaactttctcatttgctttctagttactgctaacctattttagggttccttccaaacggtaggtgagagataggactttcctctgatttaaatgctgtttttcttatctttttttttttttttgtgctgtggacaggtaaaaattctttatggaacaaaggaattttcaagtacacataatttttattgttcttgacagtactcctggtcagtctcggacactcaagtgcagtaaggagatactgaatatgcatcatgctccacagcttgaccctcccacaggcacagcaacaagcgaaatagatatgtggattttggcaaccttggctttgtgatgctagggcatcgatctggcctgggagaagaaaagctccagaagctatactttattccagagccccagcacacagtgtctcataggcaaggctgctctgtcattgactattctgttttaaatggtttgaagccacaacttttgtgggctttcaggtgcgaaatacttaacagatgctgcacacagggctaagaagggggccagtaacatttaggtcttttaaaatgcattctctaacaggttctttaaacatttaaatctttccttcctgtttctagcaatgtactaaacaccaacagctatctcatctttaaaaattctgcaaatacagaatttaaattatttctttttgaaaaaaggaaccagctaacagtttgctggtagactaaaatgatctccataatgtgatcacctggggaagtcttagagcgctgttgttatgaagagggcggatgggttctttgatgggattttccggtcttgtccaagccagctctgaggcaccttgtcttcagaggcctcttctcctgctctggctatgctggttctttcctggcctccagctggcaccacagtggtgaccagaatgccctgctggtccagggcctctggaattcctgccggccacgtctagagaaggacaatcctccttttcttcttagtttagtttagacaaggttggaattttttaaacagtgactttactaagtaaccaagggcaaaacaaaacaaaacctcacactggaaaatcaccgaagcaaagaaatgaacagacttacaaagcagagattcagagttcttactcttctctgactttggtatagttctgtattgaaattctaagattcttgcagggaaaataatgtatatataaaactgagcaaatcaaagaagcacttatgggtaagcaacctggatacctgcacacccagcacattttgagggttcatgaattctgtgtccttgtccagcgtttctttctcccctcttcactctcattcctcacttcttcctaccactttcttttacacagatgactcttctccatgattggagtccatgagatccatgggtagacaagtggtaatagatggtctaggtatatttgtcatttcttagggacatattacattacatattagcataactgtagccattggacacttaattttcttcactagatagaattttttttttttgagacggagtcttgctctgtcgtccagactggagtggagtggtgcaatctcggctcactgcaacctctgcctcccgggttcaagcgatgctcctgcctcagcctcctgagtagctggcattacaggtgcgtgccaccacggccaggtaatttttgtatatttagtagaaacgggggtttcaccatattggtcaggctggtcttaaactcctgacctcagatgatccacctgcctcagcctcccaaagtgctgggattacaggcatgagccactgcacctggccaataggtagaaaatttttatgctgttgcccatgactatttttgtattgctttaattcttgattttagtagcagtttgtgtatgcttttataaacctatataatttagtaaatctacattagtttatttagctaagctttacaaattccctcataatacaacttttttagaggtaactaacagcattgtaaatttttagatgcaaatgtatgccaacaataattcccattgtgtaatactgtgaaattttggtaattaatattttaaaaaataattggagtatttattgactggctagtctgtgttctgttgctttgtgtgaaggaaaaacagaaaaaacaaaccagaatgaacaaacaaaaaccacacaaggctcagttcctgttctgtattgaaattctaagattcttacagggaaaataatgtatgtataaaacggagcaaatctgagaagcacttacgggtaagcaacctgggctgcagggaagaacacacacatctggcatcaggaaacctacatctaagttctcatccttccactcaccaaccttgagccgattcttgagcctcgtcagattttacttgtaatttgtgatccttacagtgctgtgatttgatgtctcttgactttttttttttttgaaacggagtttcgttcttcttgtccaggctggagtgcaatggcgcgatcttggctcactgcaacctccgcctctcgggttcaagcgattcttctgcctcagcctcctcagttgctgggattacaggcatgcgctactatgccctgctaattttgtatttttagaagagaccgggtttctctatttttgtcaggctggtcttgaactcccaacctcaggtgatccgcccacctcagcctcttgaagtgctgggattacaggcgtgagccaccgtgcttggccaatgtctcttgacttttaagtgtcagaatggtggtagagacagagtgctgcaggaatcagaaaagaggtctcaagaaaacttactattatttgttaggccaaagaaggcatagatataaggttgttttgtgttttaaattctactttttctactggttgttgtatcaagatctggacttggccaggacttggtgttgcttttttctcttaattagcttttgatttagatgcaggacagtaggccaagaataactagaattaaatttacatttaaaaaggttccaagtgtttttatatgagaagagaaaacaagtctggtgtttttatgaagctattttctgttttcagagaggaaccgtatcctcttcagtacatttaaatattgtatgctgttaaaaaaataaacttatattcatctgtttcagtcctgacctttaagtcaaataaattaataacaattatgctggtaacttttttttttaacttttatttagggttcaggggtacatgtgaaggtttgttacacaggtgaactcatgtaatgggagtttgttgtacagactatttcatcacccaggtattaagcccagtactcagtagttatcttctttgctcctctgtctcctctcactgtcacccttaagttgagcccagtatctgttgttcctttctttgtgtttatgagttctcatcatttagcttccacatataagtgagaatattcggtatttggatttctgttcctgtgttagtttgctaaggataatagcctccagctccatccatgttctcgcaaaaaacatgatctcattttttttttaatggctacgtagaagttaaaacgaagttttatggtatgtgctacttaaaaattggggacccttttctaacttgttacataaatagtcatcagaatacctagattcaacttttggattcattaattatctttaaaatatgattgcatttagtgaactgaaaacatggcaaataaaaacgaaatcagtttgtgggagcaaagtatttatgtgcatacgtatatgtgtatatgtgtatgtacacatttgtgtttactagccatggaggttattgttgagccttaagaaaggaatagaaagtatgaatacattttaatctggacttctttgatatcttgctaggtcattgtcacagcagcatttgttctacatgtgtttgcatctttagaatggagcatatctagtgagtggtacactctgagacttaatccttggagaagatggtggtgtgcactgcttttttttctggctatttttcctactgtttccaggtggattttatgtaaattgaaggaagcagttcaagcagaacaactggaagggaaagagtgtgacttaattttaaaaacatatatagttacttatacagttgttttttacgtgtaagattagcaaatattaacagaagtatttagcctgggtgttggttttggaaattaactgttatttattgaataagcaaataaataccagtagctgagtcttttgtacagtatattaggttgaagaaaaatttggtttattaaaatgataaacttttatcttattaatatcacttgatattttatgttcctcaagcataaacatatttttttaaaaaatgaagtattacattttaaacagcaagtaaatatcctaaaaaaccgggctccttctcactgaatggctgtgttacaccagtactgtcagctccatgggttatggcagagtggataagtgagatttttttttcatgttgagataaaagataaactaagaagtctacttttgaaccatagacacaaacttaaaaaataactataattgataattatatctgattttctataaccagatttaaattctttattgatgcaagacatgaatttttcttaataattctcagaatatcccacacttaaattagtttaaaagcatatttggtttgtagaaacttctttcgaaaaagagtcctattcagtttgaagaggtgatgggagtgagagggtcagtgaaatagaggaagggaagttgcttttaagtgtggtacaaaattacaaaatatgtgacttgaatgagttcacaattaattcagaaaaatctgaactagaagccactgctgagtgctggcaagggaaattatgcttatgtaaaatgtgacactgaattcttccctgaacagaaatttggtttgggtagtttcatccttgggatttatttctgtggattatgcttattgcggttgtagcatttcatattaaccgtaacaaatggaatatcccagccattctttgcatgctatgactttcagcctatggtccagtgtgcatggaccctcttgcaacatatacactgagacagtgtatagtgctgaatttgttttttatttggtttcaggaagtcagctggttacttcagtaatcagcagagattcagaaatatagatgttgtaatattatgcaaccatggatgtgttttatatcacttggtatttctgataaattgaggtacaagtctgttgtgctttgaattattggagagttgtgttatttcctcttttattatgattaagtgtattacaaagaatttgaggatgatgtttttaaaatactagggtaaatgcagaaacagtacagaggagtgtttgctttcttgatatagccagagggcgctcactatacaaggagactagagacctctaactttgaacttcaaaactttgaagtcatttttttctcattcctctgatttattcttcgtatttaggtatagtgctttgctcattattttgtctctgtctttttttgtttgtttcatctgtagtgaaaagtgtgtgtgtgtgtgtgtgtgtgtgtgtgtgtgtgtgcgtgcctgcctgcctgcctgcctgtataaataattagatatctattagatatttgaaacgggtaaagattatttttaacatgatcttaatattgttattgcattcaacagtgattccttaatgttatttaatacctatccaaattcacctttgcctctttttctcaagtatgtctttttatagttggtttgtttgatccggatccataaatttatcttcctaaacaccttccaagctgtcacttaccttagtctacactgcaggactctggtagcttcagggtcaaatctagcctaaatattgtttttcaaaagcctcaaattaagttctgtgtttcaggaaattttacttaaaaatcagaatctttcttgttttggaggagaaaaaaggaaaagaaggcctggaaaccctgggttttccttcccgtatggcaacaacagctggctgactctgagaagtcctctccttggatggggtgcttgtgcactccagtcaccatagcaggtgcctggcctcttcactgatgtgtttgcagccccctctctgtatacatcactgaattagataattatcattgtttctgaaattatttttcttgtctcatctttcttaagtccagtgactcttcgcatgctatgactttcagcctatggtccagtggttttgtcccccctggaatatttggtaacgtctagagacattttgttttgagcagtgggtgctacttgcatcctgtcggttgagtccagggaccctgctaaagtgtcctgcattacacagcatgaccccatcactctctcccagccccaccccaagaaagaattatctggccccaaatgtcaatagtgctgaagttgggaaactctgctacagtctgatggcacacttctaatttcactgccccgcttctagtgtcttctctatttccaaatgtatttattatcatttcccaatttgcactctgttcatactggattcctcactatccagtcaagagatcatgcttttacacatcttttggaggaggggggattatatttccaggttccttgactgtgaaaatactgtctgtcattttttaaggcctgaacatagatatattaagtcttatattctagtgatttttttgtagatttttattgttccttcaatgttgaactcctacagtattctctgcaaatatataatctgtgatttaaattagtatttagtatgttattctcagtcttttcatatgaactaactttacattcttagttggattttaacctgcaagaggatagagatcgtatctcttgaattgctgtgccttagaactcccaacctcggaagcttctctgcctataggccttacagagggatagtccattaacccatggcttgccctagtcacaactaacaagataagcaggaaccctatgttggtcagggttctattcaaacgaagaacccattttagatatcttgagcaaaaacagatttaacaaaagtaattacaagcttatacaattactggaaagcctggaagaatgggctttagcaaaactttcagcagtgacttctagaatagcagaaatagctgaccaaactaggaggctactacctctgtcccagtggggaatcaggagcccaccattggaagtattgaattcagaaataggcttccataaatgtaacccagggatggagaagctgtctctgttgattccttatgcccatgaggcagtgactataccaacaatgcagaattcagccacagcctttgctgctgtccatatgtctgtctgtctctctgcctctctctctctttctctccctctccgtccacccgccctcctccccagttcccacaaagtgtgagattgaccctagaacactggtgtagggtaaaccgtatccttctgaccatgcttaccaatggaaatggccaaaagtgatagggatagaaccatctgtttttcaaatctcacaggaatacatcttagaggaggggtataatttacatccaaatgtttagctccaaagaacttggagaaatgcacctttaatatttgattttctcatgactttcttcagtaattgttcttcctgaagcttggcaaagcattaaattattttaaatttttatggatgtttttgacaatagggacccaagtaagggcttagcattacatgaaatacatgctttttaacgtggagctctattataaagttctaagcatgttgaatactttgtcagcttttaagaagaccaatttctaataaagtcatgggaaaaaaagaaacttatgaaatagaggcaactaagtaatagaaatttatgtcccctcaccatccttattgttttaaggccagtggattgtaacttttatggaagagacggcatggtacaacttaatcctaattacaattttatgatatttgtttgacttattcattcatttcttatttactagtgctcttattttatacagcaccctataactttcagtaaattcttagctgactagtgtcacttttctgagataaaaccagtggggcttactcacagcttctggattttgataatgtcagtaataaaattctggctcattaaggaaggaaggatttaatttgactcagccttttaaaaattcatgataacaaaagtacaaaagaaaactttgtggactaccataactgtactttctaattgtaaatttatgtttcacaatttttatttgaaagtttggtttttatgtaattgttttttacttttgtagtttctttgctcgtaacagtaactatagttaagcttatggctgaaactcctgctgaacaaatctacagaggagtatcttgcattcaaattagaatgttgatcttcctcacattatttggagttgggacaccccaactacacatggtatttatttattttaaaatttcatttgttttgctcattgtgataatttcaggtggtaggtagatgtaccttagtgttcaaattaacacatagacaaaactagattgggaatggctggattagattaatacatgcctatctaggtttattatgtcaccatagcagttttagtttttggttttgtatgtgtgtgtttaaaatgatacagctaaaaacatttgcttttattttgatgaagacaaaaatatttggggaatctggatttgttttggtgatatgcctaggatgtagtcagtttagcccttcaaatgacgtttgtcatctaaattattctgaaagctctagtaagaaatgacagagctcctataagaaatgttgaagcaccagtagaaatcagtaagaactaggatatggtagatctaatgaagatggcataacttcgtttaagagttgtattttcggttacaatgacaataaatgcttgtaactgaaaacagagatagttaagaataaatttaaatttgtccatgaacacactatcaattagtaaacaatgtaaaacactgtgatagtattcatttttttctgtttgtatatcttcatgtattttctttataaaatcaagatatacatacatattgataaacaataaagccacagttttgtatttgtcttatttacaaaatagtatattttaagcatttcccatggcattgaatattcttcaagccatgatttttaagtaacatttttatatctgtcacgggattataccataagttttataaccattaccttattcgatatatagcttgtttgccatttgacactaacaaaaataatattgtaagggtattattgaaaataagttttggtttccatttttacctatttttataggaaaagttcatgaaacaaaatatttaaataaaaagatatgtactctgtctcttgttacatattgtggagttgatttccagaaggttttatggattttcacttccacgagcagtgtacaaaagggtatggaaatcttggcaagcattacttttcaaaatactttcttcaaggttttaggggaaaatagtgtctgattctctttatcctccttttttatttcttaaatttatagtgatttatttacttgctaaaatattttttgccacttctgtttcttatgtgagttgcatattcgtatcagtggtgtgtacattctagtggagttagaaaggacggtaaacaaatgtattgggaaggtataaatcttaaaaagaaaaataaaatgagattagagtgattaggttgaagaataccattataagtactgttttcaggagatgctttttatctttggttacatttgagcatagaagggtggaggctttctgagagaggaggattacaggcagcagggaccacagtataaacgctcttagctgaggatgtgtttgatgtgtctgcagagcagccaggagaacagtgtgcctgcattagggacaaggaggggatagtgatggaagagatcagattgacagtcaagaccagatctcttaggtacttggagtgtggactagggtaaggagtttggattttattgagaacaagaggtaaacccttaaaaaaatttggagagaaacgcaagatatgtgtgtgaattagaataggttattttatctggacttttggttggtgaatgtagtacaggctgatttcagccccattttcccctttagcctctctaaagggtggctgtattatatagtacagttgctaaactatatacattgtggccctgaattgatagagttacagctatatcattccggccagtagaaagaagggattgacaatggccagggtagatacagggaaattctttaagagatgatttcagtagtctagggagaagaggatggtgcctaggtttagactactcacagaaaagatggttaggagaggctggatcctgtaatgctgatagaatttgtggtcaacttagatggggaatgtgagagaaaaacaggagttaaggatgactccaaattttattcttaaaattttgcatcttagaagttttaatttgtttaagtcttaacaccaattgagtatatactctacatgctttttttttatattctcactcatgtttacatagattgtaaacacgagttactctggtgactgctttactcttattttaatacttactattaaaacttatagtcttctttgtgtctgtaatgttatctaaatgtttattcagcagaatgctagtggtggaaaacaggaccctaaaaatatttttacaagggcggtcggagtgtttaactctaggaagtaggccaaaatagctgctgtgatgcactgagcagtgagtttgggaaaaagcattctgcaaaatgtcagccgatagcattgaaaaatagcagagctgcttgaagcagatttttcagtttacagaaattgtgttataaccaaagcatggaagatgggaacaaatggcaggggaaatctggctacatgactgtaagatcagtgctgctgcagagagtccctgagtcagctttggtttgtaccaaggcatcaagtgtatttggtttgacaagagattggaatgtgctgacaatgcccctttcttataatcttaggcagtatattacaaagctttattttgaatgtagcttttatcgtttgttatttattgtacttaaattatgtttaaaggcaagcactgggatatttgtgtgcttaaactttgtttaagggcaagaactggagatttgtgtgcctggaacagaccctactctgcctccactttccatttaggtcagtgggcaattaatcttgtaatatgaaaggtttcaggtttgtagtgtttttattgaccaacctttacatgaaagtacatctaccatgtagctggaaaaagatccctgataacttttctatgtaccacccttagtttttggaaataggtaaaggaagaaaaagtgacagactgagaatgaataggcagagagatggaaaaaacagtagagagaagcaccaggaggggtagattcatacagctggatggtgaattttgcactgatttgttttgctaacttaaaacttgttggattacataaatttctattaaaaaagaaaacactgcattcgtattaatttaggcattatttttcttgatgacaaaaatctgaataaaaaaactagttccttttaataaaggacattaaatatcagtagataatagctttacttgtagtttatttagagatactttcaagggataaatacttttctcatctttttgaaagttataatttggcaattgttttctgacaggaacatttggttacatacagtagatgtatggttagatacagtaaatgatgtttttgccaattttctaactctctgggaacagaagtggagaatgttgaatcccattcccctgttacacacatttcttcacctggtgaactcatttgtcctcagttttagggcgaattcctcacaatttttttcataaacttccaatttaaaataactttctctgttaaaacctttcatcctcttcgtgttgttgaacttattcttagttttactgcagtttccattttaaattgtttgtggaattatttgccactgtctcccctcacaactgtattgtaagacccatgaagacagggattgatttttccaaaaatgtttattgagtgacttccttccaaaaatatttattgagtgcctactgtgtatcaactaggatttggggatctattaggtttacattctcttcaattccagcatttacttcgtttaccattatgtctccaacatgtagcacagtgcctgataaacagtgaatgtcagtatctgttgaaagaataaagatgaaagccctttgaggagtatttgcagggctcaaatgtggtgtggagtcaggggttaaatctgtagttgaggaacatgaacttctcctgaggttggggatttctttccccatctcaatctgaaatttccaactgtccctgttctaacttttctttcaataaaaacgagaacttccttagtgttagatccattttgtaaactgcgtctggggaatgtatgcagtttaagtaaactgcaagataaatcacagaagagttaatgcagtagtgatcattttattagcggtccacattaatagaatacagcaatttaaattgtaatgtagttaactttgtccttttttggggttgtaattaatctaaacatccagctatttatgttacttataattaaaggtaggaaagccattagataactcatttgttcatactgtgtattcaattatctgatttattatttatctagtttatgtactgagagtacataataaaacttaataaaacctcataataaaacttattagggggcagtaaatgaagaaacatgttgtgttcttgacagagcaggtacatggacactcagacattaaaatggagaccaggaaattaaagatcagaagcagcatgtggaaaacattctgtctggggccacttattataggaataaacagctctgtagatttagatgttctggggaagtaccctatcattggaaaatatggtaagtgatcatgagtcctcaagaagaggttatatttgtttggtattctttgcttaattatcacacttgacagaatgatttgcattattaacattattaatagaaagtgtttagagaaagttgaaaggcaccatggtttaattgactggaatgctttatgactaaaaatgcagagagtagtttgtgaattttcaggaactgatcctattctttattaaagcgtattgtgtatttctgaaaaagcacacatagtatagtttaattcagactctctgagctgtatatacttctaattatatactagtttatgaaattactgagttccttctactttgagaaattctggaattaagaatgagtgaggattgttggggagaggtcgttgaagctgacaaaacactgaatgcttaccctcgtttctaggtcacagtgaaatcagacttcactggggagcagttttctgatgaggaatgtcatgaatcctttcagaaatgggaatgtctctgtgtttgtctctgtaatgtagaggcatcttgagaggctggacttttgatgaattgtcataagaactgaccccatatagcattggctcagctttctaacaaggggattcttatttcctgctacataaattccccaaatgaaacattgactctttcagacataacctgacccagtgcactgggtcatactggagtatcctgaccctgtatggatttatactgctgagaaaatttaaattgcgttcaaaagagagctattttatgaacatctaccttaaatatgcatcttgcttatgactaattaatgccttgctatgtttttgtggagcagtcttgaagaaccaggtggcgaaccattcatttctaatgtgttgtagctaggaattagttgaatttgactgtatacgaggtgaggaaagagaaagggaggaaggcagggaaagaccagcttttccacagtgacattcttcaacagtattttttgccagcagctgatatttcttccctagtgctgtttcaatgtgtatattctaagccttgtaataaatttcttgctaatgacttaaagtgatggcatttgtacaggaatgtgtaactgttggcttgattttattttacaaactggtttgaaaaagagagaaaatcctctgaatattcatttctgcttaagtccagtggaaatctcagtaaaatattggatgtgcagaaaagctttacactttaggatgagctgcattattatctttttcctgcatcataataaaacccttaatccaacatttaggttgtttgatagttggcgtttataacgctaccggggtgagcatttatcaagataaattgtggagatttgtgttccttcaggatagggaatgtggcatttagaattcttattgtttagaaagtcacagaagatactttaaacatttcttaaaattttatttatgtaacagactcatcttttcaggttagatttatgagataatttggagtccttcactactttaaacattttcttaaaattttattgatgcaggagactcatcttttaagattagtcttatgaaataacttggaatccttcttcactgctctttttcacaaaccctgtttaatctgtccatcaatgttgtttagtctgccttagaaacatattcaaatggatgactttttacctcctttactaccgttccttgtctgtatcaccatggtctctaacctagaacactgttcagaacactcttcaacagatttcctaattttgtccttggcctctcctgtgatagcaaccagggtaatcctgttaaacttgagtcagattatgagatgcagtattgcatagcagttaagagcacagcctctggagctagtctttctcggttcaaatatgagctctgccacttaccatatatttaaagttgggcaacacagttaaatgtaatattggaagagcagtaatacttggattaaatgaattaatagtatctatatggtagacattgttattattgtattgttattactgttattttagtagctattatatcatctctttactcagaatcctctactagcttgctattacatttgaagtaaaaaccagaatctttacaatgacctcctaggccctgcacagtctattcattctgacttctgaactcatctcattttcccttgcatagtctcttctggccattctggatgcctgctgtcctcccttttcttccactgccaatgtatgaggcctgaacccagcccagtcatattctctgtatttgttgtttccttttactggaaagatgtccctcaaatatctgcatagctcacttcctttgcttcaggtcaccctctcagtgaaacttggttatgtcatccaagatagcaacccattcaagactccctgcgacactctatgacacttcgttctttatctttagccctgaaagttaaatgcaaatttttgtttgtttttttttttggttccctgtattggaatataaactccatgatggcagaggcttatttttggtctcttgtcctgtcttgaatgctgagtctctagaacagtggcacatagtaggcacacagtaacattgaaggaattagtgaacttatggcacctggttaattctctgctcacaacctcatgtggtatcatctttcccatgtatacccagtattctcttagctgtgccccctgtggtctgtgatctgctccatcttggcttccagctgtccactcttaattctaaatggtaatttgcaattaaccatttcctgtcttttgaataatgaaaacacgaatccctctccatttctgactagcaaaatattctcatgtctttgagacccacttaactgtttcttccccctgcggtattacctcaacttgtcttgatttcttcctcctgtgatttatcgttgcccttcattgtttaacctcctcatagggctgttatctagaatcagaaataccaatttttttattatttggcatacctaggatggtattttttttagtgtgatccctgttgagcgtcatccgcatctcttcatgatgatacctggtactcggaatttattccccaggagctccccatacaaactgaatcagaaactcttggggtgtgacccaacaatctcttgtttatacaagtctttgggtagttgttctagtccatgctaatgcttgaaaagcactgagcaaggacattggcatgatggtccagtttccagactgggaatatctgagattaagggtccagttggggccagtgctgtggctcatgtctgtaatcccagcacttggggagcccaaggcaggcagatcacttgagaccaggagttatagaccagcctgaccaacatagtaaaaccctatgtctaccagaaatacaaatttattagcggggtttggtggtgagcacctgtagtcccagctactcaggaggctgaggtgggagtatcacacttaaacagtgggagctaattgaatcagaggtcattacgtcttaggagagtttttgtgaatgtggcagatagagcttcttactgaatcaaaatggtgctataaagccaattatttagaagcaacattatggagctgtattcctgttattttcagaatttttatgctttgatatatggaaaataccttttagtcaattccatcttttttaaaaaatcgcaggtcatcttggaatcatagttgaaataaatagtatttctcattaaagcattaacatgtcagttcatcataagtttggtaattcagaatggaaccaaagaacttcattgtttggaatacaggttggatatcccttatgcaaaatgcttgggaccagaagtgtttcagatttccagtttttacagattttggaatacaatcatctgttgcataacgacaaagataccttctgagaattgagtcattaggcaatttcgtcattgtagaaacatcatagagtgtacctatgtaaacctagatggtgtagcttaccacacctagacaatatagtttacactactgtttctacactacaaacctgtaaggaatgttactgtaccgaatatttaggtagttgtcacacaatggtatttgtgtatctaaatatatctaaacataaaaaaggcaacccattgtgctatgactgctactatatcactagatgacaggaatttttcagctccattgtaatattatgggaccagtgttgtatatgtggctcatcattgatgggaacatcatgtggcacattactgtatttatatacacataatgagatatcttggggatgggacccaagtctcaacatgaaattcgtgtatgtttcatatataccttttacatataatgcaatattatataatgttttaaataattttatgcaagaagtaaagttttcgctgtcctcctcacattaggtcaggtgtagaattttacacttgtggtctttcagcactcaaaaagttttagtttgaattttggatttctgggctaggaatgctcaacctgtaatatgaattggtaaagtctcatcaggttcagtatttcatttattcagcactatgcatatgacaagatatcagtgtaaaaaatgaaactataaaagtactggaagaaaatatgaataattattttataattgcaacatgtagaaggcatttctgaagtgtgagaaacaaaacccagaagatgtaagaattaatggccgattttaaaaagtcatagaaaaataaaaattctatctggaaaaaaaatcatacaatcaaaacaaagttcaaagataaatggtaagtggggagaaaatgttcaacccacaaggtttacttggaatttattgtagagatacaatcttacatgtaagaaattacttgtgaccatctttatcaattgcagttttttgatatttaatttttttttttggacagcagtgcaatggaaacagcttaaatttttaccagcatgctggttaaataatggttcattcatacaacagaatattatatgtctgtactctatttggaaatatctcgaagaaatacaaaaattttaaaaagatgccgagtggaatagagagtatgcacatgtatgagaagtatccacttgtgcatgcattaaaatatctcttaaagcatacatcagaaccagttttattgatattttctgaagggaagtcagttaaatatctggtaaagattatcactttctacgtcacctagtccaaaatttaaattacaaataaggaaagatcagtcacatatataaatatattttttagatctccaacttggcacggtgaatgctagaatgtttcttgtattttctgggatatactccataaaaagatacctccttacataaagatgagaatttatgacagttttcaacacagagtgaataataaacttttttggagtcttgtggtaattccatagaagatgatatttgtagttgtcttcatcaaatcatcatttaattttatgtactgaaaatacataatatacagattcaattttctagtaatatcttatatagcaacttcaactcgtagaacaatgtggagaacttcagcaacttgttaggggaggattctgagctgccaaaactgatgctataaaactttcaagacagtatgaggatgggctgctcctcaatttaaatgtattcattttatgcaaggtagatgcaatggaagatataaaatcaactataaaaatcatgttattatgtgttcatggcaatgtggagtaaagtaagcaaatatttcactataattgaagatggtaaatgaaagttatgacttctgtccatttttgttcctgtttcagtcacaccacactttatcaggtctgcttttaattttgtgtaactgatccatttattttcattgctttaatttcggcagacttgtacataaaggctgtttattttccgttatgaagaataaaatgttatcttgattcaggcacctcacccttacaactttctcttagagcatggcttgcctaagcataagcctaactcaagctttctgctccagggcaactctccttattcatatgcgaattggcaggaatgtattacctcagcctgtgctggtttgtcctggttcctgactttactattgatccccttttcatataagcattgaaaatatttttagtgtctgtgtaaaatatgaaataaacagtaacagatcatatgtgtttcagcaagctacataaccttggtatcagatttctggcaggcagttcatattctctaataaagcatttggctagcagatgggttaccccatcccactcaaagaaggtttctcattcatttgtggaggttgctgaaacctttgaacccttggaattcagcagattaaagtccgctctatttgtgaaggggcagatccattttcctttgacattaaaattatatctagtatatacatttttataacatttgaagggatcaaatgtgttttccaagtcataaattctggaaaatggtcctatactctttgttttaatttttataaagataggaaacatactgcttttccaagataatcttttcattttggatattgtttattgtactttgtattgatatgtaatccgcactcctcattaattcccttctctatttccaccccagccagttctttccactaaaatcatatagagaaaatctagtattgttttctcttcaaatgtaatgagttggtggggagatagtgaatctttcttctttttttcatgtagaaaaattctcaatccctcaactattcagtaatgatgtgattgctagacccctgaacctactggttaaactccttatttgtcaaaattctccttaatttagcatcccaagctcttataattttccacagatgggctatacagattacagtgtaatcatcacttctcttgttaagatagcttttgtttttgtttgtttggtttggtcagccatctcacattttggctcatttttgagtttgtattcaagtaaggcccataacacacttttttcccccaactttttaaagtcaagttttactctgattgaacctcctccccgccatgtgtgatcattctttgctgtttgaattttacttttcccttctgaactctggaaagaatttgctgaaactcagtgtatagtccttggctgcaatccagccctttcatttcatctctctgtttctgggaagggattggcatacatgtggaggagcagctcccaccttttttaactgcttatcatgtttaggttgagttcttaccttttaggtcatggacaattgttgagacgcagaagtagagaggtataggggtgatgagggcctgtgggatttactgaagggagttattgcaagcagttctaagtaaagtgtttttttgtacagattggaaaaattatatggttcatatgtatgtattaatgactttctgaagtatatggatacttttgagattgtgagaatgtaaatttatttaaatgtcactgtatttatttcaaggttttctcataattttcttgatcagttgttgctataacatggttatagagtagcccacaatattttatattaaaaattacacctcatactaggaaaatggagccttttattttcatttttttgagacggaatcttgctctgtcgcccaggccggaatgcagtggcgtgatctccgctcactgcaagctccgcctcctgggttcacgccattctcctgcctcagcttcccaagtagctgggactacaggtgccagccaccacacccggctaatttttttgtatttttagtagagaccgggtttcaccatagccaggatggtctcgatctcctgacctcatgatccgcccaccttggcctcccaaagtgctgggattacaggcatgagctaccggatccagccaggcttttattttaaaattcaaatctttgtctaatatttattcaagttttattgaccataaatatacaaattttgattttttttgcagtataatctgtatgttttaaaaaatatcttgaagctttcatagcattttgaaagttactagctactagaaattcttgatcataatattcctttgagttctgtcttgaaatttgtcaaacattcactattgggttacctaacagaccaaagcacacatgtgggtatatcactggaaaaaatgagtatccaaagggatgatcaggaaacctaaaaaaaaaagttcttaatgttggcatgtataaaatttttatttgaaaagaatgataaagatatatcatggtttggtttgaagtatctataaaggatggggatggtctcggtgcaccttggtctttcacatatctattatctctggaagtcttgatctatccttctacatttggtatctagttagtattggaccttatggttctagaagagtttatttttaacttcatgactcctatccaggaccatttgtcttacagcctttctgtaaataactggcgatacttgccctctccatcccactgcacatactgctatggtgaccaactcattccagtttgcctaggacttttccagttttaaaattgaaagccctgtatttctggaatctcctcagccctgggcatactgggatggtgagtcattctgcatactaccctccacttttcagcacttctcttaatttgtggtttgtctgttcattgtccagagtgggctgtggaagcccaggcatccatgtgaaagatagtgtgtgtgaagatgccctctatgtagcattagaggttggaagtgacttttttctttaagcataccattgcccctctttttctacaaaaatggtaggaaatcattggatgtctcttgacacatcctttttaggtttttttttcttgttgaaattgtgacgtgaattactcttgaggaatttttgtcttgaatttttttcaacagttctgcaaaataaaattaattctcttcaacaattccacaaaataaaattagacttcgtgccttcagttcgtcatagtttttggtgactcagtacttaacaaagcaacaaaattgtgtgcaatgaaacctaggaaaaccaagttttttagtaactgtgaatcccgagttgtcttagattggttaccacttaactgcaggatcctggataagtcttgttttctctttagattatggtttcctccttcatgaaagaagtgggctttgctagactgaccctgaggtcataattcacattaaaggaaatgactttcagtcagtggaagagcagggtatgattactttatgtaccaaatacttattttctggaatccatttggagtcatttttatatctctctagcttcgcctctgagtacagaacacagcataatgcactatccccatagtacctctttcagataagactttctgactgtagctaggataatatgtcggacatccccaagaccacctgcgggttcagtgattcaccagcaggacctacaggattcagcatatggttgtactcatgtctatgacttattattgtgaaaggatacaaagcaaaatcagcaatgagaaaaaacacatgggtgaggtccagggaaaccaggaataagcttctaacagttcttttccagtgaagtcacacaagatctgcttaattctccaagcaactaactggttgtgacaacatgtgtgaaatgtttacctaccatggaagctcattagagattcagtgcccataacttttctggagaatggtcacataggcagcctctgtaccaaaatttcaagcacccagaaggaaggcaggtgttcagcataaaccgcattgtttgtataatttagccacagtgagccatcttatctaggaatgatgggaacccttcccattggaagaccatctggaaaccatatggaatccaacttttcagatgcctgccaaggaccaaccttacaagcagatctttctaaggatagaagtcttaagttgctatctcttttctgaacataataaaactcaatgattgcttcagcccttaacctgttgtcaccaggggaggccacatgacattgaggaataactctgaagttctacttctggccctactagtaatttgttaggtgactttggctaagtcgattactttactggagtttaaccacctgtgaatttgagatgattatgctaactacatagggattttgttaaattatttcattcacacctacatgcaagacatatgatattacttgcccctgagtccactcattctgaaatgttttttaagaacctactgtgtgcttaatattgtgataagctctggaggtctaattgtgagcaaaagaatgttctctgcctttctgtaacttacagtctcattggagagagagactttaatctcacataatttgagattattcataatttgagattatgcaaattaatttgtaattacaatttgtggtgagtgccctgaaagaaaggtagaaagtgcagtgaaaacatgggtactggcctactctagtaggtcagagagggtctctctaaggaaatagcatatgtgtaagaatctcaggtttacctaggcagtggccacatcaagatgtcagggaggaatattagataatggtcttgaaaaggctcttctctttgaatgggagggtgcaggcattattagaaaataaaaatacaggccaatgtggttggagaagagagaacaaagtggagagagaaagtggatgagattggagaggagagaagtaacctaggaccacattgtggtaatggagtttctctactatcctaagagggtatttaccaatgaagtgacatggtcagatatctaactgttttgaaatgatcactctagctgctttgtaaacagaggtttagagtgtacaaagttggcctaagagacgattgcagaaacctgagctagtgctgattataacttgagttagagttattatagcttgctgggagatggagaggaatgtaaagatttgagaaggcgtatctagagttacttgctaaactgtttgaataaacagcttcacgactatttttccataatttttaaaaacaatctggatagcatctctggtagagaaagggatgggagttataactcgctgagttttgcacatcacctacagtctatcttgcacatgcatcctttgaatatatgtgtgagatgctgcctaacacatatgtaggagtttgtgtcgactgctttatatatactaactcattttactctcatggaaatactgtcaggtagatgctattacagacatattacagttgagacgcagagtttaagtaactgaccaagtcaaaaccaagaagaaataatagagctgggatttaagctttactttgccttcagatccatatggccaactatatggataagtagcaaacttatgacccttaggccaattctggcccttggctgtttttgcacagccagccagacaactacaaatgttttttacatttttaaaaggttgtaaaaaaataaggaaaaaatcaaattgtattagacagtgtatgtggcccataaggcctgaaatatttactatttgaccttttgcagaagaagtttctcaacatctctattatgcttttactacgaaaacatttttctttagtagaaagttgagaaacagtaatctttacagataaaagacatgtctggtcataaaatcagttagttgtagaatgagaacagtgtactcacagttacttctgtggcacaataatttttttttattgttgccagtttaaaattaagaactgtgtttaaagttacttgagaagatatggataaaaggcagctgggctagtgctgttatttaactgtgatgccctcattaagaaaattgatttcagtgccactgagactccgtctcaaaaaaaaaaaaaaaaaaaaaaaaaaaggatttcagatggacttcagaagctgctttagcatttggtgacaggatatattagcaaaaacactttctgttttaaaaccatggtttgtttttgaatagaaaaattgtgtcaccactgaatattggtaaattgtgttcagatatcaacagctatttggagaaaaaaatgactccaacaatgcattttttttttcttctagagctttgaggacatagcatgttttggcctttctaaacaaattgacttcttgatttttggggaaattatgaaattcatctgaattttcagacagagcaaaatattcagccatttaacaaatatttattaaatcttactgttgtgataggcattttggaggattatgtaaagatgattacatagtctgccactgattttcatttggtaagttgttgttcaaatctaccacactgtatagatgcatcacctgtttcttattcatggaaactgtattgatctgttatctaatagagtccaaaggtggcaatagaggttacatttggctactgatgagcttccatttgcttgtttttttaacctcatggtgccaggtatcttgctgaaacgaagaaaatgagatagcttttgctgttatagattggtggtattagtggttggcaggtgcctgttattgaagcaccattccttagtcatctcactgtatcattcatttggcttgtggagggtggattggaaaaggtattaattatagttatttaaattataatactgtttggttaaagaactctgtatattttatctttccttatccttagatgtgtcagtctgctaaaagatttacattgcataattttctatctttcttttgattggaagtttagagattttacataaagttgtactctgtctttataggaattctatatttttagttatttgataactttccatactattttccatggaggttgaactaatttacattcccacaagcaatgtgtaagtgttcccttttctttgcatccatgccaacatctgttgttttttgacctgttaacaatagccattctgactggtgtgaaatggtatctcattgtggctttgattttcacttctctgatgattagtgatgttgaggatttgttcatatatttcttggccactcgtatttcttcgtttgagaagtatctcttcagccatcgcagtactgggtatctactcaaagggaaagaagtcattacataaaaaagacgcctatactcataagtttattgcagcactattcacaacaacaaagtcatggaaccaacctaaaagtccatcagtggttgactggataaagaaaatgtgatatatatatatacgatgggatatgacacagctattaaaaaaaaatgaaatcctgtcctttgcagcaggatgaatggagctggaggccattatcctatgtgagctaacttggaaaaccgaatgccacgtgttctcgcttataagtgggagctaaacaatgggtacacatggacataaagatggaaaaaatagacactggggactccaaaaagcaggaggttgggagagggttgaaaagggttgaaaagttacctgttgggtacagtgttcactatgtgggtaatggatatactagaagccaaatccccaccaatatgcaatatacctatgtaacaaacacgctcctgtatcctctgaatctaaaatgaaatttaaataaataataaaaagaactattcagctgagctcatattgctgaaccatacgaaaataaagttttatgttttttaacactgaattttgtgtttgtatgcaacaatgagtaactgaacgagggacttggaaaatatgtgttgactgaataagtgaatgaatagatggaaaaatagtaattatagggatttttaaacataacaaaaaatgcagtttcagtatttatcacatatggccagtcttgttttaatctatctaccccaattaactttaaaacagattgcaggcatgatatcatttgatagggtattacttcagtatgtgtctctaaattataaggactcttttttaaaaaaagtaaatgaaattagcatgctaaaaaattaactaatttctcaacatcaccaaatacctaattagtgttcaaatttctctaattttctcacaaatgcttttttatagcttttacaaatcaggtcccaactcaggtctgtgactaacatttgtttgaaatgtctcttatgttaatattctatatatttcccttcccttttgtgtcttttgccatcgattacataaatcatttgtcctatagaatttctcatgttctgaattttattgctgacatctctttcctgtcaccatatctttgtctctttatttctggtaaatttgtagcataaatggtagtgaaatctgaaaagtacgtatccagtttaggttacattttctaacagtaatacttcataaatggtgagatggttgaattcttgaattggttaaaaaaaagcatgtgggtgatacatgtcaacactatttttttttctccaactaagatttttttcttatcatagtcatgatactgaatagcaacttagaggaaacagctgttcatgtgtaatattactaaccagacctttctttaacaaaattatgtatttgtgatttggttgaggttatttataaagagcaatagtactgaaacagtaggagttcttatttggcataggattgctggacatggtcagactacacatgattaagctttgccttctgagtcattggatttggtaacatttttgtctactcaagggtctggccaactttacttttcctattaaggatgatgaaatccttgctgttaactttatactggaattgtaagtgtgaaaatccatccagtaaaaactgaaacttgtagttaattcttatgatttatatagacaaatttaagaaatgtaactttaaatagagtaattttattacagatagactttaaaaagctctttgttcttataaaataaaatgtggtattccctattttgaaatttactctgaataatgttaaattttcataatcagttaagctctgtttgaaactttataaatgaaaacttttttaaatagttaattttaaaaagtattcttaaaatacatttactagggcctcatcacctaggctggagtgcagccgtgtgatcttggctcactaccatctccgccccccgagttcaagcgattctcctatctcagcctcttgagtagctgggattacaagtgtgtgccaccatacccgactaatttttgtattttcagtagagatgaggtttcaccatgttgaccaggctggtctcaaactgctgctctcaagtgatatgctcacctcggcctcccaaagtgctgagattacaggcatgacctaccgtgcctggccaagaaatacctttttcttagaaaaaaatctaagaatgttgatgtttatcttcatggaaattatttttttttggttgactattgaatgtttgaatttagtatttctttgtatattgtacttacttatattttattgtagttactttcaaaatttgacagatagatacattggttcatctgctataatttttaactgattcctataatgcattattgccatgtttggtgattgttgcttaggggatactcaaaacctgaattattttcttataaatagagggcaagtgagaaacaaatgatgttactcagagaatattgaaaagatgttagttttgctttcttagtgtgtaggtccttctaaatcttcagttaaaaaaaaaatgttccagcccttttggcatttgttgatgcacttgtttcttttgtgcatttttccaacatgccttttcctattaaaaataatcattatctgtagtagcttatgtaggtgttttgagacaattccttaaatctatctaattttactaaaaagaagtgttatgttggattgaaagtaatatttcattataaaatggtagctaatagttgtatatttactagggcagtggttattttgattccatttattctttaaagagaaaccaaaacacaataaataatgttgtcgcttataagaattttcatgaaaaagcaatcccggataggagaaaaaaattaagattttgttttaaatatttgctcccagttgtcacaatttattttagaaaattagaatcagatttaatgattgtatctgtttttttgtgtatgtcattattttgatgaatgtaatttgctgatctcctcactgatgatgtcataaatcaggaatgatttatcgatgatgttgaagtttgttgattagataatgtcagagaatcttaatcatggattataaagttcattttatggaagtttttctcaatattgaaatactttattgatggcatgatttttcttaatcatcaatatacttttttgcgttgaaataattgtcatttgaaggttcatcatttggcagtaatacaaccaatttgagtcatctattttttcgacagctctttgtttagtcttgtgtagataagtaaaccagaatattcccacgggtttagtgaggtctcaattactgtagtgagttgtaaaatgtgagcatttgatatcttggtaaaccttcttttgtttccttttgtctttgcagataaattattagtcataactgtagcaacaaaagaaagtgatggattccatcgatttatgcagtcagccaaatatttcaattatactgtgaaggtatggtatatcctttaacctatgaagatcctataatgtgtgcctaaagtatgtttttcataacagcagtgcaatctgtaatcctcacaaggaagatagcatttggttacataattactgttagttcatgtagtttttggctttattaatatttcctaacacaaagaaatggtggtaaatgcttgaggtgaggggatagccaaagtattctgatttgatcattacacattatatgcctgtatcaaaatatcacatgtaccccataaatatgcaactattatgcacctgtaataattaagataaaataatgctgtgccactcaaacaataatttctgaatttttgccaatgctttgtataaatatactctataaaacagcaaaaaaaaagttaatatgtatttgcatatatatatataatttctttctggcaggtcatgtacaaatacaatgtaaataagatttggcagggatttttttcactgactgcataattttttctgtaatgggttttgctatcgtaggatgattctttgtttgcagggaattagaaacaaatgtgaagagggtgccttttctgtctattattgagaattgcttttgtttttgctttttttgtttgtttgtttgtttgttttcatttagaggtatttgggaggattgttaatgtatttttaaccaaagcattttagaaaacttatctccaggtgaacatctcattgacaagtgatcagaggaaacttggggaaattgatagaactattaaactcagctatgagaggcctgccattttatttacttacttgttttttttaatagaaagaaggatctgtcagccaagtcttttctacaaataagaggagaacaaggagatacctaggtaggaacacaaaaagcaaaaaactttttttttaaaaaagaagaaagattactttttggagaaaaactgatccatttgagtatgtagtatattaaaaaggtagtttttattaaataaccactggaatactaagtatagatgtaaatatagaacagctaagtgttaatatagaacagctaataaacagctaaactttgctgaaaaagagatgtagtggtaacaactagatgtttaatataggataaatgaaaaacatgttagaaatatgttactatgatagatggaaaatgtagcagtatgcactgataggagacactgtggaaataaaattaggataaaataatgctgaaatctagttggggaatcgttagggttcagaatggagagagagtagaatgtttcttatgtgcaaggcaccttgtaaggaactttatatatgatatgctgttaagtcactatatgaaccatgtaaggtagatactactttatttctggatgaggaaaacttgtcccaaggcaaataactatataaagtataatatcagatcttggaccccatccccacttaacttactggagtttatgatccttttgctctctcctcatgtaatgcagtggttcccaaagtgtggaccccagaccaccaacatctgcattgcctggctactgataagaaagaaaaaataatcaggctccccctcagaccgactgaattacaaatcctgggagtgataccctgaagtctgtgtttgaacaaggcttccatgagattcagatgcacactgaaatttgacaaccactagtgtagtggaaagaacatagagggtggtgcttaacatggtgtattgcacagagtagactctcagatgtcgttgggtccaatgttgcattaggattagggattccagatgggttgtggaacaaatctcagggccagaggaggccaatttttagagcaagtactattaatgcttctagattagcctagtttgaatccagatccaaaacagcttgagttttcttgggttgtgtttttccctcaacctgccacataggaagtgataagttataacaggacatttgaggctgggagccccacaggctttgccagcaagatttatctccggctcagtattaagtaaagttagaactagtggtatttattattaaattttattttatccttttcttgtgtgtttatttttaatttcattctccattaatttcccagatctcttagtagatcattataatggcaacttcagactttgttttgatgaaatgaagagaaaaggtgtgtgttgtgtgggggaagggacgtgtattgcactttctgttcccttagagtcagtgtgtcatcatgcatttccaattcagggagcagctgctgaggctcaagcaaatagtgaagagaaagggtacagggtaattaaaatcaaatttaaattaatcatacttaggcaatatcttgcattgaaaaatccttattaagctttagacaattacataagtttaagatgtataaggtaaagaaggtgatttttttcttgatgccctctgcaattccctgaaaaacccattttggttcagtaggaaaattgcttaaaggcccctcatcaaggagtcactgagcttcaatgttgatcataaagatttcctgccagattgaaaaaaaagtgatatgggaaatttattcatttttcttctttatggtctaaacaaataggaataaaatgatgtaatgtgagaaatactttctgggtctacttccttggattagactcacaacttttgagatggtaaaaattgagaagggcattttggggatggataacattgaagaattatgatctgatttaggcatctagatttttttttctagaatcatgattccatgaaacattagaagagtggttacggtacagtactgttcaagttgatgatgtctttaagtttttcatagtactttcataatttgagttttgctcaggaatgaaatgttgattttgtttataggtccttggtcaaggagaagaatggagaggtggtgatggaattaatagtattggagggggccagaaagtgagattaatgaaagaagtcatggaacactatgctgatcaagatgatctggttgtcatgtttactgaatggtaagagaaacaccctgtggattttaaaatctatattcaattactttttaaagagctgagatttatatttgtagatgatgtattaaaatatggttgggcacggtggctcacgcctgtaatcctagcactttgggaggcctaggcagctggatcacaaggtcaggagttcaagaccagcctggccaagatggtgaaaccctgtctctactaaaaatacaaaaaattagccgggcgtggtggcaggtgcctgtaatcacagctacttgggaggctgaggcagagaattgcttgaacccaggagcaaggttgcagtgagccgagattgcgccactctactccatcctggcaacagagcgagactccatttcaaaaaaaaattattgacaaggaattattgttttaaaaagtagatattactattctgtaggttgcccgttcactctgatggtagtttcttttgctgtgcagaagctccttagcttaattagatcccatttgtcaattttggcttttgttgccattacttttggtgttttagacatgaagtccttgcccatgcctatgtcctgaatggtattgcctaggttttcttctagggcttttatggtttcaggtctaacatttaagtctttaatccatcttgaattaatttttgtgtaaggtgtaaggaagggatcaagtttcagctttctacatatggctagccagttttcccagcaccatacagaaagggagaaaatttttgcaatctactcatctgacaaagggctaatatccagaatctacaatgaactcaaacaaatttacaagaaaaaaacaaatagggccatcaaaaagtgtgtgaaggatgtgaacagacacttctcaaaagaagacatttatgcagccaaaatacacatgaaaaaatgctcatcatcactggccatcagagaaatgcaaatcaaaaccacaatgagataccatctcacacgagttagaatggcgatcattaaaaaatcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctataaagacacatgcacaggtatgtttatcgcggcactattcacgatagcaaagacttggaaccaacccagatgtccaacaatgatagactggattaagaaaatgtggcacatacacaccatggaatactatgcagccataaaaaatgatgagttcatgtcctttgtagggacatggatgaagctggaaaccatcattctcggcaaactatcgcaaggacaaaaaaccaaacactgcatattctcactcataggtgggaattgaacaatgagatcacatggacacaggaaggggaacatcacacacgggggcctgttgtggagtgggggaacgggggagggatagcattaggagatatacctaatgttaaatgacaagttactgggtgcagcacaccaacatggcacatgtatacatatgtaactaacctgcacgttgtgcacatgtaccctaaaacttaaagtataataaaaaaaaaagaggcaaaagtagatattactagttataaaactattgtattaatcagttcttgtgctgctacaaattcctgagactgcataatttataaagaaaagagatttagttggctcacaatttcacaggctgtacaggaaacatgatgctggccagctgcttggcttctggagaggcctcaggaaacttaggatcatggcagaaggcaaaggaggaatgaaggtctcacatgattggagcaggaggaagtgaggggatgtgctacatgcttttaaacaatcagatctcatgagaactctataatgagaacatcactagggggatggtgctaaaccattagaaactgccctcatgatccaatcacctcccacccaaccccacctccagcactgagggttacgtttcaacatgagatgtgggtggggacgtagattcaaattatatcaactatggtctgagatgatgtaattaaagatgatgaattaccataaacactaatgagacaacatggcaagagctaacgtttttgtgaaattcatactttagtcttgagttaagaataaagatcatagtgagctttactattgagacgggtaacttaatggattctggttaaacagaagaaaaaagaccacgcaaagttataaatacaagtgagacattagaaagcctgtgttactaagaaagaagaacctttttaatgtaaatgtattttgtgtaatatttcactctcctaattaaaatatccactcttttttgccatcttcttataattttataataacatcaaattgtcatgagttattagttactacttcctttattttattttctgtgtcttatttgtttttgttattgattgctcattttaagtccccatgaattttcccctctaacttaggaaggtctttttacatattttttctcaatttgaaaatataaagacacaaattatttgcagatgaaaataagagtaatatttttatgcattagtataaataagaaagttgtaaattatgaaatgaaaatagatgttaatataatgaagtcccagtgccgtacacacttaaaaattttcaaaagatacataacacttgcatctgtaaaattttcctgttatattttacacaaaatattaagttctgcttgtggttacctattttgcaagatgaagtatggtaaggcaagtgttagccatagtgtactgggaatttttctacagcatttgttattttttttacacttagaaaaagaataccaagttcattaaaatagctctgtagaataaatactgggtatgttttggtttaaaattaccatggatttcaaacaaccatattagtcagcttaaacttgccacatgtacattttcactttggctctgaggcagattctccttgtaagagttactacatgtgagtcagaaatgattttacatcctcaagcttccttttgggttttaggaagaacttttctctaccatcactctcgcatcaccatcccccacctccggccccctatctaatatttgtccttgtggacaactggtatagtgagggacctatttttttctcatgagaagaaggacactgtgatatacctaaagcctgcttgaggttgagtttgttgatttagatgatactttaggacccagcttgacagaaaagataataaaattttaatggaagacacagtgtcttccaggcactgttagtgtttgggatatatcatggaaacaaacagataaaatttctgacatctcctgtgagaacagccagctaactgaaaacatgggtgcccactcagccaagttgttgtctaagaagagtcattaacattttctgcatcattacctaccatgactatcctgtggaaaaaacctaggggtcatgagaaagtaaccaggaggttaaagagggatgagcaattgaagccacataagaaattttttttacccttcttattttttaaaaacaacaccctttttaaaaagtttatacagagtaatgaatctagttgaaaattgtaatctagggcctgggagaatgaattaaactgtttgtaaatggtttgaaatatgatgcccattctgtaacacaattcctaaactcttaattaaggttagctctggtaaaggtccagaattcaggatatgttcattttaataaagcaaaacattcttattttttatgtggtatttttaaggacaactcaactgttttatggaagcataggtcactatcatatgaaaatatacacagatgtatatacttagtggtttagatgagccttttaagaaacacagctttgttagggcataatttatataacatgccataaacatttgtaagtgtaaaattcaatgaatttaattaaatttacagagtcgtgcagtcatccccattattcaattttagaatgtttccaataccccataattatcccgtattccatttagacatgctaaaaagcctgaattaatttagaaacaattttgtcgcattccttccatggaatatgtattctaaacttacttttggatgaacgtttaaaattagaaactggctctttataatctgtagggtaagatttattatatttaatttagataaaaaaatttagatatttggcaaggttttaggttattctcagaacaaaaggaaaactgaagatatccatatatgagtgagaccatctgatactgtctttttgtgcatggcttatatcattaacctagtaacctccagttgtaaccattttgttgttgcaaataacaggatttccttcttttttatgggtgaataatattccattatgtatgtactccatatttcctttatccattcatctgttgatacatacttagatttgttccatatatttactattataagtagtgttgcagtaaacatggaagtataggtatcccattgatatacttattttctttccaacagcacaacaaaaatatcccccatgatcaagtgggatttatcccaggaatgccaggatggttcaatatttatctgttaaaattgtatttgttttatgccaactaactccctttccctccctccaaaatttataaaataattttaatcattttattgtgattttatcataatctgttgtgcaaagtcaactgggtacgtgggtgtttttaactgtgtgtgtgcgtgtgtgtgtctgtgtgtctgtgtctgtgtgtctgtgtctgtgtgttttgagggtgggtggttaggagtggatccatagtattggtttgtgatgttaattatctctggaaatatagacatatgcttcaggtgaagatatgatgaaagaattatcaggtgtgaagctacttctgtgctgctaatagtttggatgattataatttttgctgaagtttatgccaataatgataaaggattggggctaaatgacaaggttagggaacacttctgttgctttcttttttggctatatgggagcttttgcttcttgttgagactcaagatgatggattctgtggcttgtaccactgcctgtttttgtaaaaagttttattgaaatgcagctgtgctcatttgtttacatattgtctgtggtggcttttgcaacacagtgacagagttcagtcactgtgacagacaatatggtcatcaggacctaaaatattttctgtaaaaggccagagagtaaatatttactgactcccgctttaggccatagttgagaaccattgatacagtctgggaactggcacagaatcatttttaaaatagtttgtcagacagtcttatttatgagtgaggaagagatgggtaatgtagaggtctctagggttttaaaattaatctagccttgtgccttctagtgggagtggagaggatttgaatgcaaaataaattaagtagatggaatcaataggattaaggaaaagattccatgagataggccatggaaagagaggagtgaagggtgaatgaaagattttcaacctaggtgactatgtggttgatggtgtcacagaagtagggaacacagaaggacaaaaaggaaaaacacttagaaaatctcaatcatctattgagatagaacactgacatgtctggcaggggactcagtatgaccacatcaggtagaatcttatggttttttcaggacccaggcatacttaccacagttatatgtggaaaattttattttcttcacatgtagatcgactcaatttctgtgagaatatttttatgacctgtgtatcgggggaaccacccccaatatttcaacgtaggttctttcctatttccctaagtgttggccggtctgagaaataaagggaaagagtacaaaagagagaaattttaaagctgggtgtccgggggagacatcacatgttggcaggttccgtgctgccccccaagccgcaaaaccagcaagtttttttgttttgttttgttttctatattcattttattaattcatcccccccaagttttctacagaatcctggaattcttctcagtgtagtcaatacattgatagtttgtcgattttaatgaagacatccctctcagagcctgtgctgttccgcagttgggattgatgcgtctctaggcctgcagggacttcccttcaccatcatatgggaatcctctgtgactctaccctgtgtggattcttctgtgccctgtttttcatgtcttcctctttcttagtttattcccttaatttggtggagcacgttctccagtagctacctctactttccttttccccactcttcgtaccaaattttgcagattgggttctccagaaagtagaatcttaggtggaaattagtgtgtgggaggcttattaggaatgcttgttggatcaatgcttatgattatgcagtttggttggattcatctgtgttcttctactgatttttcctggggtcacttttgtggctgcagtaatctggctgctccactgagagtatgtctggttgttagctgggactgttggctggatacttttgcttatctacaggtcatctcttcgaggataatttgggtttcttttgctgtattagtccattttcacgctgctataagaaatacctgagacgtacttggttttcagggcactacattgccttgaaaaccagcaagtttttattagtgattttcaaaggggaggcagtgtatgaatagggtgtgggtcacagagatcacatgcttcataaggcaataaaatatcacaaggcaaatgggggcaaagcgagatcacaggaccggggcgaaattaaaattgctaatgaaatttcgggtacgcattgtcattgataacgtcttatcaggagacagggtttgagagcagacaactggtctgactaaaatttactaggcgggaatttcctcgtcctaataggcctgggagtgctaccagagactggggctatttcatcccttatctgcaaccgtgtaagacagacattcctagagcggccattttagagacctacccctaggaaagcattttctttctcagggctgttccttactgagaaaaagaattaagcgatatttctcctattcgcttttgtaagaagagaaatatggctctgttccgcccggctctcaggcagtcagacctgatggttacctcccttgttccctgaacatcgctgttatcctgttcttttttcaaggtgcccagatttcatattgtttaaacacacatgatttactaacgatttgcacagttaatgcaatcatcacagggtcctaaggctgcgcacatcctcagcttacgaagatgacgggattaagagattaaagtaaagacaggcataggaaatcacaagagtattgattagggaagtgataaatgtccatgaaatcttcataatttatgttcagagattgcagtaaagacaggcataagaaattataaaagtattaatttggggaactaataaatgtccatgaaatcttcacaatttatgttcttctgccatggcttcagccggtccctccatttggggtccctgacttcccgcaacacctgtgtgcatttttttaaatttgacaatttgactttttacagccaaaataaatttaagtaggaaaccttccttgccctttgagaagttttaagtaagttcaaataacttttctaaagtatttaaacacagaaatagcagtgctactcgaatgagataggaaaggtttcagcaacgtgaaatttttcttcaaaggcaattatgtgataacttttgtcttaactttttgctttaaaataattgtgttttgttataaagataatacaggcttataaaacgctaaattataaaagttgccataactctttttcaaacaactgacatttattaatagtttgagctatactgtttatataatctgtatccatcattagggtttcaaagacaaaaaatattcactcacattccaaaagtgcatttataactttttttaatttttaaattttattattattttacttcaagttctgggatatatgtgcagaacgtgcaggtttgttacataggtatacatgtgccatggtggtttgccgcacctattaccccatcatctagagttttgtttttttttttttttgagaccaagtctcactctgtcaccaggctggagtgcagtggcatgatctcagctcactgcaacctccacctctcgggttcaagcaattctcctgccttagcctcccaagtagctgggattacaggcgcacatcaccacgcacagctaatttttgtatttttagtagagatgggttttcactatgttggccaggatggtcttgatctcttgacctcatgatccgcccgccttgacctcccaaagtgctgggattgcaggcatgagccactgtgcccagcctcatctaggttttaagccctgcatgaattaggtatttgtcctaatgctctccctctccttgccccccgcccaccgacaaactccactgtgtgatgttcccctctctgtgtccatgtattctcattgttcagctcccacttatgagtgagaacacgtggtgtttggttttctgtttctgtgttagtttgctgagaattatgggattccaccttcatccatgtccctgcaaaggacatgaactcattctttttatggctgaatagtattccatgttgtatatgtgtcacattttcttcttccagtttatcattaatgggcatttgggttggttccaagtctttgctattgtaaataatgctgcagtagacatatgtgtgcatgtaactttatagaagaatgatttgtaattgtttgggtttatacccagcaatgggattgctgggtcaaatggcatttctgattctagatccttgaggaattgccacactgtatgcatgctgctacctgcaaaatttcagactcagtttagtcagagtctccaatcgtaagatgctctgacatcacaagctatttttccccatctccaggcaatgcacaaagggtctgtttatcactcgcatggtagtcgctctttcagagactttagtttatttgcctcacttctcatggcccaattacccataaaactggtcttatttcccagtcttcattattaaaaaaaaaattatcaacaacttatagtcttgaggaaaatatcaccgttaaatccggttgaggaaatcagttgtacttagcagaaaaagtacagtgttgtgttttgtaatgtcagattaatcagtttttttttttaataaacagggcaaagtttgaggtttcagtcagaaaaattttattgtaacttaaagttcagtttcaaaagtacaagtatttggctaaaaataaaattttttaacatacacatttgtaaaaactttgaagtgagttttcctctgtctctcccttcactgtagtccctttcatgttaatttttaactttgttcagtgtttacagtgtgccaggagttatttttaatttttttaaattataacttgaggatatagatactacttttccctccattttatactttacacttaagtgtaaagaggttaagtgacttgtcctaaggttattctcatatcaagtggcagaggtgggattagaaacccacctggcagacttcaaattgtatgctgtgagtgactttacaattatgctgttagctacctgggatggtaagtcattaatttatcatcattggaaacctttggtcttaaggtgcactgatgtaaaaaaatgtaaaataatttgtgattgtaatgaataaagaacttattgcagagtagaaaaattttagatagtggctgttatacttcacgttttgttaagtcattgtgattctgtgaatgaaccatgaggaagaaagtcatcagaaaaatcaatgaaattatattatattaattaaattatagtgtcagtttttacaaaaattatagtgtcagtttttacaaaaattttctcccaagtgtattgagctttaaaaacctgcagttgtctgaacgcacttattttaagattccatgctaaacagtcattcagatattaaacatacattgatgacatttagcagttaaacacattttgtcaaaaataattcttcagaaactaatggactggtacaaatttacttgaaatattaggcagttatggcaacttccgtaaatgattctatctgtattataaagttatacaacaagtaactgtatttctaacattttaatgctgttttagaatttcaatttgggaataagtgattactgaaaaaaaaattaaggctaacactaaaaaagctgacttttatttggacttcatttgctaatgtaaactaataattcaatacaattcatataatttaagttgagagaaattttgtttggtgttctgtgtaaatagttggcacaggtattaatcttgcattgtattcttgattctgacttttgttagagaacttttcatggtttatgtgcctagattctgacaagtgtattttaaaacacattttttcctcattgaacagctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggtgagttagatactggaagaaaagtttaatgcaagttataaagactaatgaaacaaccatttttgtagatgtagtaactttagatatgaagttttaaataacccttattttattattagtatattgacaaagcattttcccatgtattatgtgagttggtgttcctaaaaacactaggtaatataaatgttataattaccaaattataagtgaggaaactcatgtttttcaaatttaagtgacttctagagatattctgttgttaaaggaagaaaagtatggatccagttcctttaattatgacacattgagaattttcttgctctaggataataagtttagtaagcttccttacttgaaaaaaaattattctcagtccgcaatcaagtagcttttaagaataggtattacttaatattatctgattttaaacattatgggattaaataaatgatttgtcttgaacccagtagtgaaaaatatctaacattgagtgtctgggtatacttaaaatattgcattagctgtgctaccacggattaaaggaatgaattaccacattcctcagtccagcctttagaaaattaaataaaatttgaccttggaaattataatggctacaaatttatttttactagtttgagattaatgtaaacatagggacaaaagacataaccaaataggatgaaggacatgttagagaaacaaattgggtacaaattgcaaaccacattggaaaaatggattttgggggtgatctacgtgtatataaccagtactatccaggctagttaaaataagtgctgcttcaggtagcagcatatctgggttctaggctttgcttagccactaggaagtgatttagtttcttggtaatgcctcaatttcagctctttgcacctgcactttattttatcaacatattcccacagttgtaccttggaactttgatagctcatatagattttgtacttttgaaaccttaaattccagtttgcactgcctggcttgaaatctcttttcctcttcgtctcaatatttctacagataatgctttctgggatctcttgaccattttcttttctccaaatctatctaccacctttggatttaacttccatattcaagtgagaacccaaggtttatcatattggttactctgtgcttcttgccttagcagtctttctctgttagatttccagcttgtgaaccgtcaaagcctctccctaatatggctacccaccatcacttctctgcttgagcatgcggctcatggatgggtgctgcttccacatcatggcctccatactgtcaagacctcagtaatatatggctaatcttgcaacttattctaagtcctccattgtttaaaaccaattttttaaaggaagtatgtagccatgggactctgagacatgttttattttatacttgttgaaatttttctgaagatgacttgcatagtgaaatctcgtaaatttatttcaaatagtgatgtatgtactcaggtggttaggtttcagacagactcacagtgctttggaagcagcaagaaattagcaagcaagtgcagttgtaagtcagtttaattaaggaaaaggtgttttaagtgggaaagtaatcataaaaggacatcgaagcatcatccttatgctttctgtagtcaaaataattagagaagggcagaaaatataaatatgtttaataaaagtttgaataatttcatagatcacatatttacagttatttaagggacatgagttgtttgtgggcatactatttagtttttaaaaatagtttttggccaggcacggtgtctcaaacctgtaatcccagcactttgggaggcctagacaggaaggtgacttgagcccaggtgttcaggccaggctgtgcaacgtagggaaatcccatttctactaaaatttttttttaaattatctgggcatggtggcacatggctgtggtcctagctactttggagactgaggtgaggagattgtttgagcccaggaggtcgaggctgcagtgagccatgagtgcaccattgcactctagcctgggtggcagagtgagagccccatctccaaaaacaacaacaaaaagagtttttaatagaaaaatataaatcacataaaatatgtaatgtgaaaatagatgtttttttttcatttattgaggacatttggggtctgtaaaataaggaaacaatttttgaagaacagtaatataaaccattggaaaatgttgagtgtctctgtgtggtacatttttcatcatagaaaattggccatgggatttaaaaaatgtattgtcttctccccagaatttttttatttgatgccaggcatggtggctcacgcctctaatctcagcactttgggaggctgaggcgggcagatcacctgaggtcaggagttcgagaccagtctgaccaacatggcgaaaccccatctctactaaaaatacaaaaattagtcgggcatggtgatgggtgcctgtaatcccaactacttgagaggctgaggcaggaggtggaaggcggaggggaactcgggaggcataggttgcagtgagccaagattgtgcctttgcactccagcctgggtgacagagcgagactctgtctccaaaaaaaaaaaaaaaaaaaaaaaaaaaatttatatggcaagaaccaaaaaatgagcaaccattgattggttttggtcatgttttcattttttcttttttctccaataacagtaatttccctggacctatttttttaattcttttaagaaaattttaattttgacagttaaaaaatagatttttcttcaactcacaggagtaacattggttcctttttaaaagtattgaatgtcaatgaaacatagcagcttggctgcatttccataattcagaggaagattcagacaagaaaaatgattccgttcgtgtctttaatagacaaatgttattggcggtcttaatgcttatgctttaaggccaaggagaacaatccaattttagacttcctttttccagactatgacacaaaaaacctagccagaaaatggtttagcaggcacaataatgactggccaaagtaatggaaacatttccaaaatgtcttagatataaaatttctttgggatgtttgcagttagtgacaaatccagcattcgtttgattgcattagcatctctggcactgacagtaaaaccactgtagtagagattttattctgtaagaaagagtgagttctccgcagagaatccaagaagagctttttagaaggtcagagaaaaaattcttgtctcagtctattcttttcctagtaaatctgtttcccttaggagccttggaaaacattagttctccctcttttgtcaattacttttggagacacatttatttaaaaagagtttggttattttctgttttgcagttggtagcaaacactctattggagtttatatataaaacaaggggcactcaataattcatatttctttcatggtgagctgtgaaattccagcctaagaattaggcttcatgacttcacaactctgttcaactggttagtgaaattaacatgacaccagtttcggtctttgaatcctaaattatctactttctctctgctgtgttgcaggatttattggctatgctccatatgtcaaccgtatagttcaacaatggaatctccaggataatgatgatgatcagctcttttacactaaagtttacattgatccactgaaaagggtgtgtaacagctgcaatttttttgttttattgatttggttgttttgtgtgttatattgtgttaatgtggagtggtcagaaacaaaggttttatgatagtatggcaaatggtaaactgaatttcaaaatgttgaaaacatattttaataggtgagattggtttatgtcacctggctggatatcagcactagcttagtatgtctttatggcttctcttttgtggccaagttggcaaacttgccgaacttggttggatcaggcagaaggaaagaagaactatataatgcagtgctatatgtattgaaacacatattgaaatgacttgatactaaaatgaaatggcagccctcacaccactgtcatggccctacctccactgcatactcacttaggctgccttaaaataacagaataggttgcattatcaaaacttctgagcttggagatttaaagagacaataatgaaatcctaaagattctagacaatgtcttcttttatattcttgaataaataactgtcatttattaacatagagcattagaaatgtgtattcttgtagtcactccatcttggcagctataattgttttctcaaaagctacaccaaagccatttgataccagagtgaacttttgcagtttaaaaaaatgcagtgtattctcatttgtagtctttagccttgcaaagccctttgtacctctctgagcttctttgatcctagataggctagaggctagactctgtatccacactttatcagtagagaaactgagaccacatagtctgtgacattgtagggactggatccttggttccctgaaaaccaaaatctggactttttttctgtttcatatgatgataacatagactttatgtgtttaattggctacaattttaaaagaacacattttctggtattttgaaatgacatgtgaataaagccactcaaaagacagtttttaatttgaaaattacctgtgatacccttgaggacagagaccttcctctgagatttggagcctggagattatgggtgttgagaaaacattgaagccaaaagccctggtcattgttcaagtgtttggtggcccagagtggatagagcctgtaaggatgggtgtgatcctttttaggagactttatagccaatttgtggatttcaaatatttgagaatttggagcctgaagattcaaagagatgataatgaaatccctaagaggttagagcctgaggatccacgggactgtgctatagacacaggcttttgtcttttattcataagaacacttaaactgtaataaataaagcaactcaaaatagcagtggtctaaataagaaatatgttttatttaagttttttccttctgtcacattgaaagtaattaagaagtagggagcacaaggctgttagggaggctttatgctgtcaagagggatagctcttttgttgctccaccattggtccatagctcccagttttaatcttacttccttgtccaaaattgctacttgagtttcagtcgttgcattcgtattctgggcagctaagagaggcacggtagtaaaaacaggccatctcagtttcatcactctctttaagttgcctttctagaagtcttaccaaatagtttctcatactttgatcagaacgtatgtatgtgcccactcataatacccaaaggaaaatctgtttttttattttaagcagatatatgctcctgaaatctgagttcccttattggggagttgagggaatgttgggtacaataagcagtcttccatagaccctagagagaatattcctgaaattgatgtgagtgaaactctggagtacagtaaagcaagattttctaatttgagaatacttttatcatatttaccaatataagttgatatttaataaatttactgtatatattggatacagatataaaagttacttgtgtgtttgtagttgctgtcattaggaaacaagattttctttaagtgtattttgcaatgagttgcaactatcgcagtttctaccttttagctaaatactttagtcatctaaatattttgattagacacttaagatataagaatattaaactttaaattccctcaaagaacaaactatattaatatgataggaatgtttgctgtttttgttgtcattttcaatatcatttctattcttatgttttaggaagctattaacatcacattggatcacaaatgcaaaattttccagaccttaaatggagctgtaggtatgcttcctaaataccggattgcttacgtatacaaacaaacacctgtgttttcaactatctttcctttgttatgtccatttgggggctgtgactaaggtcgacagtgtaaatattgtaattattgtaacttaacaaaaatactagacttgaacttaacatcagtacattaaattaaaatcatttcctatgactagtgtgaaaaagataagcttctggctttaggtaacttaaaatttagtgtctcaccatttgggaactttagataagtttataaattaattacactttattattacacattttctagtgaaattctttgtattacgaattacccagagtattagagtagatccttttgacccagctgaaagataactggtgacaactagacagtagactggggaagagtgtgtgtgtgtgtgtgtgtgtgtgtgtgtgtgtgtacatgctcgtgtggatatgcatatgtgcctgtgtattatagatacatatatcttgataaaatacattaaaactaatcaatacagtaaaatttaaaatataatttattaacacataaatacttttaaatatacatataaaaattgagaatatattgcaattcaatcaatacttcaagtcagtccatttagtaaaaagattcttaaaatctagtcaggcatggtggtgcgtgcctatagtcccagctatatgagaggctgaggattgattgatcccaggagttcgaggctgcaatgacctgtgattgtgtccttgcactccagccggggccagaaagtgagacccagtctctaaaaaaaaaaaaaaaattcccacaatgcaaaatgtttagtttggagtgctcaggaaattttaagacgatggctctgctcctctctgacttgagttttatcttgcttagtgtgctaagtctgatttttaagaactggaaatattatcattggtagccaattgtagaacccttgcttatgccagacaatattctactcaccatgcatatattgttattatcttcataataaccctaaaagacagacgtggataccatttgatagatgactaaactgagttactaatttaacttggcaagaataacaatactatgaaggggcaaaggcaggattgcaagatgaattattctgacagacagctcactggcttagcacctcaatcactttactggtgccaggttggagtgagtttggtatctgtatctgttgtcactgtcatccttcattttgggtatctgctggcttggagtagatgaagttactagaagtgttgtagcacttggaatattacatccatgagaaattttgtaatgatgatacacacacatacacacacagacacacgaatacagacacacacacacgtattttaaattactaaagcctattttctctttttaacccagatgaagttgttttaaaatttgaaaatggcaaagccagagctaagaatacattttatgaaacattaccagtggcaattaatggaaatggacccaccaaggtaagtaacagttacttttatttggccaattcttggagatagactatggattgatatgtggaatgtcatctattttatttttaaaaatttctttcaaagactttattttggtgctaaaataaagacttcatcttttacacagtatatcatctggttttatactaattaattaatcaaactgatttttcctcagcagagtgatagccttttattctatttacagcacatttggcgttttattaaataataacaactaacttgggagtgagccacatttctctcatactgggtatcctttctcattaggaattgctcaggacattaagagatcatttgtttcacctgacttgccgttttctaagttaacaacactgttaagattggggtattacaatatggccagaaagcttcctctttctcttatttcattaactacagttaatgaaagtgacataatttgaccaataaaattttggatgcctttctgtttcaaatgtgtataattgagcttgctaaaaatgttattgactgcaaaatttatagatgaaaagtttgttttgcttgggtccaatcaagctggaacataaattgcattgaaaaaatatagtaatactgtgcttacaacaaccttctgacatgctgaaatgcctggtttaagtacctagaaaagggattaacagatttttgttgtgggaagaaaatactgggggatgtgggcttctgttccagaggagtgagtgatctgaattccaggaaaagctatgtgaatggaaagaaatgcaaggaaaacgcatgctggcaacttctgctccatcaaactgaaagaagtagattcccgtctcttctagttaatctttcccctttggttttcatcccattccagccttcctacaaagcaatctctatcttgtgccctccttcagtctctatcttataatcagtttccccagctctgtcatctcctcattagcattttaaagaccagtaagtctcctccatcttacaaatgaaaccaaaccaagccaacacaaggtagaacatcctcttcaatccacactgccttccaggctgcacctggcttttctcctccccttcacagccaaagtttcttaaaatatagataactcgctgtcactactccacctcttcccatcacagtaagaaatgctcctgttaaggtccattgtgaaatctttgttgagtagtggacattgttcagcccttatttttatttcacctaaagacagcatctgacaattcattgatttcgtttggtcctacttgaatgctccttccctttgcttccacgatgctctgctgctttgtctatttattttctgggctttcctcttcaatctctatggttcttcaaaatatttattttaaaaattttacagctcagtttgtgtgcatgtagtgaccctcatccttactgttttagtaaatgttcacaggggcctgtctggggcctcttccttttcttttccatatacattgttgggtaatttgagtcatttcctcatcagtgaattctctcaatgctggtggttttcaaatccttcctctaactcctgtgtctttcctaagctccaggtcagaatactcaagtggtagatttctgtgttacatatacccagagattaagacttgcagcattacctccccttataacccagtggttaaccagaacctgggttttgttttggctctaggcacttcccactccaaaagccctctgttctaactcctgtgcatgctggttttatctgattttctcagtggccatagcaactttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactacattactttcaactttgcagaagtttcatgttgctgtgtctgcaaatcttctgtacatacatgctttttatatatcctggaatcctctccccctaattcccacctgctgcatctctacctgctaagtccttcttatcttttaggtgtcagtgtagtctttactttttgggtctcttgtatgcttttgtaatctctggagctacttctgttacagtatgtatcacacactggacaggaatgatatttgcctgttttctggtctctcttactaggcctttggtctaggaattacagaaaccttatctgtcttgtttacttttgtttccccagggtccagcacatgtgtagcgaatactacgctttcaacaaatcttaattgaatgttagagtcaataatctaatgacctagcattattcttgggagtagtaaggcagattattttctggcagggcaaaagcattatcaaattactattggttggctgggcatggtggctcacacctgtatcccagcactttgcaaggcttaggtgggtggatcacttgagggcaggagttcaagaccagcctgaccaacatggtgaaaccccgtctctactaaaaatacaaaattagccggggttggtggcacatgcctttaatcccagctactgtagagggctgaggcaggagaatcgcttcaacccgggagacaggttgcagtgagccaagatcacgccattactctccagcctgggcaacaagaacaaaactctgtctcaaaaaaaaaaaaaaaaaaaagttggtcactgtaactttccctaggcaaatttaatagatgaatccctttactatgtgtgtgtagtcactgttttagctgtctgtgatactgtcagtgccagttagtcaagagctggtagaaccccacttttcccataactacatagtgttctgttcctccttggtaatataatattttaatcaaatttaggctggtgcggtggttcacacctcatgtcacgttaggaggctgaggcaggcagatcacttgaggccaggagttcgagactggccagcatggtgaaaccctgtctctactaaaaatacaaagaaaaaaaaaagaaaaaaaattaggcagctgcttgtaatctcagctacttggcaggctgaggcacgagaatcgcttaaacctgggaggcagaggttgcagtcagccaagatcgggccattgcactccagcctgggcgacaaagcgagattgtgtctcaaaaatttaaatgtctttgaggagtgattttggtcctgagaatttagtgattatggataaggccttatgttcagtgatttcaacgtgatcaccaattccttccaaatttccaggatgatgctgactggagctttaaaaagtgactaaaggacatatcacaagaaaaggagcactaatccttaatcatttagaaagacctaggtgtactaagaaatattaagtcttcttggaaacattttcagtttgcactatcactgtttctggcatttcaagctatgtgatgctcctattatgttttctctgatattatcatatctagttcattttgttattctattagacaataaaatatgaagttttattatagatattatatttggtataatacaaaaactcgagaaaatttgaatatgtaaacatttaacactaatactttataatattaggttaaagttaaataaattcaaatgagtatgtcacgtattcttcttatccaggctgatggggaaagaaggctgattattacaaacattttttaacctttataaaaggtggaaggattttttggtatgattttttgtaagttagttttacttattattttgtttagtaatggatgtttataatgatagtggttttgagccataatattgaactaaacatttaagcagttttttcattaaaaatgtatataatctataagtggtgaagtgattatagtatgttgatgatactaaagtataaaaaatgagcttatttcctactttctccaaattttatgccattggaaaaaatattaacaattttaagtaattttaaaaatcatttatactgccctcccatatggttttaattcatagctgttttcagtttttatgtctcctcagtatatatctatgaacatttatattttcctttgttttcatagtagtatataaacaattttgtgtttcttaattaacattttatttaaaacatatttaggtattttaaataattattttcatacttggtctgtataaatctaatatgaatcaatttttagatagaaactggtttctaatttgaaggtttactttttcttgaaacccatttattgttagtaatgtataagatgcatattttaatgttcagccttttcttttaaatatcaaacaatatacatcttaattatgaatttggtagctttttaaaattttactttaagttcttggatacatgtgctgaacgtgcaggtttgttgtacataggtatgcatgtgctgtggtggtttgctgcacctgtcaatccgtcatctaggtttttaactctgcatgcattatgtatttgtcctaatgccctccctcccctttccctccacccctcaacaggctccagtgtgtgatgttcccctccctgtgtccacgagttctcattgttcagctcccacttatgagtgagaacatgcagtgtttgtttcccgtttctgtgttagtttggtgaggatgatggtttccagcttcatccttgtccctgcaaaggacatgaactcattctttttcatggctgcatagtatttcatggtgtatatatgccacattttctttttttattattattattattattattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggctgggcagaggggctcctcacttcccagtaggggcggcccggcagaagcgcccctcacctcccggatggggcggctggccgggcggggggctgaccccccacctccctcccggactgggcggctggccgggcggggggctgacccccccacctccctcctggacagggcgactggccgggcagaggggctcctcacttcccagtaggggcggccgggcagaggagcccctcacctcccggacggggcggctggccgggcggggggctgacccccccacctccctcccggccggggcggctggccgggcagaggggtcctcacttcccagtaggggcggccgggcagaggcgcccctcacctcctggacggggcggctggccgactccccccccccacctccctcccggacggggcagctggccgggcagaggggctcctcacttcccagtaggggcggccgggcagaggagcccctcacctcccggacggggtggctggctgggcggggggctgaccccccccacctccctcccggacggggtggcttccgggcggagacgctcctcacttcccagacagggtggttgccggacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagaggggctcctcatatcccagacgatgggtggccaagcagagacgctcctcacttcccagacggggtggcggccgggcagaggctgcaatctcggctttttgggaggccaaggcaggcagctgggaggtggttgtagcgagccgagatcacgccactgcactccagcctgggcaccattgagcactgagtgaacgagactccatctgcaatcccggcacctcgggaggccgaggctggcggatcactcgcagttaggagctggagaccagcccggccaacacagcgaaaccccgtctccaccaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggagggagaggggggaggggggagaggggagaggggagaggggagaggggagaggggagagggtatatgccacattttctttatccagtctatcattgatgggcatttgggttggttccaagtctttgctattgtaaatagtgctgcaataaacatacatgtgcatatgtctttatagtagaatgacttagaatcctttggatatataccctgtaatgagattactgggtcaaatggtatttctggttctagatccttgaggaatcactacactctcttccacaatggttgaaataatttacactcccaccagcagcgtaaaagcgttcctatttctccgtatcctcaccagcatccgttatttccagactttagcgattgccattctaactggcatgagatggtatctcattgtggttttgatttgcatttctctgatgaccagtgatgatgagcttttttttcatgtttgttggccacataaatgtcttcttttgagaagtatctgttcatatccttcgaccactttttgatggagtggttttttttttttcttgtaaatttgtttaagttccttgtagattctggatattggatggatagatagcaaaatttttttcccattctgtaggttgcctgttcactctgatgatggtttcttttgcagagcagaagttccttagtttaattagatcccatttgccaattttggcttttgttgcaattgtttctggtgttttagtcgtgaagtctttgcccatgcctgtgtcctgaatgatattgcctaggttttcatctagggtttttatagttttaggttttaggtttgcctttaatccatcttgagttgattttttataaggtgtgaggaagaggtccagtttctgttttctgcatatggctagccagttttcccagcactacatattaaatagggaatcctttccccattgcttgtttttgtcaggtttgtcgaagatcagatggttgtagatgtgtggtgttatttctgaggcctctgttctgttccattggtctatatatctgttttgttaccagtaccttcctgttttggttactctagccttgtagtatagtttgaagtcaggtagcatgatgcctccagctttgttctttttacttaggattgtcttggctatacgggctcttttttggttccatatgaaatttaaagtagttttttctagttttgtgaataaagtcaatggtagcttgatgggaataacattgaatctataaattactttggacagtttggccattttcacgttattatgagcatggaatgtttttccattcgtttgtgttctctcttatttccttgagcagtggtttgtaattctccttgaagagatccttcacgtcccttgtacgttgtattcctaggtattttattttctttgtagcagttgtgaatggaagttcactcataatttggctctctgtctattattggtgtataggaatgcttgcaatttttgcacactgattacaaaagataaacaggggaagagctaattacctgatctacacatgaacataactcatttctgaaactaatttgatttgtaataaaaatagagatgtgaattttgtgcataaaagctgtagtacttgggtcactgtgaccttgaataattggatatgatttttaaaaggaagaaagaggaaaggatttgggcggaaaagtttctctgtcaatgaaaatgacatcatacttggaaacattttgatattgtgaaagaagaatcaggaaaatactatcacctagtagcccaggagtgcccagagcagcctaactgcataaacagccttctgcaccgtctagagctgccagcaaaaatgtctctagttttcatgaggaaaacagatgtaaatggggggtggtgatggtggataacctctgcctgtgtggtgagaggtccaaaagagggaagtttctagtcaaaagtaatgtttctaaaatatcttagttatctaggaaacaaattgagataaaaagcagagggtaggaaagtgacaagtttaattccgaaaactaaaagtgctgtcttttatgctctaacattttaaaactagtgatcattttaatattcatatagggattctagtagactgatcaataactcatgaaataaattttacatttttaataagatttctgagatggtggaaataccagtctttatatataatagagattttagacatggccaaatatttgggaaattttttctgtcttttaaaaaaactttttctcaggatattttaaataaaactatgcttttcacccttgcatattctttatctttttaagaaataatgctaaataggggatacatttccacatagatatttttccttcaaaaccatattttgtagaacacaaatgattaatgtttgcctttgtcatttgacaacagtaaaatatttatttctgtttttattatcaagacacattaaaatgaccacattgactcttgaaatgtcgttaatatcatgactacatctttcctgccttgtaatttgtttcctgaattatcctgtagtccagaagaaatgtgaatggcttacttgtccatgtcttctaattttgctgtagagattaaatgtagctatatctataatatctgtacaacacaaagtttttcccattttaaagttcttgtttcagcagtgtttgtttcagtgtttcagtacaataagaatatttgaacaggatcccaaatatttgagaggaatctggcaaaatggtacccaactacttcatgtattccacactttaacatcccctttaggactttaagaagctagaaaactctagttgacactttggtacattttttgatccccatgtttaacatggacttttttcttttgatttcattttacctttccaatgaaaaattattgatcatataatgataatagggattttaggtgcttttaaatagcatgaggcaaaattatagtttgtggaaagaaaatttaaaaagcctattaatatgaatgctcataccactactgggtattaaaattgcagaagatgtagtaatttcacttgctgtttactcagcaggatcttccctaacatgttcaaattctagggatattaaaaattttgtttgagggttcagagcaaatctaagtgtgtctacctctgtcacctatccttcttccttcacaccacccctccccaaaacacacagaagagcacagaattttttttttacagttaaaatgaataccaatagctgtttaagaacagatacctcacaaaggggatactcagagagatctgaaagaaaatgggtagagaaataatattgtactttagcttactgtcactaggatttgtcagatgactgttattagtggttgccctagatctgttttgatctgcaagctctcttttcctgaatcagtacccctgaatcactgcccagaagcttagcttatagtagcatagtttcctggaagagcttagtgtcttttggtgacaaagcttacttagtatttattttgtgtggcgttgtgttagttagaggtcacattactactgccccatttactgtaggtgtctgtgctcagcctttaaacaggtttatcttattactaaattactattcatgtgactcttatttgtatttttcctaataagtctcactagcccatttaaaactctatttcattgtttgctttttcttttttgatcatcctttccggtattatatctaatataatatgaaataaaatgacctttatgatttataagacttttttttttgacatttctagacatactttgtcctgctttacaattcatattctggagaagactattcagtgtgcacctacagatgatatattagtagaattactaaaggaatatacctgctgcagaaaacatgcttttaaattagatgattatggaatgaaaccacaccgatgagaggcctgctttcattaataaccttttccttcatttacaagattctcctgaattattttggaaactatgtacccaattcatggacacaggataatggctgcactctttgtgaattcgatacagtcgacttgtctgcagtagatgtaagtggaattgattatgtgtgaaatgtagtaatagaaagtacattgtcatgaaatactgtgatttataggaaaaaaggcaaattattttatagttttgattttatgatagataatggggatatagtgttaaaacatgatgattcagccatttgctagatttgtgtttcagaactgttttttgacagaaaaaccagctaataattgaacctaatgaaagagtcctgtggttaatatttaatagcttactacgattgggtgctcttgtgtttattctgttagcttagtcaaagcattgagaaaaaatcattacaaggcttcagcatttttattgactaattttatctgtgctggattttcaaaattgatatgtaaaaattaatactacctgattatataacaaacgactgttttaactactttacatataataactcatttaaacttcacaaaactcctaaaataggtagtacaattgactcagttttacagacgagaaaactgaggtgcataaatgtaagtaacgtgtttaagggcacacaattttaagtgttggagttgggatttgaatatagggagtctggctccagactactgtatgttcttgacactgtgcatttttacctgtgtgatgtgtatattctaggcatgttgctacttgtatgtatttcatagatagttatattttatcattcatgttttgagggtgaacaaagagttgaaaatattcattattaatctataaaacatttttatgtatctttgttctaacatcagccagagctgatatcttacaacaacatttttattccaaaaaattgctgacataacatggaagattatatgtatgaagcattgattctagggagttttgtcattaagactgattttttccttcattcactgtaagttcattgagtatctacagcagccagaaacgtagaagcaatataggcaaaaataaagctcttaggaatatagtactactaactcctgaacccatgcaaatgcaaaatacttttactgtaatatgttcaagctcctgaattaaatagtttctattcttatcattgtctgaaaggagtataaagagtaacttgtgtacatgtaggagcttatgaatagagccctattttacttgaaagtaaggtttttggccagtctctcagatagcaaactgtttcctatctgcaaagaatgccagaatatttctgaatgaagctgcatcatgaagatgtttaaaaatttatcctgatctttttttgccgaaagtagtgttgtcttctggagggcgagttaatactttttatctgtttcgtttccttttgtataaactttctggtgcaaagatagaaaaatatttatattaacattttttctttttgcatgtaggagtatgtaatttaatacttaagctgttttgtcttacagcttgttaaaatgtgatagaaaggaaaactattcattccattatgcataataaaattacgtgctatatacagctgtttttcaatagggatataaaaattaaaattgtgtaggtagttaaatcccaagcctatcataatgttagatgtgggccataggcaagtttctttatatgtaaagtcatagtgattatctcagagtgttggtaggaatgttaaatgaaattttacccacatatatatatgaatatacataacaaatatataaatgatattctatttgtataaatttaatatacatacacaaagtggtcagtattcaataaatgttaactgttataatgttgttgttatataaacatgaacttaggttaataatggtgatgtagtggattgaaacccagcactttaccctcaaatatatgtgttctgggttacttaaatttctctaaatctcattttcctcatgtgcatatttgggaaaataacctctaaggcttttatgtaaattaaatgaaatgcatcatctcatttgataaaggagagttgtgacctacttttaaaattatttttcctattaaattgagaactactggagagtagatattttgtgttctttgtatttgtttattcatttaataataaatatttgggcaagtgaatgaatagatgaagaaatatgatagtgtacaaggtgtacttttatgtgagcatatgttattatacagataatggagtaatgtgtgaggtaccgtgtatgaaaaaatggaagaaggttgctaattcagcacttaatgtataaggtatttaaaaatatttgtaattcttttgttcagactttaagacatggctttagtaagacattataaacaagtcttccatagatttctggtcatgacactgttacatgggtgtttacttatgttcctgtcttccccatctacttgtaagtctttcaagccaggaactttcattccttttgccaaatattgcccatcttgtggattggaatgtataatggctatttcagaattgtttgtgcaattaatgaaggataaactccacaccaaaacatatctaaagagaacttaagaaaatatattaaaatatatacattaagataagatatattaacattaatgaaagaaaatagctctccttatacataatataataatgaaaggaaataaaaggataaagtctcaggtctcccatgattgctttttatgtgctcaaaattaagccctgaactttaagccgaggaaacaaaaagagaaacacaattagtatttggtttcttagacgaaactttcaaaatagctttcagatgtgaagaagtttctgcaagggctattttaaaggaagcactgactagtagtgtaggcagtaccatgaattacattcatgtaataaataggataatttcatctttaaacctaactcataaccaagatgggattcagtaaaatcactttgattgggggggccacaaaaatttgtttcaagtgttagagaactgccatggagcaattcaaatttagcagattatgttgaattgatattctagtattttttatgtcatgctgattaacatttgaataaaatttaaaacaaaaccatactaatgataattttatttttatgtttggtgtaaaacaaaggtccatccaaacgtatcaataggtgtttttattgagcaaccaaccccttttctacctcggtttctggacatattgttgacactggattacccaaaagaagcacttaaactttttattcataacaaagtaagtatttgagaaatgaatattttatgtcaaaactatttttggtcttttttggaactatttgttatttatgtcaaataaaattcattgggttaagttcagtggaggatttttggagtaattacagccctgcctttttaggacctaaggattttagattctagagactagcaccacaatattgatatgagccacatgaaactgccagtttctgtagatcaaaaatggctgaatattagccatcatcatatagcttaaattaatatataatcaaggagattcaaagggccttaaatccctttgcctttgggttagttctggtactttcttctatagaattggtcattaaattgtttgtgatttaagacaataacatataagaacttgaaacagtttccagatagagtactgttttgattaattacacaagggcatgccattccccaaaggattttgatactgtcattttcttcaaaaatattcagagccccctacatacctcctacatattatccaaacttgaaaatatttttcctcagtatttttacagttatttcttgtctactaaaaccactggtatttaacattgtctagaaaaactcaatagctgtgaagtgtgcgattttctctcttctgtcctaatactgtttgtttaccattgttcctttttcctaatgtaaatgtcagctaaccattcacattgtccagagaatattttaactgcagaaaactagcttaaatggatttaaaatggtgaaaaattgagcatttgctttgtaaaatatgttgtaatatatatactttcactaaagtattttgtttttatgtattgtcttttgtttatattttccctgctttcatggggccttaaaatccttgatggcggacgtttttgtcttatctttggttatttagtattaactctatgttgcttttatgtgataagttattttaaaaatctgcaaaaagcaacagcttttcagaaaacttagagacttgacaaataaaaatctctgaaatgctctaatgatggagacagataatcttacctgaattttagcacagtcgaatcacactaaaattggtaacctttatgttgatggttttcccattaatctgtccatagaattgtgttaaatttttcctttttttgttaagtaaaatttttttatatatgaccatttattttactctctggtttcaaagggtattttgtaaaatgtgattatttaagtttataactcagattgatggctattatgcttagtagacattttttctagatatttcacaacatatatctaagatttctaggctacaggccgtgtttttcttctccagttggaaacattttatattactaaggatttaagtatttatgcaaacacctattaaagatttaagtatttatacaaagacttgtctagcagtagatattgacagaattttgaagcatcttctctttaagaatattgatatatatgtatttaagattattcatgtgacatttaagtgatatttaaatataccgtgtttaatatggttattattttatatgtaattgaatatctgaattgtagaattcatgaccttgaatgtgaagcactctctaatatgaatacttcagtcatctgattgtcttattctctaatttttgatttttaaaatatgttacaggaagtttatcatgaaaaggacatcaaggtattttttgataaagctaagcatgaaatcaaaactataaaaatagtaggaccagaagaaaatctaagtcaagcggaagccagaaacatgggaatgtatgttttaataaattaaaattaaattaaattattttactaaggaaacgttaagaaaaaataaacttttaaattaaaattgttatgccaaatttgggtgtctcaaactatttgtttgcgtatgcagtagccaacttagactgtgtctatgtttgtacgtatttatacataaagggctgtagaagttacttatgtttttcttttaatggctacgagtccacatatttaatcaaatgatgaatcaaggtaagatcaattttttttaaatgcagataaatgaatagtatgactttcatagcagtgacttaaatttaaatgtacactctgaaggttgtgtgtggtaaaagtgtgtttatttagactgtgggggaaacaggtgctcttactctccagttagtcactgagctagataatactgtaatcccaagaaacgggcattgtaggccttttgtttagccctgttaatgcttcattctactaataaaactctagtaatagtaaaaaaaatcgtgtattcaatgaatattaattgaatatgccaggaactgtgttaagagtaggtgataaaaaggtgaagacatgatccattctcatcaggaaataatcttatctactacgaaccctcatgcctgtgctgcagaagctgaggtcccagagggatggattctgactagattaggggtctagggatagacagaaaagaggcctctgaaaaaccaaactgatgttattactaatgattccataatttattcattggagaatcctctgggtccacattcagaacatattttctttaatatttttcatgattgtacctagtgcttctgtctggtattttgtttgatagttgcttcgaacaaatatggtgtggagacacacactgacaacagcaaaaagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacatataaggatatacatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacaggtactttctaaaattcgatatcaatttattgttaaaatgattatttttcatattgatgtgaacatactgtagtaattgtgtatttagtaaattgagggaacttagttatgttctacagctaataaactttcaattcaagttaattatttttcatttaaaggagtcatagaaaacaacctgaatacatctggaattatttaatattagttataatcacaaatacagttacttggcccatttttctgtttaaagctaggtgaaattatgatacatctgatactaaaatttagagttgttttattctctatagatatttttaaagtagaatttcacaaaacttctgaccaagatagttattgcatacagagttgtagtccttagtatcagaaggaaatttcagaggtacaaatcatcccacagtcatatgtgtagctttatttactgttgaactagttatcacttcacagtgtctgtttgctcatttaactcaattgaaatgggaaaaagacaccatgtatatcagcttacaatgatactaagtttgtttgtcaatactactgctaatactaataataccatttttactactcctgctaagacctcacctttaacaagtgcttattaagtgccaggtattgttgtaagtacatgtattaacacaattatttctcataataaatagaatgtttagcgggtgaaatgttagaatgattgtttttattttgttaagtaagatacatgggaaatgtagtatgctttattaacccaccctatatataatatctatctatatatatatatcactagaatttgtaaatttgagaatttagttcttacttcaaaaatctaagacctctctgtagcaacctgtatatacagcccaactgtatagctgtgttatagatactcagtatctaagttaactatctatatacatcgtaggtaattttccaaagcatatgaatgaggttttgatcatttggcaaggaaaagcagttgtgacaccctagagatatgaaatagtgtatgatttgtaactcttaaaacctagtttaattcagtactgttttcttgaatttgcattgttttctcttaatttgattgaaatgctatagtgtgtaatgcccatatgctttttaataattagatattttcattttatgactataatttatatatttattaattattctcttagtgaactatttaatgaatttacactatgtatttgacatatatccctcttaatattaaacattttaaatcttctaaaagaaaaaaaattcccggccgggtgtggtggctcacgcctgtaatcccagcactttgggaggccaaggtgggtggatcacgaggtcaggagatcgagatcatcctggctaacacagtgaaacgccatctctactaaaaatacaaaaaattagccgggcgtggtagcgggcacctgtagtcccagctactcgggaagctgaggcaggagaatggtgtgaacccaggaggtggagctggcagtgagccaagattgcgccactgcactctagcctgggcgacacagcgagactccgtctcaaaaaaaaaaaaaaaaaaagaaagaaaaaagacttacctgccatctggggcccttgccccttaaagagtaaaactcaggctgtgtctccgtggaattctgttagttaatcaaaggtttaggtttatgtaatacctatggttcttgcttctgtatctagacatgtggtttctatagtctattgacatatgccaggaatgttgcaagatttagtagattggactgaagggtagagaaagagatttgacacatcttgggcatgtggctttctagcttctcatcagctctcttttttcctcttctctccctatctctatttgctcccttgctctaaattttactccttaaattgtataataatatgaatcattcctcagctgccatccttacatttttattcacaaaaacattgaggtatacagcagatgaattttggtttcccaaatttgttggtttaaaccttttcaggaggcagctgggattataaattacaagttctttttaaattaaatgtttgatattcatattgaattatttcccaaattaatgtatgtagattctaattcatgttattatttccagtattgtaggtattcaaaacaaaacaaaacatgtgtttctgattaatagtttagtaggaattcggaagaataaaccaaaatttattattttgcatgatgtgtatttatttttatttatttatttttttgagatggagtcttgctctgtcgcccaggctggagtgcagtggcatgatcttggctcactgcaacctccgcctcccgggttcaagcgattctcctgtgtcagcctcttgattagctgggattataggtgcgtgccaccatgcctggctaactttttttggtattattagtagagatgggatttcaccatgttggtcaggctggtctcaaactcctgaccttgtgatccgcccgcctcggcttcccaaagtgctgggattacaggcatgagccactgcgccgggcccgatgtgtgtttatttatttcacttttgtgcatgtaatagaaagggcctggctggtcttcacaagatagaggtgaaataggttttcttttttcatataaagaatagttgttccataaatttgctttctaaaatagttaaaggaaagttcagtgttgccaggactagcttactgtaatcacaagtcattttttaaagtcatggaaaactggaaacatacttaagtaatttgagacttaattacaggaaagctttgcctgtttacaaacatctcagttcatcttcattcattttttacaaattcaacaaatattcattgaatatcttaaatgcaccaggggctgttgttcacccagtgacaatgaaaatatttggtttcatttaatataggttccgaaatactttagttaaacttaaatataattaaataactaaagtagtttccctctgttggatgtaagcaaggcatttttaaaagtcatttttatgtattcattagcattttcaattactttttccttctttgttactctttttaagaaatatgattgaaaattagcaatatacttacttaagaaaagatgttgggaaagaagatccttattttatttttattaactacaggtttgttgaatgagctttcttgtgttatatgtcatactaagcccaaaatacataattctgtggtaatttaaaaataaataattatataggtttctctctctcacacacactctctctgtctttagaaagatcattgctcctcttgtaactcgtcatggaaagctgtggtccaatttctggggagcattgagtcctgatggatactatgcacgatctgaagattatgtggatattgttcaagggaatagagtgtaagttacttggtttaatattttaatgtgaaataccataatctaaagatgtagtcttgttagtattacttgaaattttttttgcattcatctcttttctttatagttaatgggaatttgagaacccaagaccacttggaatcctgaaatactagtataaaactaatattttaaaaaaatgtttttaaagtcccaaatcttcaaaggaacaagctcattgctgtggggaatactaagagataatatatgtttaccatactcacattatggttgatagaagagtaatactctttatttaaaagcttggaaaggggatttagtttactaactttttaatggttataattaagggttgttttgataggttttaaaatttataattaagccaacagtaacactaacagccagaacattccagtattcctgattgcatgagtttttttgtgtgaaatagctattattctgctttaaatacaagttttttttaccaatattagattttcacttctagagattgaaaagaatatatttgctgaaaagtgtgtgcatgatttatatttatttcagagacaatggttgattactaaaaataatcacaattgaaatagttttgctaaggtaatattggagaagaatgtcattctttttttcatacatatgatggaccagagtgactaagacattacatgctttgccttagttctcaaacatgtcagcctgattaaaaaggggcagtatactctcaggactaaaaggatgtgcccttacatttagaaaaaaaaaggcacacgtttctgttcaaacagttgagtggtaaaaagatgtgttgcttgtggaaatagtaattggtgtggaaagcttcaatctgaatgatgtaaatacaataaaggtttttgttagctgcaattaaaatgcacagtggaggagaaaagactattaagatcgtattctgttgtttctgtgcagttgtattgactctgggtgagttgtatagacaatatacctgattgtatctttgggcacatcacaaatgagggtttgtgaaagtagaatgcaaaatttgtttcaagttgctttaggcattggtgattttctgtccaacctcctgtcattcttgtctaaagtataaggaaaaaaatatggcagaagcttttgatctggaatacacttcatgtccaaaagctacacgaaggagcaactgtgtgtgtgtgtgtgtgtgtgtgtgtataagttgaaacactgaataattccccagagattaatttctgaatttagctgacacgttgtatacagtaattcccctttatctatggttttgctttccatggtttcaagtctactgtggattgaaaatacgaagatatgttgagatagagaaagtgtaaacattcatgtaacttttattacagcatattgttatagttgttctattattgttgttagtcttactgtactttatgtataaattaaactttattataagtatatatgtgtaggaaaaaacgtagtgtatgtgtagcgtttgttactatctgctttcaagcatccactggggtcatggaatgtatcaccctcacataaggcggggactgctgtactccttaaggcatttttctttgaggctagtctagtaagacataatatcatatttccgttaatatctaactgcatttcttggtcaagatcttgccttgatgttctctaaaagaaaggcgcacagtcttaggggcaaaacttgttttgcagtttttatgaaatcagtcatgttcagagtgagaatatagatgtgggaaaggatgcaacgttcatgtgctcccagctgtatttcttcatgttttcctttttctataaaatatttaagatggcttaatgaatggtaagagaatataattttggagaattttaggctatattcagtggtattttggtaaatgtgtaacaactggcttttggaggtggaggattccctgatttaaagtgcttgcccatttgtttggtgtaaatacttctaccatggctgatttcaagtttccaatgtgaaattactgaacatggacttggcagaaaaagttaactttggggagccagtatgagctgggtctagtgcaccactggttgtatgttatgattcatgctatcaaattctttaattttaaatagaaacaccgtctatacaatagattataatagtctaattgtaacaactgattgagatatgatagctataatacaaatgccaaacagataccaacccaaaattgaaatgtatccaaaggggcagtggtttatctcctaaatctcattaaatatagtgtatacaatgtaatcttatatatatatcattgaatatatttgtatgttgattcaataatttatgtatacaaaatctaaacacaaagcatttattttaaaaaggtaaaaatgaaacttaaaattgtttgtatttgtggtatataagaatgtcttctctttactttcagaggagtatggaatgtcccatatatggctaatgtgtacttaattaaaggaaagacactccgatcagagatgaatgaaaggaactattttgttcgtgataaactggatcctgatatggctctttgccgaaatgctagagaaatggtaagatatgcagtgatggcttgcttgaatgttcttataagatggcttgctttaccagttggtgtgtcactgtgttttgatgccctttgtcttgctaatttgtaagtactagccaatttttttggttctgtgttaaaaaatttgggagtaattttggagataatttaacatttacttatagaaatggtatgaaaaatgttagtttttgtgctcgggctaattcataggcaaccgagttggatttcagtaataaagatgtatttgttacaaatcagctttgctcttttaagaatacatctttaatttgaaattctatagtgaaaacttgacctaattaaaattaattagataagcttcgatgaaacaatatttccagatttaagaatatttttgttctaaaattaatgtccacattttctctaactaggtaaaattttaaaattattattaacttcacattcttagaaagcaggattattaccaccaaactagtagaagtgttgagatacatagtgtatttactctaaataaaatactaatgataccttgctgcactacaaatgtacttttattataaaacttaaaatgactagaaaataatttttcaaaatgcataaacatggcttagaatatattgatatgatttttggttttagaaatgatggggctattttatttccgatttccaaatttatataagcaattgtgatttgatgaaaagtcagaaaagttggcaagtatttttttcttagtttaacaaagcatgtattgtttgaatatgtttgttttctctacaaacctgtgtgcattattattgaatatcctcagtacttgtgatagtattttgtgctcatgtttggctaatttgactcaacagcgcatcatggaatggcctctcttactcattttttccgttgtcttatgtgtctaatgaaagttctgctaaggaatgagcttagacttatgtttgaccccaccacacctcccaaaaagaaaagaaaagaagggctgaaagagctggagatgtttctttgtgtgtgctataagctttgcttgttctgcatgttgtctatgaaggacatttcagaatgttagcttttgatcaacagctgctattatttttatttaccaaagaatacctgagagagcgggtgtacaggtcaacttacccaatgcttctcttcattttagactttacaaagggaaaaagactcccctactccggaaacattccaaatgctcagccccccaaaggtgttatttttacttattttatttatttttgtttatttaatatttgatatagtatattgcctagtagtaaagtttctttaagggccttacttgcatttagcttggtaaaatgttgattttcatcagtcatctgtgtgtttgcgtgttttgtgtgacttgggcatgggtcttgtgtgatagtcaactcttggttctttgagctgatttatattttatggctgacaggtgagaaagttaaacctaagtccctttcattctttttttaggtttttatttctttttaaagggagagaagagggtagaagtaggtataaaatagaatttgattacagtaaggtttaggtgcaccttattgagttattaatcactaactcttttactattaaaacaggtccaaaaagaaacacattacctagtggtgtttgccacatttgtctggtttggggcaagaatatgagactggttttctttatctgcctttataatgtatgactcatttgcgtgttagcctttaaacattagaaaaagaaaggaatgaaacagactggtgaaatataactggcagtgaattcttgattaaaaatgtgatgctttctttgaaagagaaagaagccaaaagaggtataattcattgcactgtgtctcaaaaatatttctgctttcaaacaggaattttttccccgatgtctacatctaggatcaatgagaaagggacaaaaacagtccattcttctttttttcagttgagtgtcagtgctatctactagttttgtgtggtgtctgaattcataatcaaaatttgagttttttattttaaactatgcacattttatatgaatactaaaaatgcatgttcataaatgaaatagatagaaattaatatcttctatatatttttcctatgattaaatttacttttgtacctacctctaagattaatactgttattttctggcatatagggtgtatttatgtacatttctaatagacatgaatttggaaggctattatccactgctaattacaatacttcccattataacaatgacctctggcagatttttgaaaatcctgtggtatgtatttcatactcaactttattatttttctataactgtaagtggttataaatcagttggttaataatatgaaatgtggttagaggctttttaaaatgacataaggtgaaatgcacatcaaaaccacaatgagatactgtctcacaccagtcagaatggctattattaaaaagtcaaaaacaacagatatgggtgaggctacggagaaaagggaatgcttgtacgttgttggtcggaatgtaaattagtttagcaatttggaaagcagtttgaagatttctcaaagatcttaaaacagagctaccatttgacccagcaattccattactgggtatatagccaaaagaaagtaagtcatttgaccaaaaacacacatgaacctgtatctgttcgttgcagcactattcacagtagcaaagacatggacttaaactaggtgttcattaatggtggattggataaagaaaatgtgttacatacacaccatagaatactatacagccataaaaaagaacaatattatgtcattttcagcaacatggagagaactggaggccattaccctaagtgaattaatggcacagaaaaccaaatactgcatgttctcacttatgagtgggagctaaacattgggtacttgtgaacataaatataggaacagtagaccctggggatcactagaggagtgagggagtagggagggggacaagggttgaaaaaccaactaatgggtactgtgctcactaccttggtgatgggatcagtcataccctaaaccttagcatcatgcattatacacttgtaacaaacctgcacatatactccctgaatccaaaagctgaaattgtttttaaaaagtaaataaaaagaaaaaaattaaaacgacataattaattgtatttcatgatctatagagtagatctaaacttgaccaataacttgtttttattaagacacttattagctttggggaagggaattatcaatttgttctcttccaatattctattatttttgttttgtgtattcaaaagcaccatccagttttaatcacaattttagaaacatgtttacaaatagttcacatattataatagtttgattttttagaagaaaattcaaaaagttttgtttaggaaaatacattttttaaaattattttttgacagttttgtgaatgtacatcaaagatagccagagagaattgcagagaaagctgattgattcagcatatggagtcttaacttgaagaaacaatttccttttaaaatctgttttcttcttctttttttttttttttttttttttacagatttgagtggtacagtaattagctccttttgtgttttacagggacatctttttgttaggcaagtggcacacttattcaagggaaaatgctgtcttcaacaatcaaacctgtaacactgctgtaatgattttccccttgccaatagtaaaagttttaaattgcagactcaatccacctgatgagaattgtcctttattttgtaggaatagttgagatatggggatactaaatgtagtagtctttgaatattctgaataggaaaatattatcttttgacattttgttattttaaaagtacttttgttccattttaaccacataccttcctctttcacagaaataaagctgaaaagaggtgttttctagtcgtgagggtagaattccatatttcacttcaccattgaatctcttggtgtcttgagggatagaattatttgatttcttgggtgacattaggttcctggtcagatatcctgaattatatcctgaattgtagatatttgtgtaagaattcaagtctttggaaagtaagcaatgaaaatatcagaactgagtaggaacaagttttctttccatggctttctttgttaaagcagcctgattaatatgccttgtgagggataccccatagcaaaatgcttattgattatcccattatcagaatttctaagaaattaataaagtcacagtttgctcaatgatttgaaaggtgatctaaaatgaaatgtgaatactaatgccctaaaataaaatcttaggggattttttttttactttaacttgaagaaaaatcagtattgatgcacaggaaaaatgctataggtaaaagttcttaaatcttatggatgattattcaatttcttgccacattttagaatcagaaagctaattaatattagagggaataatgagataatatagaaatctgatccatatatactatataaacatgaaatttattaaaattttgaagatacctttgtttcctccacataaaaaatgtttgagttacatataaacagatatgcaaaaccagtgacataaattatggtataaatattcagcccctaaaatctagcctcaaaagatgtatttaaggcaaatatcttttaaaacatcttttgattggaattattttgagtctgtgtctcacttcctccctgctggctctctgtatttgcactttgtaaagagaaaattaataatttctagaaatattctaaatttcagaagatatctttttggatatttatattactccatgtattaataatattttagtaaatatccatatttgaataaagaacttgtcccaataaaataattctttagcttttgttgaaaaaagttgagatatctttgtgtgtggattttatgccagagattggtcaaaaagaatcaaattcatggattagaataaagagaaaccattttttaatatagagccctaacccttaattttagtaactgaaagaagtgcaagtgctagtaaactcatgattattccttgataaatattaataactgaagtgaaggcagaaattttaaaaactcatttaaaaaatcaaatttagagtaatttactatagacatataagacagaccctagttaattagttcactaattcatttttacaaatacttgttggtagaattttgctccttgtcttttacctttaagcacacctttatttacctactctgtgtatatattaaaatactgatggtccccaacttacggtggctttacttaggaattttcagctttatgttggatttatcggggtactgtgtgtttttaacctcccacgggtttattgggacataaccccatcgtgagtcaaggagcatctgtaaaatgtgtaaatctattcactgtaagattacttaagttttaaaatcctgaggtacaatatttcataaataaaaattttgtatttcatagaatgacataagcatattcagaaccaggcaaagattaagctatatactgtgatttctgaaaattactattttgtccactatacataatcatttataagttgaataatttctaaaatgcatatgctttatacttttcagtgaagtatttataaagatatttgttttaatatgtacttctttttataggactggaaggaaaagtatataaaccgtgattattcaaagattttcactgaaaatatagttgaacaggtttgtattaatgattacaaagtatagaaaattttgctgttattttccagaagaaatattattaatactactttcacagaagatgtgaaagtggagaaactaccttttaggtaaaatttatttgattcaattactgattaaatagcattaaggaacatacagttgtaaaatgtagaacatagaaattaacattttaaaagcatgcctttttaaaaagcatgctcctatgtgtcatagctttctgaaaccactaaaaatagaaactgttgacagatctctgatgtagaactcttgcagtgaaagcttatctttggaagaaactgggctgtctttctggaagagtcttttctcagagacatctttgaaacatgaattctcttttagcttagtgttcaaaactattgttaatacctaatttttgagaatgtaagatgtcatcaattctgaggtgcaccattatttatgtaccatgagaaaaaaaatactgtcaataaaccatgacagaaaactatgtttcctagtcatacaggattttttattttacacatattaaaataactattttagactattaagacacagaagttattatgtcttctaacgatgatgcatattttatagccctgtccagatgtcttttggttccccatattttctgaaaaagcctgtgatgaattggtagaagaaatggaacattacggcaaatggtctgggggaaaacatcatgtaagttgtaatttcacactaagaactaaaatgtatgtgggggttaagtagatactcagagaattcggaggggttatatactttttctcatatgtctctgagttctagacttagataaattggctagccaaggctctgatttcagtctacttctcccaccaaccaatttttttaacacttaagtaatttcattagtttgggcgggtttctcatttatgcatgtaattacactggatgttccctaagggtcgatgtcctcaggccagagtttgttaggtaacacgtctttacagagtgatatcactcttttccaaggccactttttattccttgcgttttcacagtgagctgtggtgaaaattctaaggcaaatgttatctggctctgaaaactgtttttgtgtgtaaagataggaaggagggatctgagtgccttaggtgtaattcagttttgcatttgcattcagtgtcaaagacttggcaggaaatactactgccagtggttagatgtgtttcttttcctctgagaacagacatgccattttagcagaatactctggaatattactgcctctgcacggttatgtcccccaggtaatgagctgataagggagagggaagcttaaagtataaggaagaacttaagtcagcgggtgatgaaataatgaaaagcaatcattcaaaaacttttgagtgttacaaatagaagtgaggaagggcggggaaagcttgtttttggtgtttggtaatacagacagcagatatgccaagtgtatgctcatcaagcagctgagactgcctaaagggtcactgtaaaaaaagactcatttttaagaaaggatgtgagggcttaggaagtcaattttatttactttatagctaaacttcacatatacatttaagaagtaggaaaggagtctactgaccttacattactttgtttcgtcattgtatcattgacaaagctgttacctaagttattttgataattttacagttaaagcagatgatataccacattggaacaactgttatttttattgtctattatgatctgtggttgaaaaaaaatactataatataaatgggaattgcacgtggagtacagcttattatgtcattaatgttgtttctaggatagccgtatatctggtggttatgaaaatgtcccaactgatgatatccacatgaagcaagttgatctggagaatgtatggcttcattttatccgggagttcattgcaccagttacactgaaggtctttgcaggctattatacgaaggtagttatcctctcacccctccagcctatttcttacccatttttacacaggtgttctttttaatgtttttattaataagcaaatccactggcttactttgctttttcagggatttgcactactgaattttgtagtaaaatactcccctgaacgacagcgttctcttcgtcctcatcatgatgcttctacatttaccataaacattgcacttaataacgtgggagaagactttcaggtaattatgactcttgtgtttttagatttttcaaaagaaatatatcattatgaaaaggactttgccttaggccttagtttcttttttaaattttgctcaaatgacataatttgaattttgccactggttaaatataatctgatgtatttcttcattttaacttttttagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaagttttgttgttctattattggtgtttatcttccaaagtgaatacatgatggaattgtctgaaagaatgaagcctttgatttttcattttgcttagtagatttaatgatatacgaaactattgaattataaatgaaattataaaatcttcaattttaggatgactagggatttgatctaactcgttttccaagtgagaaaatagaagccaaatgttattcaatataggtttatttgtttattaatattttctgggtctctattatgggtcaggcactgttccaggcaccaaggatatgttgatgaagaagacattatagtcactgtgagatggacttaaaaagataaggaagttggttctactcctgttctcttctttggcgacacttaatacccaaagaaaatttctactatccatcaactaggataaggagacattttagtaatgatttgtgaattatgttactgtacatcaggaatggttttcaaaatatgtaacacctggtatgatgtagatgccaactcatcggaacagactctggttataaaagcagatcggttcgttcctaccagtgcaagccagcttaatatctcttgtggtacagttcaaagacatctcccaggtactagttattttccattttggtatccatgggtggttacttagcataactatttcagtctcatgccatgttttcagaaatgggatccaggtagtctattgagcacagtttttttgtctttcctcttatcctacattccatgaaataatataaaatgtagctttaaaaagatgattcataattactgagagaaaattagaaaaattcccataagtagattaaaaaatttgaaaaacggaaaacgagtagaattggaaggatggagaaaaatacagcttgaaacacacagagcagaagatacagaaagtacatctattgtttgattcattcattttatgcaatataataaaggctttttaaaaaaaatacacacacacacccatatatataaacaattatcccctgaataatatgggcgttagaggcactgatccccatgcagtcgaaaatccacatgtaccttttgactccctcaacacttatcaactaataacctactgttgactggaagcctcactgataacataaacagctgatgaacatttattttatatgttatatgcattatacactgtattgttacaataagctagagaaaacgttatttaaaaaattataaagaaagataaaatatatttactattcattaagtggaagtggatcatcataaaggttttcatccttgttgtcttcgcgctgagtaggctgagaaggaaggggaagaggaagggtgtctcaggggtggcagagacagaaaaaaccggcatacacatgagcccgcgtagtttaagcacatgtagtccaagggcttattgtgtatctgcaacaatcagatatctctgacagatgaacctgataaagtcacactatttagagtatgataccatttatgttaaaaacaaaatactatatatgtgtgcataaacctacagaaaatttcctagagaggaacaactctggagagtggtatgagatcacggaggagtaaataggatttatgccttttaccttttacacttgtgtttttgaaatattatagaaatatatttgtatattgattgtttaaagaaaaaaagactagaaggaaaaggagacattcacgtaactaatttgaataaatggaagcatatggatgtcaatagtaaccgtgtgtgtgtgcgcatgtgtgtgcacaagtgtgcatgtgtgtgtatgtgtatacatacattaccaaggtgctttaaatgctcaccgtggtagaattttttctaattcttaatgcgcataggaatcaatatgaatattttccttaatatagatacttcagtagtcatccagtgcattaatcttcattctgcttcatctttgaaaacactagtaatttatctgtattgg

SEQ ID NO: 11878 - DNA, 11668 bp, Human
actgggctgggtgtggtggctaacacctgtaatcccagcacttcaggatactgatgtggattacttgagcccaggagcttgagaccagcctaggcaacatagtgaaaccctgtctctaccaaaaacaaaaacaaaaacaaaacaaaaaaccaaaacccaaaattagctgggcatggtggcatgcatctgtggttccagatactcaggaggctgaagcatgaggatcacttgagcccaggaggtggaggctgcagtgagcagtgttcacactgctgcattccagcctgggcaacagagtgagaccctaattcaaaaacaaacaaacagaatgagagagagagagaagaaaagaaagaaggaacccagttaaagaagttgggtccatttggatttttcctggtttgttttatctgctgccaccagcagcctcctgaagttacaaaaataacacaaagtaaaataaggcaaaaccaccatctgcttgaaagagtttacaaacctgatggtggtcgtggggtggatggaagattaaaaaaatggggacagaagtgaattagtgcaagccacttgcactgacaagatggggatggacttctgtggaaggcagaggaggtcatgcctcatgcccctggtaggaaaagtggccaaagagggcttcagagaacaggggctgatggatgggctacatcttgatgtgagtcaagctcctggatggctggagagaggaaggatgttctagttgggggaacagcttggacaatggagacccaagaaagccatgttctagcagtgtgaatgttgtggatgctgaagtgccaggatgcaaggtggagaactgggaaatggccctggaaaggggccaaagccgggtgatgaagcaccttgtctactgtgacggagcttggatctctcttgtggtccaaagggaaaggattgctgaatgtaaagccaatgtcaccagaaaagctgaatccacaagagagtcctggagtccaaaagagcatctcatggggaatcaggaaagttctggcatttggcagattaagcaagtgtcttgatttgaagtccagtttagtcccaatactccctcccacacccaccacatcgcacaatttggttttgtttatttactccaggttaaggtagagtctcttagcttggtttgagtgctgtactcttctctctggtctgatatttggaactaaagccaagccagaactccagggccaagggggatgttgaaaattgtctgagtccccagaccaccctgccagctcatggcaaagggagggatcagaggccacagggaaagcacttcagctgctcttcacagcatcaccctctccccatttaatggtttaggttaacaggactttttccttgaggcttgggacacggaagggagcctcccctaaaccaggcccttggagagcaggccccaggggagcagtgcaactcaccttcacacccacaagacggctcctgacttctgctccctcctcccctccccaaagtggaacagagagaatatgattccccacgacttccacatcacagtttccaaacaatggggaaatcggaggcctccccgtgtgcagacggtgatatttaccgccaaatgcgaaccaggcagatgccagccccagcacgcacgcaggtaacttcaccctcgcctcaacgacctcagaggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggtaagggcgcagcgtgggggacccgtgctctttccccgggatcccctgtccccgtcctcgcgatgcagtcggccggctccggctccgaaggcggacctgggcgcctctggctctccgcggtcccgagttctcgacaaactttctgcgccgactgcggcatgagaagccgccagtagctgagctggagggcccacgtccggcccctgggcggacggccgcgaagctgcaggcgctgtctccagggagccggcggcctcctctcccccaggggctcgcggcggtccggaggctccgagagcttgctaggaggtcttgggacaacccggtctttttttttttttttgagacggagtttcgctcttgttgcccatgctggagagcaaaggggtgatctctgctcaccgcaaccttcgcctcccgggttcaagcgattctcctgcttcagcctcccgagtagctgggattacaggcatgcgccaccacgcccggctaatttttgtatttttagtagagacggagtttctccatgttggtcaggctggtctcaaactcccgacaacaggtgatccgcccgccttggccccccaaagttctggcattacaggcgcgagccaccgcccccggccagcccggtcttttagtatctcttgctcccagtttccaggataggtgtcacatcttgaaagtcaaattccatacacgctatcgcaaattaatgttggaaacggggcagcagagaaaaggataaaagtcataatgaacgccctgccttccggattttttcggattcagacccctgaatccttgtttccttgcccaccttagcgcacccgaggtggccgcgctatgataattacatgataactgggtcaattacaatgcagaatagttgggtctcttctctccaagacctagctggggttaaaaacaggtggccggggcgggagctgtcctagatcctgaaacgcactgtctagtttcggatgccctcaacagaaccggggtggacggtttatggcgcagatcctgggttgagggcacgggcagccatttggaatgatcaaggctcaggtaaggggcgtttccagcgaaggagagacagtccacttggcatttggattccccaaattcttcatgtttaaatggggcagggagggttcttacagaatggctggaaggagccaaggaaaataaaagtgtgtgtggattttttttgtgtgtgtgtcagtttataaactctgcacagattatggccactttaatgacttactgttcctttgatgcttttgttataggactcgatgcatgtatgtcatggtgtaaggacaaaactcggcccctgtgctcctctaatctttacaaaaggtcatggccagcgtgcagttttacagtaacaagcaaaatgatttgttgagctcatagagagcccctcacacctatgaagttctaataagtgtagttctactataaagttaatctcaggatgagcaaatttcaagtttctatttttccagagctttccatttttggattataatactttccctacttaaaaaagcacaacatttgatatttccccaataatttgttgctttaaaaatgacacaaaaggtactatttgttcattgtagagaactgaaaatacacataagcaaatacacatacacataagcaaaatatacaatacaaacacaagaccatctttcagggaagaatctgaagttttagcaatagcagccatctaaccagtttagcaacagaatataagctctgagagggtgggagtgaatatgttaccacattgtacaacacagcacatagggcataaggaggggaaatgctctctggggctttccaggaaggcctgaagtcattgcttctagcaaatggaaatcactccagagtagttatctttgacaagaattgaaatataattgagggaactatcagacctgtaagattttgttttttcctttactaatatgttactttacatttgcatttggtgacatacgtaactaccatttttctgtgactgtaacatctgggcatttttcagagctaaatgtgctatggtcaacttggagctttaatctaattgcctggtccaccaagttctggctgtgtacttgaatagatcactggcagggtacaatgggaacagcctgtcccttggagccaggagaggacaccaaggttgaccaaagctcgttcagttgcccctttagccgaagcgcacctgggccagtcactggctgccagtgccatctaatggctgctctgaaaatgctcagccttgcccggcaacccttcagaagctagcaccgtgcaggcccagcgcctggggaatagggcgagggtggggtagagagaaggaagtggcctcctgaagtagaaatcagcgcttcagaggactttcacttccaaagcctcccctatataaaaaagatttggcccacgcctccccaaatgagagatttattttaggcaaacttattttaaaatgccagcgttcattaggagtgacaagacacttagtcatccacgctttaatgtgaattacttttctcatctaattacatttctttctagcagctggctgagaagatcttctgaaatccaaaatgattgtagggttggcggtgagctgatctccggcctcgaggtggcttcagggggcccacctggttaagggaaatttggcagtgcgagggtagtgctggagagaggggtgggtacagggggctaggggcaccatggatgccccctccttactgtcccctggtgtcttgacctcagcttctgcccacaggcacttgctggattctccaaaagtatctgcagtggctgttccaccaggaggtaattcccttctggtctctttcccctccacatctgcatcctcttcaaatcctgccatttcagaccacatttgagagctctagagaacaagacatctgacacgtgacgtgtccagaagatgagccagatttcaaagaactgagatctgctttaaaaacgaagctctccaaagttactggagtctgggtaatagtgatcaccagagtaatttgtgtgcaggacatcaaatcaggctgctcgaaatgctgcctaaattggccagtggttttatttgcttttctgtcaacctaatattcataggaaatagagtttcagaggaatgataggatcctggtggaataaaaagggaaaagaccatcttgagcaggagtttcagggtcctccgtttttcccaagttactttcactcctgagatcttgcatgttagaactacagcttaatgtagtgaaataggaaagttctctgttaggagcttagccttaccttgtcatggacattaaagtaattgtctctctttgggcttcaattttcccatctctcatgggaagggctgaaccaagcaatccccaaaatagcttccagccttaacctttttaggggtctcgtttaaatagaagataacagggaaatggtcacagtttacccaggtccattccctcctccttatcacaacttataccaccgctgtactgcacacctcctttctcagcattgctgctgtccttaaaatgcctttaactccacaagagagtgtgttgttaatgttggctcaaggtccttcctggtgagtggccaacattgttttgctccttgcaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggtacgtgggccatgactgccatcttggcttagacattagatgggactggagctgggaaagctcaaaagaaaagggtgtggggaaagggaaattcattcccagtgataggcgtgattcaatccagggcaggagcaaaactttgcagtgaagtaagaaatgggagaagaaatcagggaaggaagcagcttcagggagaggggttgagtccacaatttctgcttggttatccttacttcttgccccatcttttatggagaccttgaaccctttaagctagagatggtgctataagagcaataatggacccctcaatctattctgtactttaaatctttagcttcccaaactattcctttttaagaagctcatatcacttgccattttcattccatatttcttacccttttatctactaccggttgcaaaaccagccaggtagttcttcaaatcatctctggaagaaggaaaaaccaggggcccttttttttttttctttaattggtgccaaatgtctcatgtttattctggaggactggccttctgctgtgttcctctacagtctttccagagcatgtgaaggccctttgcatcaggcaggagctccctccaggtcaccacagggtgtatgtatctgcctgtggggggtgtgtgtgtgtgtgtgttggggggcataaatgagtaatgatgccaaatccagagattaaaaggcacactgagaccaggcgagatggctcatggctgtaatcccagcacttttagatgctaaggtgggaggattgcttgagcccagggattcaagacaagcctgggcaacatagtgagacctccacttctacaaaaaataaaaaagttagccagatgtggtggcatgtgcctgtagtcctagctacttgggaggttcacttgaggccaggagtctgacgacacagtaagctatgatcacaccattgcactccagtctgggtaacagaatgagaccttgtctcaaaacaaaacaaaatgaaacaaacaaacaaacaaacccccatactgttagtgtcagtgaccggaattttaatcttgttgccatcacctggcaggtgctgagggtggaatgtacataactacattctgtgtattttgtcaatgcagaagctgagttaaggtgaagatagaatgaggtcctcaaagacacagaccagttttcatgtgtaatataaaatagaaacaaagagcccaggggattctgtgagttccagtttggaaagacccaagagtctcttgacttgagacacccacagcacagctcaccagggagggtgcactggacacagtcaggacccatgggttctagacccagttttgaggtgtgggaccttgaccaggtcctatcacctctctgagtctcctgtttcactatctgtccacgggaggggagtgtaaattagttttttccattgttaacgttccacagagttgtaattctgaacacctggagtaggcaatgtccagctcaacagagtgggtaggatccttttattttctcctttgctattcccaagaaagagagcagccagtgagcttttcatctttttatcactgaaaactcaaggctgcagcctatgcagccattttcctaagctaatatgtaccacaatagagtcctctagggacaaggagcagagacacaggttccacagacggtgcaatggaaataacgctagctttccacccctccctccagtcagaatgagattacagggaaataagcttgccccagagctcactgggggatctctcagaaatcagctcagaagtcgtgaaagaaccaaggtgcagttttggaggcttagtgcagagatggagctggggtagggcataaagtaggttttccatcactgaggtaaggttgaggcattattttttattttttgtttatttatttatttttttgagacggagtctcgctctatcacccaggctggagtgcagtggcgcgatctcccctcactgcaagctccacctcccaggttcacacaggttgaagcattattaaaaatatgtttaaaaatatgggccctagtagccagacttctatcacctggagagattatcccccaaatttcagccccactcccctcctggacttgaattaaaccatatgtatttattcaatattctttttatttatttatttatttttttgagacggagtcttgctctgttgccctggctggagtgtggagtgcagtggtgtgatcttggctcactgcaacctctacctcccaggttcaagcggttctcctgcctcaggctccagagtagctgggattacaggcgcccgccaccacacccagcttatttatttatttatactagagatggtatttcaccatagttggccaggctggtcttgaactcctgacctcatgtgatctgcctgccttggcctcccaaagtgctgggattataggtgtgagccaccgtgcccggccctcaatattcattaagtgccaacaactaccacccgtctgcctttcttggagccactcctttatgtcaggcatataacagtaagactttggtcctgttcacaaaagctaggggtggctagatggctagacaaaccatggaatgggatgggaagtgtgttgcagttgccaggcagaagcatgaaggggatgggacaaaagaggcagtggcaagatcttagatgcccacgagtgccaagaaagcaggtgggcagacctgctctgtagggaggcctcgacgcttgacacgcccgacactgtgccctgtgtcctcggcacgtggcgagggcggccagggcctaggcgcagtgacgggcgcggcagccgggccggggtgcggggcacgggctgccctcatgccctcgcgtcttcccccaggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagcagcatggatcggaggagcacagtggtttccatgcggtaggatatttcacaggacttagtgagcgtgaaaggaaaatgtgcttcctgcccccacccccaaatggatcttcgagggatcagatagtttgggtgaaggcacagggtggctccagcacctctaggatggccgtattttccacacactccactgagtgggagactgctcagctagcacacgtgtaaaggcaggattcctgcaagagtgaccccgggcgctcaggggctccccggctccggtccacctccaaaagccagttggacaggttgaggcctacccacgcctgggagtgctctggactgtcaggtgagaagtcttggtaatgtctccggggaactgctcgtagcaatccatgggaccttaggcaagtctctgaacttctccaaaatttagttctttcatctacccctcccttcccagtatgagggttattgtgaagattaaaggagaaaatggacataatcttctttttatcatagaagctaagtgtgagagctgagggttagtatcagttccaatttcactcccaggctactcacagatacgctcagacatacggtctctctcacacacacacactcatggagacacacatctgtttaatacaacatactctacgcagttgcttcttccagcccctagggcttaagccctgactcaggccctctgacccctcctgccgtgcccaggctcctccctccccgcgtgtttcagctccagcccttctcatccttagtacttcccccaggcctctctgataacagcttcccaaccaactggtctcctagtttccagctgctctccccagcccatcatatacgaattcttcacgttagtttacacaaaatcttgctttttcccacagtcccaggctcaagagtcaaaacagtgcccccaccccaatttctgtcaattccaaactactaagcatggtgggcagggcccttgtagacgggcactctctccttaccaaaccctgcttcccaagtttccccggatgaaggcgctgcctcacactcgttggtctcctcacaggtctcgcatcctcctataccctctgcctggaaccccccaccttcccctgccattttgttgtcattgttgttgtttttgagatggaatctcgctctgtcacccaggctggagtgcaatggtgtgatctcatctcacttcaacctccgcctcctgggttcaagcaattctcctgcctcaaccttccaaatagctgggattacaagagtgcgccaccacgcccggctaacttttgtatttttagtagagatggggtttcaccaagttggccaggctggtcttgaactcctgaccccaggtgatctgcccaccttggcctcccaaagtgctggggttacaggcttgagccactgcgcctggccagaaagccagattcttaagacaaggtgttccccagtatggcttacatggaatgtgctagaatgaataatggcctaggccttcctgaggatgctcccatgctgggcatgctgggcctgaggtttccatcttggtagcctcctttcccccacaccttctccctctgagacaggtaaagtcatggttggtggaggtggctaaatgtcagtggtatactgttggtattttcagatcccgtttgcttctcaaaaaaaccatttactttaaagaaatcaaacagacagccatgtggtgacaacattaacatttatttgaaaagggcatcgtgatggctcactgggagatcgcgactaatagtcctagagaatgattttgctaagaatccttcttcctatacttccccccactccgcctttcccacttccctaaaataaaactaaccaattcaatgggtttaaaatacagaaaaccgccacgggcactaattctgcactcacatataaata

SEQ ID NO: 11879 - DNA, 26105 bp, Human
agctgtgttgagatctgtggtgctggtcacagagcctggctgcagtgagggctcaattgctccatgctggaactggaccagtcctcagagaccatctgatctgctcattctgttgttcaaatggggaaacagaggcccagtgaggcctagcggcttgtttaaggtcacgctatggaagaagtgacttgaactcacttctgattctgaggtgaaggctcttcccattagtgccagggccacacaagtgtttcttgttttgagtgcagatgggtggcttggaagtcagcaggaggcacaggtgtggtgacttgatgggctcagggcccaaagggagggagggcctgggagtggaagatggaacctcattcaagcccgtctctcctttcttctcaccagaaactccccctttctttggacaactggacccccacacctccaccctgtccccatcccttttgctgataatcccatctccttgccctgtaaatgctagggggcccttgatttggggaggaagggaaggctgaagccggtcccggcaccctgagagccccagggccctccaatgccccactccttctccaggtctgccctggcttgctctgtctccctagggcagctggcttttgtcccaggggagcatgggaacagcttgggtgagaatgggggaggggcttcccagcaggtttcacctctcccacctggcataatttctaccctgcacccagtgatgcccaggagccagcacaagaacctctgagctctcctgccggctttccccactgtggggcccacaggatggctgggtgtgctggggaaactgagggagatgacttgtgggtgccagcaccatgggactttgggtgatcttggacctattccttcctccttctaggtgcttcctgagctggcgaaaaggagagctggatgctgggattctataaattcggcggtggatgtgagtctagctacagcatggaccctggccagccctggaatctgagttcagagatctttgaaaaaatgccttccgataactgagcacctactacatgctggacactgcaccaggagatttgtgtgcattccctcattgaatcttacaaccaccctctgggatggtttttgctattaagccgattttatagatgagaatactgagggctagaaaagataagtaccttgtccaaggtgacacggccagtaagctgtggagtctggatttgaactaggctctcttggagtttggagcccggtcttttcatttctggcagagacctgtggcttcagggggcggagcccagcccatgggggaagtaagtccttcctgttagatctgtctgaggagtagtgagtttctcatctaggaaaccatcagcaggccaggctggactgccccatttctagccccctttcttctctgcagactgccctgtttctagccccttttcttctctacccttttctgtagagtgcgttagacccattttacagaaggggactctgagaccctttcttctctgcggggcagggtatgtggttcagacgagccgcttccatccccagttctgtccctaagccctgggtgacctcagcattgagcatcgtctctgagcctcagtttcctgtctatatctagtgccaccaggcatcagaaacgtaagtgcttcaaggatcttgggtgaaaagccgctttagcggcgagcatacactaattaataaaatgccttggccggggctgggcagaggaagtaagcgggcagccgaggtgacagctggagggaggagcgggggtggagccgggggaagggtggggaggggatgggctggagctccgggcagtgtgcgaggcgcacgcacaggagcctgcactctgcgtcccgcaccccagcagccgcgccatgagccgtgagtgcgaccccggtgcccggtggggaattttcttggcctcctggtggagccttgaatgccaggctcagcccctcatctctctcctctgcagggagtctcttgctccggttcttgctgttcctgctcctgctcccgccgctccccgtcctgctcgcggacccaggggcgcccacgccaggtaggcggccccatccctccccaagggaatccccggtcttgcgcccctggcctggtttcaaccccctcctttcccctccagcgggcccagcttcccctttctgctcgcggtgctgagaaagactgaggctgagtcttttggtgggatgggggctccctgaagcccccccggcggtgtggccttggctaatgggctatctagttctttcaggggaaacagcagactgggatctggtgccaacttggggagaagggacagtccctatccatccccctcacctgttctgggccccagatgtctaagcagcctctgcacccaacaaccccgctgtttcctataggggcctctttgggaggaagccgcaggcaccaagggaaatgagttccctttctccagcctctaaccgtctgggaacccatcctgattcccattgccagtggagaaggtctcccctggtgaagacttcgggagaacatgggagatggaaatacatttaggagccgggatgcttcatctggggtttaagagatccccattgagcaaatgaggaaaccgaggctcagtaggtgccatgattccccaagctcacaaaatacatggtgggcccaggatctgaactcaggtctgtctgcgtccacacacttcgcaaggtctttccacagaaagctgcttctacccacaatggacccggagccactctgggtttcatgggggaggttgatggggaaattccgcccttccctcccccatgcatgtgccaggttccaggtgaaggaattcagctcctcgctcagccaaccttcctcccccagctcgctgcttgtgtgtgtgcgtgtgtgtgagcatgtgtcccagttggatatagtttcctccaccacctagctgtgtaaaatctctaaaatgaggcccagagagggcaggagggagcagagggagtccgcactttctgctgtgatgctctaaggatctggtgcgtgggggaaagaggaaagatatgtacatggattttggatcagaccaagtttcctgaaacgggctttgggtgggtggcatttaggggacccaaagagaggacggagggtgctctaggaaagggattgcgttgaataaaagtctggtttatgggaagaggaggaggaagactcatgtggccagcactttaaagtttacaaaggttggttgtggacatccacctctttggtgctctcaacagccctgccagagagatgcgttagacccagtctacagaaggggactctgaggcccagagggagtgaagccacttgtctgaatcctcacagtgagctggtggtggggagtagaaggggctcttcaggttgcctcgctgacccatcttgtcagtccctggatcagcccagcacttcctctgaggccccatctggcctcatccaggcactcttggtatacaggtcccacccgtctgtattcttttttagtccattcactaatgcacaatgagccatggtctgtgctattttgttttttgccttttctgtttccttttgtataataaatgtttacacggaattgtttttttttatccccaagggttatttatgccagtctttggctggggcctggagacacggagctgggaggagctgacaggctgatggtggagccagaaatgccaacagactgtcatccaaggggaccagggctgtgcggagctcatgggagggagcaggggtatagggagcccagggaagggagcaggggtgtgcggagctcaggggagggagcagctgcctctcagtgcgaagaattgagggaggcttcttggatctgatgacttttggactggacctcgaaggaggtggcgggtgggggaaacactaagagactcgaccaggaaacaccgtaagggtaatgtggagcaggaggctgaggttggatgcgtaatgtggggatgagactggaggccagaaaactggtaccgaggctcctgcaaggatctaggaaagaacgaatgactggtggagtgcaggggcagaaggtctgggttgccctcatatttccaagtctgcgagtaaactgagggccaagctacttgggcatctgccccaggaagccaaagcctgtcttttgcctctagaggcaaaggagatgaagagatgagggctgcactcacctaagagggcaggcggagggagagaatgctgcttttgcctctctggtgggtgaggagatggaggccagcctggaggcaaggctgtgccgggggcgccctgaatgctcaagtacttcccctctagtctctggacttgactcagtgcccatcttctagatggggatagggcatgacctggcaaccagagctgcatgccaggcagaggagccccaggccagctgacccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattactctttaggggatttgggtcctgcctcttcactgggcaatcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggtatgcagcgtggtgtgctgatcatctctgcctccgcgtgtcttggggactcagtgagagcaaatgggaaggttctctgctgatggggcagttgtgggagggttgtattgatacaaataatggagagggacagattggctctacccagagtagagggcctggacgtcgaaaggaaggcctcctttagcccgcctgctaaacccccttcatgggatatacagaaaaatgaggctccagaggtgggagggactcacccaagaatgcacagccagtaagagcagccactctctaatacagctctcccaagcaactacttggtgcctggccctgtgctgagtatgggggactcaaagtgaattagacttggtacctgcatctccttggttttctttcttgatgaacaggggtgtcctccactgagcatagaactgagttggcgtgaaaacatgcaggattgaagttagaccgaaggaaggccttcctgtacgaatacttcctaaagatctggttgtggcaggagatggtgatccccctggggtcctggtttcattcgttctggattttcaaggttcactttgaaggaatgtgacaaatccaactcaactgggtcatcctcagtctgcatcaaagcgactctccctttccatcccttccccaaatccagtcctgggtacctccaggagtaggaggaggagggagattaagtcttggctccgcaacttcaaagcagtggggtctgggcaagcctcctgctttctctgggccctacattcctcattatgcaatggggagtctcacctacctctcttagggagtgctggggagataaatgagcgtgggtgtggaaggttgtggacttggtcggctggagccctggctttctggctgggctgtgatggtcaggctgtagtctagtggcacccagtctcctctccgcccaccctgacaccttggggcaccagcggcaggcccactgttgtccttcctgggagaacttttcctgccccagagcagtggtgtttatggaaagaacgtggcgggggaggcgggaggggggaagctggatgggccggactgggagggaggagcctcagctcccgcacagcctctcttggcagggagggtgtgggcagccgttccagcttcagcgtctggagcttgtggctcttctgcctgccgaggcagagctctagggccatggcgggaggccttccggctccacctcagacagctgttgagggcctggaagatgagggactccttttggtcaggctggaggtgaccaatctcctcacttcattttatttattccacaaacattcgttaagctctggctaccacatctggatcccagacctggttaagccccaactgtgtgcatagcctgtgctgggggaagagaaagccttaagggaagcgggggtcccttctcctggaagcttatggtggagaagagcaggttgaattggaacccggagccagggcaagggagagtgggaggagggagtgtggacatttggggaagacttcttggggaggcaaggcgtgggctcagctgatttggaggaaatgtattaaggaggctaacagcctggatgaaggatggagatgctgagggtttggggctaagggaggggctggcgcagaatgttggagctgcacggacctctggagttcattttgagatccctgctgtggcagggatggggaaattgagcctaggggaggcctaacccctgtgcccttagagtggtagaactagaccgtgagtcctagcggaccttgtgtgccagggttgggagctgggcagtgggtgctacaggggctcctgggcaggtgagagagccaggccagcaggaggggcaagaagaagagttctagcagggtgacaagtcctttcttgggggaaccagacctctgagccagcacgggggctgctccagaggcttcttggcctttctgggcctgtggctgggggaggcgggggctggggtactgccaggccctttccctggatcctgcctgccaggtttgcctgtggctgcctgataaagcctttttgtccagccttcttcccctgacccctccctcctacacccctgctggggccattgtggggctgtggggagttgccagggcttaagcaaaactatttgcatgattcttgtggtccttgcttgtgtgtgtgtgtgtgtgtgtgtgtgtgtgtgtgtgtgtgtgtgtatttgaggtggtgttgccgtcttcgaagtggggaccaagaggactctgctgcccaggtcaagccctgtgctgtgaagtgaggagtgaggagactgagaccagggcaggggatagggggcaggtcttgcccagggtcatgctctctgatcctagcaccctgagatgacagcatttcaccctcagctgctctggcctttcactacccttttgacctgcaataaccagttgcacaaagaatccatattccctgtaacgttggctctgagcccagataaggaagtatgtttgcagaaaggagcccggcgttttctgtgtaaggtcagagatggagcctcctgccaggcgctaggagtttttggtctgcccagctctgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcttctggatcctagagcccagaccccaccctgatgtgggccaagtctgattccatcaggaatgggggctgaggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgggagaagtccccgtcctcgtcctcgtcccttttctgaccgcccccccaccccccgccccggcctgctcttgctactgaactctgactaggcaggaagtgaacgctctagaagcccgtggctgaggagttttatcagctctttcttaactttcagtgtcacagccggggaatcttctcctgccgccgtttggtggcaatagggagggagggggcgcttcccctgggggcctgatgtgggctaggctggagttccagagcagggcctggaaatgtcaggatgggtggtttatgttcacagaggtgggaacaggggtccccttgggggaaccctgaagccctggcacccagtgattcaggacggagctgcgacttaagtccatgcctctggcccctcattcccccatcaggggctagatgggggtcaggaggccaccctagcatggtctctgacctccatttctcacccacagtgaatccctgttgttactatccatgccagcaccagggcatctgtgtccgcttcggccttgaccgctaccagtgtgactgcacccgcacgggctattccggccccaactgcaccatccgtgagctgggccttcagccctcactccttccgtcttgagcccttctgctccccgggccctttctcctagaccctaacttcctaccctcctctctgaccatggccctgttctccttccttgcctggttctgcccctctccctgacctggcttcagcatgagctctcgctcttggtccaccctcactccctgcttctgagttccatggtgagtcttcaccacatgccctggcccctgtcctcacgcccggttctgtctctgtcatgtgtcattgctcccaaggttccatccttacccacttccccataggtgctactctgttccaccctggcccttgtcctcagtgccccatcttccaccctggctacttctggttctggtaggagggaccaactgagtgactgccattgcccctgcagctggcctgtggacctggctccggaattcactgcggcccagcccctctttcacccacttcctgctcactcacgggcgctggttctgggagtttgtcaatgccaccttcatccgagagatgctcatgcgcctggtactcacaggtgggtgtggggcagggccccctgacctgggggagcaagcaagcctgctagtccttttggattcttggcatctgataagggtagtgggtggggagagtctatgatgcctgataaaataagccccaacccaggaggaggcaagaactgggatggagctgggggtggaaacacccttgtcaccgttatttttgctctctgcagtgcgctccaaccttatccccagtccccccacctacaactcagcacatgactacatcagctgggagtctttctccaacgtgagctattacactcgtattctgccctctgtgcctaaagattgccccacacccatgggaaccaaaggtaaaatggggtgaggagctgggcctggggattacaggaggtgctcagttcttctctttgggaaaaatcaggcgaagaacaattattgacccaattctgcagatggctagaccaaggcaagacatatgacatgtccagagcctgggctgagaacaggcaagggcagcagagggtcttgcctgaggtcacctagagtcagaccaatgtttccatagttccagggtgcctctttgcttgatccttttctaatgatcagttgggtcctgccggggtggaagtgacttagaagttgagatgtaggaaagaatagtgagctatttattgggtgctgtctctgtgtttgggtctttacagatgtaaatagttttacatgcttcaccagtgtaaggtacaaataagccacatttttttctttcgttactcaagacttcacttagccacactggcaggggtcttccttgtaagaccttcccatgccacctgtaattatccaaaaacctgggatattattcatttcagacccatcagttcagcatcaagtacagagaggacaagagaggctcatcagtccactgctgctatactccagttcctgccacatggtggcactgttgaatgccagtcctgtgcagcctcatggttatgtgcttttttgggttcaaaaccttgcaccatgtccctgcttgggtctcaagagcactactgtgacggttttccatcatatggttagctgcttttcccaaagcatgactattctaccaggatagctgagtcttgccaactttgctgaaatcatgcttgcccagtgtcagtgagtgatgattccaaattacggttgacagatcactccctctaacttcccttttggtggattttctttaggggtacttgatattttttcctgccagaggaacccagtcagccatcttaatccaagtaatttccattgatcttgaaccttcaacatcagggctcacatcttgatgcattgtgaagagatgcctttaccagaactcaaaaaattctattcctttctgtgagggcaattgggtgacaactcatttgacactgacataattaaggaaggcctctcaatacttattctaaggatgacttgtctttatgccagacatagaaagattggcatcatttaaaataggttgacacacctattttaaggggagcaagcaagcctgctagtccttttggactcttggcatctgataagggtagtgggtggggagagtctatgatgcctgataggtggtggtgtggtggcacacgtctgtaatcccagcactttgggaggttggggtgggtggattgcttgagctcaggagttcaagtccaacctggatgacatggtgagacaccttgtctacaaaagaatacaaaagttagctgggtgaagttgtgtgtgcctgtagtcccagctactcaggaggctaaggtgggtggatcaattgagcccaggaggtcgaggctgtagtgagccataattgcggcactgcactctggcctgggcaatagagtgagaccctgtctcaaaaataaataaataaataaataaataaataaataaataaataaataggttggcaaactacagcctgcaggccaaattcggcccacctctccatttttgtaaataaagttttattggaacacagccacacacatttgtttatgtgtcatctgtgactgctttcccgctacaatagcaaaaactgaatagatgtgacatgtctgtatggtctgcaaagcctaaaatgtttactatctggctttttccagaaaaagcttgctgacctatgatttaaaaaattctacccactggttctctgccatgcttacattatctctcgcagtcctcagattcactgtatcaaatgggtatcatttgcccctttttaaagatggagaaattgacacccagagagatgagatgatttatctgtattcacacagctagcaaatagcatagtcagttgcaaacacaggctaccttgactcagggcaagggagttcatgtttgtttttttctgtttctttatttctttttggtgaaatgtttcattatggaaaaattgcaaagatacacaaaagttgagagaaaagcagaatgaactatgtacccatctttcagtttcaacatttacccacagtttcttcatcttatttcatttctcccctctcatatttttataaagtattttaaatcaaattctaaaaatcatgccacttaaaattctaaaaatcatgccacttcacccataaatacttctagggtcttttggtagagagtgggttacttggtggtggtggggaggtggtcctgaggaggccactctgggcttcctgcttgggccagtttgcctggtgagcccagatgtccccagggcagcaagatccagataggagaagctactgctgtttcctaccccccaaccagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtgagtacctaggaggggctcaggactgctctggacctaatttggcacgcgtatgtcatcgacagtgggccggcaccctggtgacctgagggaacccctctctgtccacaggtagacctcggccacatttatggagacaatctggagcgtcagtatcaactgcggctctttaaggatgggaaactcaagtaccaggtagtgctgggccagggggtagggcagagggaggggtctcccatggtcttccctggcaaagactgcttggggcgggggtctgggtcatgtcctgagagggccaaccacgggagtgggaggcttgtgccaggagcgacagtatacgctgggaggaggcagcaggtatgagaagccagggaggagcagacgtggcctcccatgtcagccagggaggtggattttggagctcaacaggagatgaacatttgtagtctgcatttatttatttaattattccacaatattaattggacacgagaatatacctggcacaggtgattgagtagtgaccattatagttaatgggccctgccctcaaaaaaccacaggcaaactctaggatgttcattctatgagggcttttgtttaaatcagaacggtccaacagaaatataatgtgaaccacatacatagttaaaattttctaatgtccatattaaaagagggaaaaagaaacaggtgaaatgattttaataatacattttacttaatgcaatatgtccaggtaattagcattttagcatgtaatcaatacattattaataaaatatgtcacattcttttttcatgctgaagcttcaaaatctggtgtatatttcacactcacagggcatctcaatttggatgctctattttcactggagtgatctaatctgtattaagatttcataaaatgtacagctgaataagtagagtgacatgtccgacttgttccacgcatacttaaaggttttccaatagctgaagtatcagttttaaaattcaaatagaaattaagataaacctaaataaaataaattaagtaacattcagttcttcattcacactagccaaatttctagtgctcagtagctacacgtggctagtggctaccatattggatcgtacaaatcttaggcaagcaccaaaacaaagtttgatgctgaatctttagggctaagaacagtacttggcatgtagtagtctcttggcatgtatttactgaatgaatgaagaagctgccatataattaggtacacttgtagctgccaccaaggagaagctgtgagtgccactagagtgtttggatgatgggtaaaacttccctaggaagttacaaataaacccagagttgcataaaggatgaggaggagttagggatgctaagaatgggagagggctttccaggtagagggtttagcaagtacaaaagcttagaggtggagaacagcttggtgacttggagggagtgtaaaaatgggagcgtttgctgagcctagtgatggagcgtaagaatgactttacaggaaggtggagatgtctgtggggaccgtgttaaggaattctactttctgccaagagcagagagagtatttggaaaggttttaagtcagctcatgatgcaagatttgttgtttttttttttttaagttttttttttcttttttttttttttcttttttgcttgggtgcagtgcagagactggcctgtctggggataggagtggaaatagggagcccacttagggaaaggagtcagagtggaagatgagcgggggttgcttgaggtagtggtggtagagatggagagcaggggactgattttaagagacattttggaggtggaatcaacagccttggctgaggggaactggcagctggaggcaggagtgggagggagttggttgtgggcagctgtgggtgacccccaaccccaggttgccaggtggccccatcccacaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggtgaggactccagacctgccctgccctggaaggtcattccctccatcctgagaagttgggggcgggggggtacttagaggtggaggctgggattagaatcctcacccttctgcttagtggctagaagaccttgagcaggcccctcaacctctgtgagcctcggtctccaaatctgtacgttggggtgaacgatgattgtaaggatttattgagatcatgaatgggaaggcaactagcacatagcaggccttcagaaaatagatgactgtgatggttgattattagctgggtgactcagcacatttgattagccaccctgagtctcggtttcccctgtgtgctgcgcccggatgcatacttgtggtccccagcacgtgcagggtcaaactgtaacttgcccggccttcaggaatcttcatgttcccttccctgcatgtatctaccttcctgcagtttggtagcttctaggtgactcagggacaggatatttttgtgttccctatgggggcgagtctgcaacctaaaatgtcagatggtttcctgcctgggagcttggcccctgacatccctgtccagaccatgttcgctctgagtcaccagtaactcccttcccccacctctggcaccactgggcatggctggtcccaattatagagcctaattcactggagccatgaagagccaggcattgggaataggaacagtcattagagggaagaggggctggttctgaagtttcagcgttgcaaagaccttgacctgagagagctggaggctgtccagcacactggctggagatgaagctgtgaccaaaggcaggaccctagggcaccatttaactcccctacaacctcatgagccgggtatgattaccctgtgaaaatcaagattcagagaggtgaagtgaactctccagggacactcagcagatggagacttgaggtctggttgccaccaaaatctatgctacttccactccatcacaaagggggctcttcttgaatgggaaggggttgcaaacctgagtctgatctgtgacatgtgagtattggaaagggattccccctcgcgtctacacttagtattcctacttttggctgacatatatggacaccccgtcttatgccaggcactgtgccagcagttttgctgtattcattgtctacttctctcaacaaccctaatatagtattgcattgatgttattattattattatttgagatggagtcttgttctgttgcccacacagtagtgcaatggcgtgatcttggctcactgcaacctctgcctcccgggttcgagcaattctcgtgtctcagcctcccgagtagctgggattacaggtgcccgccaccatgcctggctaatttttgtatttttagtagagacagggttttgccatgttggccaggatgatcttgaactgctgacctcaggtgatccacccgccttggcatcccaaagttctgggtttataggcatgagccacagcgcctggccgcactgatattattataacacacattttacagttaaggaaagtgagattctgagagattaagtaactcagcccaagctcaggtggctggaaatggtaaagccaagatttgaatccaggtctgctgatcccacagtctgtagctccaggtcgatttccaaaagccaatttgtctaatggctaattggcctgcatatcagtttctttcaatatctagttgcccagttttaattttgttacagaatgttcaatttgcattttccctggctttttgctttctagctggttatagctacaaatggggcagaggaaaaacttatttataagaatcctgttatataagaacatataggaaatatgttttttgaaatatatttagggctaggctccccttctgtcctcagtattctcttttgccactgcagcagctctgagtggtctccttgaagtccccctctatcaccgagggtgtcagcatgatgacagctctcaccagtaaatcctccacttttccatcttttgtagtctctccaccttcttttaatgggcttcaggagggaggtcataagaccaattcttggacacctcctttgcatgtcctgcttagctgggcctagaacctccctctgaaatgtgggagtagctggtgctcttgtcttgagacctcagtcaaaatagaccaaaagttctattttcacatcctgttacaaagagacaaaatggaagaggccaaacaaaattaaacatcaacagcaaggccaggtgtggtggctcacacttgcaattccagggcttttgggaggctgaggtgagagaagtgcttgagacttgcagttcaagaccagcctggataacatagtgagaccccatctcttaaaaaaaaaaaaaaagaaagaaagaaagctgggtgtggtggtacacctgtggtcccagctacttgggaggctgaggtgggaggattgcttgagcccgggaaagttcaggctgaagtgagctgtaattataccattgcgctccagcttgggtgacagaccaagaccttgtctgtaaaaataaaaataaacatcaacagcaacaacaacaataaagagaccaaaagcaagcacctctcatgaactggcctgctttccaagctgggcatctaaatcactgtgcttggctgaccctatttccaatcctgccctgcccaggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccgggtaagccccagaggagtgctggtgagggcaggtgggctgagggatccagcagacctgggtccaaattccaggttcttcttctgtaaaatggggctgatgtcacttctacagggcagttgtaagcattcctgtgtgagttcattggttcatttgtccattccacaataccagacattactccaggtactggagatgtagtgggaacaagacttttgtggttcttggctcatcttttagtgctcccaccctagaaagtgatggcagtcatacgacagctgacagcattagggcccttactgcgtgtcaggcactgttctaagagcttctcctatgttatcagaattctaagagtatgttataaaccatagtagaaaagcccaccatgctctgggagtcaggaagggacatctgacccagagttgcgggttatgggaaaagaagggatgtccaagcagaaattggaaggagggatagagatttcccagggtaagaggtggtgttagtggcaggggatggctgtgttccagatagagaggacggcatgggtgaaaggcatggaagtcagaggacatggcagtttgaggaacagaaggacattcagggcatggtaatgtatgtaacagtgcccgcctatggtgtttattaaatcataagcctccgctctgggctgaattgtggctcttttaaagttcgtatgttgaaatcctaaccgccagaaccttagtatgtgactgcatttggagacaaggtctttaaagaggtaattaagtttaattgaggtcattaggctgggccctaatccagtgtgacttataagaagaagagattaggtcacacacacagagggaaggccacatgaagatgtagggagaagaaagccatctacaagccaaggaaagaggcctcaggagataccaaccctgctgacaccttgatcttgaacctctggtctccagacagaggaaataatttctattgtttgagccactcattctgtggtacattgtcatggcagccctagcaaacaaacacattctctttccctggaattcccagccaacgccttcctcaatctccccttctccacattcggaagctcccatctgcttcatcgcagtctctggctcccctgttgcctcacagtcctctgcttctctctaatccttgtccctaaaccctgtcatgaagctgtggcacacatggatttccatttccttctggtaatttgactgaaattagcatttgctgccccggtgggcagctgctggctgctttatggcctctttgtcggtttctttatggttctttgtggggacacaagacatgaacagagacaatagcctttgtgtgaggctggatggttttcagaacgttttcaaggaatgaccatgatgatgtacgtgaaaagccccggcgtcgtacctggcacaaggcagaaaggccgcagagatgtatggactgtcaagattttttttcttttttctttttttttaaatagagatggggttttgccatattgcccaggctggtcttgaactcctgggctcaagcgatctgcccgcctaggcctctcaaggtgctgggattataggcgactctcaggatattaagaagagtgagtgatgataagacagggcttcccctgataaccattgtccatggctaccctctcaggggttcccatgtgaccaatactgagataacagctttgcatagtttatcccatttaaattgaccacagccatatcaggtagatgctcttcccttccccatttttacatatgcgggaactcaaacttagcttgaatagctgcccaaggtccctatattagtttcctcaggctgctgcaacaaagtaccacaaactgggaagctcagagcaacagatggaggctagaagtctgaattcaaggtgtcagcagtgccatgttctctctcaaggctctatgcctccttggcatctggtggtggccgacagtccctggcattcctcagcttgcagaggcatcgctctagtctctgcctttatcatcctgtggtgctctccctgaacttgtctttcctcattttataaagacaccagttattggattggagcccaccctaatccagtaggatctcatcttaacttgattacttttgcaaagacttcatttccaaataaggatgcattcacggatgcagagagttagggcttcaacacatatttaatattttagggaacacaattcaaccctcaacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgattttggctcactgtaacctctatctcctgggttcaagtgattcacctgcctcagtctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagcttttttatcttgccaggttacctgggctttgagttctattttccctcccttcacagggggttacactacctcttggtgtaattcaacggtctggggagcagtgtgagccacaaaagaggtcctcttggcccattccacacttcaaagatgaggaagctgccggatgtggtggttcatgcctgtaatcccggcagtttgggaggctgtggtgggaggatcatttgagaccaggagtttgagaccagcctgggcaatatagtgagacctcacctctacaaaaataaaataaaacaaaattagccaggcatggtggcacgtgtctgtagtcctagctacttgagaagctgaggtgggaggattgcttgagcctgaggaagttgaggctacactgagtcaagatcatgccactgcactccagccagggcaacagagtgagacagtgtctaaaaaaaaacccacaaaaaaaaaatgaggaagctgagactcagaggggcttcctgagagagcatgacagcagcaggcccggggcaggtctgcagcatcacaactgctaggctgcccaacactctccatcctagctcagaagggactcccactggaagctcttgtcccaggaacttacccaggctccaggacagcctggcctggctcccagaccactgctgtgcttctctctcggcagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggtgagcagctgtttcctggatgcagtccctgcccttgagggactggcagcaaagtcagggagacatcaaggaaatagaacgggacaatacatgcggcaatgtgtaacaaccagacttataatgggcgtggaagtgctgtgccagggtggtaaataagcctgcttggggagagaaggtgacttttcagctgggtttggagaacaaatggcattttcagtgggagaagagagggaggagtgttttaggcagagcaatagaaagtacaaaggctgccgggcaaggtggctcgcgcctgtaatcctagcactttgggaggctcaggcgggtggatcacgaggtcaggaaatcgagaccatcctggctaacacgatgaaaccccgtctctactaaaaatacaaaaaattagccgggcatggaggcaggcgcctgtagtcccagctactcgggaggctgaggcaggagaatggtgtgaacctgggaggcagagcttgcagtgagctgagattgcgccactgcactccagcctgggcgacagagcgagacaccatctcaaaaaaaagaaagtacaaaggcatagaggtcagacagcaggtatctagggaaacagtcatagatgtggctggggcaaggagcttatgttgtgggaatgattagtgatgggaggttggggccaaaccgtgtagaatcttggttttcatactaaatattttgagttttatttggtctagtgctttctaagtacccacttacgggccagctgcataaaaatcatttagaaagctgattaagataccaaatctcagatgcctctcctacggattctgattcaaccagcctgggtggtgcccaagaatctgcgtattcatatgaataaagtatatatacatatatatgaatatatatatgaatagagtatatatacatatatatcaatatatacatatacatatcaatacatatatacatatacacacacatatatatgtgtgtgtatatatatactatatatatacatatatatatatacatatatatatatacatatatatatacatatatatatacatatatatatatatatacatatatatatatatatttcccccaatatcctcagatgttgggcagccaagtttccagcccttgtcacatacaatggggagccactgaagcaggtgtgacatggcccatgagagttcccagtggaggatggatttgaggaactgggcagggaagcagggaagctccatatttgtctccccttggccacatgaacatgtggatattgcagagtggagcagattctgtgcatgagctccttgtgatcctggaacagcatcttattctttactctcccatgacaaatggtccccgggggcagaaggaacactgccactgaatttctgtgtgagctcggacatgttacatctttgagctctagtagtaaaagggcttggcccaggctaaggtcttgaaatctgtctgtgaaggaagccagatggggagcattctcccttctgtgatgatcaggtaattagggcccagagttgctcaaggttataggctgtttggtggcagatctaggcccctgactttctctttagtagcattttccttccctagacccagtccctgaggaggggcaatttgtgcttttcctcttgacccttttccccagtgccaaccatgccaaattctagggcacatgctcagttgctcaagttagtctcctggagtccctattatccccagaaaaaggtggacctggaagggtcccgccccaggttgaccttaatggcatcatggatctgatgctagcatttccccttatctccttgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagag

SEQ ID NO: 11880 - DNA, 174318 bp, Human
  misc_feature (1)...(174318): n = A,T,C or G
gtctctgttacaaaatgatggccatataaaagagagaagagaggcgcaaaaataacaaacacagattcagcaaaaatctcacccctttattgccctgaacttttcaatagcaagaactgagcttgctgggctgaaaattgttttaatgtaccttcataaaaggatctttgacttggtaagtgtgtgcgatgcatacttttcatgttacaccacaagtgccacttagcaactccactagacagggcagtgtttcagcatggggtggggtgccccctgacaggcttttaaaaggcccggatgccaatgcacattccaacactatccacaaaaaggagactggagcagtgctcttccctgcattgggcaaggagactctccctccctgcctaaccacttgcctgccctgttttgtgggagaattacaagtaaatgctacagaggcagtggagaaaaaagggtgttttaattcctctccagagtttcctttatttgatgtatgttgcatcctttaaacaagttgtgcaaaatggctgcagggtagattggctctcccttttaaagctctccatccggctgggtttatttgtaaatactgcatctatccttcttagtgttttaggactggctggaaagactcttcttcctgtaggttgggtcagtgtgagagatctaaaaaatcattttcccttaaaattactgtattttaataaaaggattgggcaggggctggaatgagagaaaactggtccttcaaaatgtaaaactgtcatacttaaaccagtttacaaaatatgcgtttaattatgtggtgggatgtgtgtaggtgtatgatgagagaggcaaccaacatggctatttggggtgcaaggatgtgggaacaggcaagtaattttcacattggactttcatcctagggagctgggttctagtcacagctctgagctgtgtgaccttgggtaggtctcatctccccggggttttgtttcaccagttgaacagtatgaggatgagtcacagctaacatttgttccatgatatttacccagcaccatacaagtgttatttctgtcctcccagttaacactgacgtgggtagtattatatgcccattttacagatgaggaaactgaagcctgaagaagttaaatacttatcccagaacacacagctggtaagtggcagacctggaattggaatctagttcagtttgattccccaacccatgctcttgaccactatactgttttttcaagtccagatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagagggagaaagagaaaaagactgtggaatggaaagtttcccaacccaagcctttcccaaggggtagccattctctgttctacagtttagggcttgcatgtgctttttctggagtggaaaaatacataagttataaggaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatgtaggtttatttttttcccttcttctaccaagaaaaaaaaaattgtctctcttgcatgcaataaagacgttggaaataaactgcattggtagcaagacaaaggatttaatgatttaatgctgaaggggtgtgatatgctggcatgcatattgattccctttgctgaaaatttcctgttagatgttttcttcccaaataacccctcccgcccccatgctcctctccttaccaaccttatagtctcttgaaaacagtttttaaaatatgcataaaaatgtggggggtggggagtagagggtgaccacaagactttaaaacattcttcaagtagggcaatttgacacattttgcagtttttactaaaatgtatgcagagtggaatttaactttgctgttctttggattagctactagttgtataggtccccccaccccttgtgtattccaacagtccaaagtaattaaaatatgacattttccttgaaaggaatttagtttaattaaggtggctgctgctcccgaagttcataaaccaccagttcaagctgccgcttccaatgttttccttgctaaggaaaggcaatatttcttagcattgaccctgctgccacctttccaagtcactttgttggtctaagaagttgctgttttgctagaaaactactggcaatgaacaccccttggactgagccatccattatttccatatcttgcagttcagcccggaacgtggacatcagttaaaggaaaggaaatataagtggggtagcccaatttaaaaaaaaaatattgactattttgttatctgatgctgacacagtgccgaggtacgcacctggtcaacagtagcctggctgcaggcttgagaaatgatcaggagtcccagaaaatcccaccttcgggtggctgtagtgggagcctgcaggatgcttcgccgccctgacagtgatttagataaatggctcagctatctatcaaaatgtttttagtactttatttgacaattcattggagcattagcctgaaaatgacattttaaatctttgttttcaaagaggtcaaagtttaactggaagaaattgagttttcctaataacatggtggcttatctaaagagagaagaaaaaggggagaggggacaatgacaggatttaaattgccctctctgaaactttttcttaagaataaagacttgcttcttgggccgggaaatcaacaggtttgtagctgaaaaatcaataaccatttgatgccaacagcctggctgtctgacttaacattttgtagagccataagcagggcaaaaagaatatcgttttcagaaggcgccttaatcttcagctgctccccaaatgccttttcttttttggtgcccattttatttctggagaactcaaagaaactggagtgttacaaaataattttctaatccaagaagagacttttcagacctgtcctctttgtagcaattaaaacagtatgaacaatttctgttggaatcccagggaactggggctctctgaaactttttcttgttagagaaagtggtaatgaaacatgttttttaacagaaggaaaaaatatgctcaggatcctcgccaaaagttattagacctaatagagtttttacatgtagacattcttccttttgtaattaaccttccaaagatgcctattaagttgtaagagtagggggaaaagctttgtttgttcttggacaagttaaacaagggatttgctttatctagggagagcgagcggtgaatgtgtcattcgcctaaaactacccgataagcaagaagtgttgataacagcaaagtttagctaatcaaagaaacttgcattagacaaagtaaataaaggcatttgacaaagggatttcagaaattccagtgtcttatttttgtaagcagggcaattagttcttattgtggtcagtttcacaagagtttgaatcccacaccccaactttaggttaaatgaataaaatgtaaatattgcttgtgcccttgcagagttgctttaccctcataaaccactttatgatggtcagttgttccaacgatttttttttttttttagcataaataaaactaaaacttttttttttttttttttttagagattctaacaaatgtcttgtgccatgcagtgtttggttcagggtggtacagctagttagggctattgaaataaaagtatattagggctacatttgtgtaagtaagaacataaccacaaccttttccattttacttaatggctattttgacgagaagcagatctgtttttgcttttaacacagaggaaacagtgggcaaagaagaaaaagtactaaattccaaccaaaactattttctgctttgagttttttttatggtgtgtgtgtgtatgcatagtaaataaagtaagacctttgaacatggagcacaccatcacaagctcactttgaaaggtgttaaaatattccctttattttctttttaattttaaaggcagaaaaatgatatgccagccagctgccatttgtagtagtgtctgtgaattgcttcttataagcattcaaagtcaggattaggggactactaagggaatgtggtctaaatattacgattgacgactgcccctggaaggtataggagtcactaaatttctgttcagatgtctccaggattatcttggttttaggcggctccagatgttttcaacattaattgctcagtgggtataggataaatcttaatattttgtggtctaaatatagttgctttggtgaaataacgagtgtgacaacttcttggcctttttccctgtcttttctccctactcaacacatcaaaaggaaaaagaaaaaaatattttctttttgaaataggactttgcccattaatgagaagaaattatttttaaaacaaccagtagtgatgtttgattagggaatgagaaaaggcctcttttcaaagccctgggacccaaattttaagtattaaacagtatctaaatcctctcctagtgagatataaattggggtcaaagtggcaaaatcaaagataccctctgaaagaaagactaaataaagactgacagccaccgtatgaattgaatggggttttgaataaatatttcagtgaaaaggcccaattgtttttctaaagtaggacataattttctgcttctcgggcacatgacggtggtaactaataccatcagaaagaagagaaaaagagggacttttccttaaatcgcaaagagagtacaggcagggttgtgggttgttcgaaaacaagtgaaagattcacaaagttttccttccttgtagaaaaaaagaaatcatattgtgaatattggataaattggtacatttgacaagggagtgagtattgatgtgcaacttagaaaagaaaaagcatgtgtttaaattttattgccagaaaaggatggattcaaaaaactaaacagtagaaaggtagacatctgtttgcctaaacttaagctatggaattgacttggaagctttagttagaatttgatttgccagccaataatgtaaagcccttgcattgaatcaggtcttttttccttaatagataaatgaccagaatggctatttctgataggctagctgacctgaatcagaagtttccttctcatttctagaagcctggcgctgatatatacaaccgagggtattgttatgcacttttctctaaagcgtaagaataaaaaaaagttcttctggatatcagatgtttataatttaccttcgacatatgttaagctctgaggtggctgaaaaagaaagaaaacctgttttctcctttacacattccacagatatcattaaactctatctgagaagggaaatacatgataaataacaaagattataaattctactctcaaggaatttataattttttaaatcagtaatttagaaaaagctgagaattttaagttactctttgggcagaagatggagatgtaaaaaccaagatgcaaaatacaaaactctgttcaagtcacacaggattttaacaataaatgcaatgttcattttagaacatcttagaatcttctatacagtttgagttatgtgtaagtgccatacatttatccttaaatgacatttttatactttaaatgttctaatataaattcagttaactatcaattaaatagattatttcagaaatgggagtttttgatgaaggttaatcagaaaaatcttggctgaaaacctttccaaagatattaatgtagatagaatcttgcctttcaaattacagggtagttatgacaatcatgtatctctgattttctagaataacccactttcaaatatcctgcacagttcccacataaatcattgaaatatgccagatatttaatattacaacatctcctaggctgccccttgaacccaggagtggcacagaaagtctttgtttggattctatagtcaatataagtagagctctcacagcttaattttttcattatgtctgaagatcgccttgtgtttctgggtcattcttatgaacatgaattcctttcgtagcaaactatagatctgtgaatagaaggcattccttgcaaaatggactgggctgtgattctcactctagcacctgtgtgtgcgtggacagggtggggaggagggagtagaattaaattaaattgttatgaacaaatctgtatcagcccttgccagcttcctcttaaaaagttggagctggggtgatggagggagaagagtagagttaactcaggtttcagatttatcagtatcctgcttgtaagtggcttggtctaagtacctcttgttaaataggagatgagataacctgccccatctgtaagatctaataacacaacctcatcagtcaatatgttgctctgaattctcctcttttcattcccagcttccttaccccatcattaaaaagcatgatctctgtcccatcccactccccaaacccctttaaatgaatgaaaaataaagttgcaaaagttctctctacctaggaagcaggagagcctaagtctactggcattttgtcttgagctttcagagcttcttagatgggaagtcaaacaggcaatggaactgctgacttgctctttctctggccctgtagggtgggggagctacaaggggaccatttagtaagataagactctctgccccctgcgcgataaggcgaggataacaggaactgacgtcagcaaggcgactcaacctggccaagcatttcctctagtcagggctcagggattccaggagtctctaggcttcccccagcagctgaagaactgaaccagctcaggggagggagaaagaagaaagctgatttttacaggggtgatagtgggtgatgatgtccctgatttccaaaagcagatttctttgaagagaacaaagaaaaactgggaggaagaaagtcgtttaataaaagtggattctgagattataattgtcattttacattgtcatagaatagatatttgtgttccagctgtcaacaattcactgctgatgtctcattagacagtctatccagcaatcaccaaatatcatccactcacaaacctcgccaactctccatatagaacaaaacgtgagggatttcacgttgtcagagttaatccttggtactccttttttttttttttcctttttttttttttgagatggagtctcgccctgttgcccaggctggagtgcagtggtgtgatctcagctcactgcaacctccacctcccagattcaagtgattctcctgcctcagcctcctgagtagctgggactacaggcgtgtgccaccacacctggctaatttttgtatttttagtagagatggggtttcactatgttggccaggatggtctcgatctcctgacctcgtgatctgcccacctcggcctcccaaagtgctgagattacaggcgtgagccaccgagcccggccttgtatttacttttgaaagtacaaagttcccatccccatctgcatcagatgacaacattgctaaagccatttcatttgctaccagccctgaaaccacttagcagttttcctcccctttttccttcttccctttctcttaaacccagatttattttcattttattttattctttgccttccaaagtatctgatttgagatttggaggaggagaaaagtcaaacagaaggattttatttcttaaaattcacagattctcctcagtccactgctgtcttaaagatagcttcttattttttaagtttcagtgtttgacaaagaatcactgtcctaatttgacccatatttagtggaatgtttgctatgttgttgttgataaattactattcatcacagaataaaattttgtcaagtcaaaaaaatagctaaattcaaaataatgtgcaggtaaaagaacaaataagatgagtgcatcggttaactagggagagaagatctggatcacatcccaatttttttcccatttccagagcaaatgaagacctcatgtaataaatttgtcttctcaaaaatattaaagctttcaacggctacagtacctttgtcatgtcatcaaagtccataattataaaaaggccgatgatctgaaggccatttcagcttcaaaagatttttttaggggctggtctattggaaagcttgggggtttaattaactaaaatggaaatggaggcagcgaaattcagttcctgatgttttaatttagctcagtactgccatgtgttattgaagagaattcttaaaggcaaacataattatttcattatggtcctcagaatgctttcattggctttaatgacaagaagctgtataaaaaggcatatattttaattagtcctttttatatttacatcagataaacaacaaataattgatgaaaaacaagtctttggaatggatgatttcacatagtgcactggttacagtttaatgatgaaacatttctctgttgctttgcattttaattatatatacattatattacagtagtcgtgccatggagctactaaaataccgttgttgccattttattacaaaaaaaatcacgattaatgcctagaaattgaaagctgaaaaatgtagctagacacatctccaaggaagtaaattaccggttccattaattttactacatttgttagaactcattttgatcacttttatcttttacgcttcatctttttggattaagatcgtcaggggtttcatatgcttttttatggccacatcttctcctgagcacctttctttcgctcttgctgcctgttttgaggatttgcatgtgaaagtgccttgccaaatgtgcactggaaattcagagagctttttttccatgctatcggcttgctttacctttgattttatatgaaaacccatttcacatgattcatccgttttggtgtacagaacactaattgttattattgattttaaattccgtgaccattacaagtaacccagatgactggcagataaagggtaataatccatggagttctggaactgtttcatgtttgtctggagtactttatgtgatcaatattaactgccccattgaaactaactgctgtatcaaataacagtcaatcaaatgaatgtgcttagagattatttattgaaagctttaattgttcactggggccctccttatcaggggaaacaatacaaactagaggtaggatgaacaggtttggatttgcagggaaagttgggggatgcagatgaacaaggcatctctctgcttctcgggcaagagtttccagaaacccatgttgggcttatagttcaggcagaagttgtgaatactcttccagagcttatcctatcacctgtacctcaaaggctttctagagaagggggtataataattttcttgcactcagcagaagctgtgaaaagttctccctttccaagagttttactgctgcttctccctggtcctctcagaattacccttccatgcatctctccacctctgcttccccatcatggcctgatggtccaagataatgcaagtagcctgccttgacacaggatcggtttctacagctatgaaatgggaataatagtgtctacattgcaggatctgtagaaggattagagatcatgtaaattaagattctattcttgtcttgaaaacatatggaagtcaccaggtaggccttctgccctgattttggcatgacacctgtggcttacgtgcctttgctaaaagcaaactttttttttttttttttggtcatatctaaattaggtatctcttttctttggtgaaatgatccctcggtctatagctcataacctaggtggcagtcctttctgtttgtcaggtagcactgtgccctgattcaggggcatccatttaccagatccccagatttcttgcaaatgattgacttttacaagtgagcattgtcaccttcaaagttgtcacaatacacttagcccaaagatgctgtcgtggcacagtacatttttattgctcattgatggattagtttttgcaacgtgccattcagcaaatggctcttgggtgtctgccatgtgccaggctccttgatatgatctgtgggggacaccaagatgaatcagacactgtcccttctccctctgaactcatgatataatgggaagaacttgtgacacaagtcgttgtcacataacccccttataacaaacccaaaaatctccccatgtctttgaacctaagattgataatggaaagaactaagaactgccaagaaccacagctggtttatatggtgggtgatcaagtggattatacatttttgtcacagtggagcgggcgtgaagtttttctgtgtgcaggcctcatagatcatctctaaaagtagttcacaaaggagttctaaacctatcttacacagtggaataagtgcacaccttccaaactagcttcttgaagactttcatgtggatgtttctggagcgtgttaagtaatcatgttccttggggatgggtttgattctattggatttttaaaaatcacttatttctctatgatttctgtgacttattcctgtgtaacaaaccatcccaaaacttcctggtctaacaatttattatgacattattctgtggatgggctgggctccgctgggcagaccctctgctccgcatgctgtcagctggggctgaatcatccatggctaaattgggctggcaatccaaaaagtctcactctcatggctggtggtggatgttggttgtcggtgagagctctaggggatctgcatgtgacttgtgcatgtcacagcatggcagcagtattccgagagagagtgtttcgagagtgaaccttccaggaaggaggcagcagaggctcccagtcctcttaaaacctagacccagagagtggtatacagtcactttcactatattctgctggtgaagcagacacagggccagcccagattcaataactacctttcagtttgggagagaaaggcaaagaatgtccaccataacaatcgtagcgtatatgcactataacaagaaagaaagtattgtcttctgaaaatgattaaattaaagaacagttgtggggcttttagttttttggttggttccatgtttaatgaaatgctactctaatgacaacatacatcattttcagttaatcctcacaaccctataagtgagatgtcatcttcattttacagatgaggaaatggaggctcagggaaggtgaataacacggattgtaaggggcagagtgtggtttcaagtcccatgaaaggcttttctctaggctccatgtgctgttactcacttgggggtcctcagcttcaggagttgtcatcctgtcagctgagtgaagaattcctgaaaaatgtttcatgccctaataatcccaagaataaaacaccatcgagtgttttggttaaggggaaaggtaggaaaaagagaggtaaagaactgtaactcgcatagcttcctctgattacattattttctctactataaaccagtcttttacattgtggaggaaactctgcccaaactatgaggctattttactcttttgcccttttgtttttacatcctgtttgctgttgaagtctacgctggcctagtcactgctgtagctcagggggttcagaccaggattagtctggtatttactgaagagtcacaagaagatgagagatgggaaactgggcttttcatgttactctagtttactggtaacccttatctaaagatgggtgctaagtgtttgtgctagagagtgtctcttcattaagtggagctattttgtcttccactaccaaaagcaaaaaagtaaaagacaaagaggaagaaagaaaactttctgatagtaaagtcgaattaatgtttatttgctaggtattttaagtatctattgtgtgcagaggatcccaaacctagttaaccattaccatttagtgaaacttacatgaatcatagtgcatctaattggcctctcagataatgctctcatttcagtgacttcaaacatgtcttattttttatttttttgagacagggtctcgctctgttgcccaggctggagtgcagtggtatgatctcagctcactgcagcctcaacctgctgggctgaagcaatcctcccgcctcagcctcccatgtagctgagactacaggtgtgtgtcatcacacctggctaggtttttggagagagagggttttaccatgttgcccaggctggtcttaaactcctgggctcaagcaatctgcttgccttggcgtgtcaaagtgctggaattacaggtgtgagccactgtgtcccgctcaaatatgtcttaaatggaatgtattctgtattttgaattttcatataccgtattctacctgtttcttttgtttgaaatctaattgttgctgaattatatattttgaggaaaaagagacaggtggacaaattgaagtgacttgctagaagtcgtgtagtgggttctaagtggaagcagatctaaatctgtaagacgctaacatgtgatgcagtgaaatacagcatgggaccctgcagtgtgatacagtgaggttgggtagacattcttcgtgcactgtacctgctgtggaagcttgagctccaggttttgttttggtttttttctaatctttaaaatgaatccataacacctcccttgaaagcctaagatcagtcttaaagccttaaataagacaaacatgatgctcagtaaatagattgtttttacatatatacatagttgtcaataagaaacttgttttaggcttgcatggcgactcataccggaaattctagcacttcaggaggcccgaggcaggcagatcacttgagcctaggcacttgagaccagcctaggcaacacggcagaaccctgtctctacaaaaagaattatgtggccgtggtggcacgcacctgtagtcctagctactcgggaggctagggtgggaggataatcggagcctgggaatgttgaggctgcagtgagccgggattgcaccactgcattccagcctaggcaacagagggagatcctgtctaaaaaataaaaaaaaaaaaagaaatttattttaaaaaaaaatccaggccaggcatggtggctcacacctgtaatcccagcactttgggaggccgaggcaggtggatcacaaggtcaggaattcgagaccagactggtcaatgtggtgaaaccccgtctctactaaaaatacaacaattagctgggcgtggtggtgcccgcgcctgtagtcccagctgctcaggaggctgaggcaggagaatcgcttgaaccggggaggcggaggttgcagtgagccgagatcgcgccactgcactccagtctggatgacagagtaagacaccgtcccccccaaaaataaaaaattaaaaaaaaatccaaatgctagcattgtccagaaaaatttaacagatttatttataattattataaagttgaactactgaaccttgttcactgaaacattttgatttgcattaatgctttacatccccacatttatattaaaaattcacacgcaaatgaagatggaaaaactgccaatacctaatttctgtcctctatttttccacttgcaatcatatacctaggtaccttttgactgcattagaaaaaaatacctaatattcagaactaccaataacaggaagaagaaattttttttcgggggggtgggtgggaatgaaatgtttcccatcatagtggactcctaagcacgttctctacgtatgcagtgtgctgatgtcttctggcataattgttaaacgtttgatatggataacacacaggttagtgccctcaaaaaggccaaccagataggcctcacttggctcctgcaaagcaccagtagctgcgctctggaagctcagatctgttttaaagtcctgagcaatttcttgcaccacatattggaagggaagtttgcgaatcagttcactggacttcgtataaagcctaatttcacggagtaccccagtcccaggcctgtaacaatgaggtttctccaccccgccagtagagggcgcactctcgtgaatggcttttgtggccagtttcttcccggatgcttttccacgggttggattttcgagtagtgtgctttgtaggaaccgtggtatggacacctccttactttcccccttctccttcgcccagagctcggcgaactagaggtggcgctggcgtcagagagccccaactgcaaatccaattccccgatattttatgaattttttttaatgcagaaaagttacaacagctttactgcaaacacctggatacctactgccatagctaccattaaaattaccaggtttcttttctgtgttctcacccttttctccttttgcatatgtttgttttgttttgttgactgggtcttctcactaaactgagagtctttgagttcaggtattgtgctttttacctctgttttcccagtgctaatatagtacttggtctatgatcctcagtaaactatggttgaacccacatgtatgttctaataaacaaccctttaatatactcgatatcagtgcccttcaatagaacttcctacaatgaagtttccaatgatggaaaggatctataattctacattgtctaatatcatagtcgctagccatttatggctgttggaatttgaaatgcggttaatacagctgaggaagtgactttttaattttattttatttttatttatttatttatttatttatttatttatttttgagacggagtctcactctgttgcctaggctggagtgcagtggtgctatctcggctcactgcaacctccgcctcccgtgttcaagccattctcctgcttcagcctcctgagtagctgggattacaggagcgcgctaccacgcccagctaatttttgtgtttttagtagagacggggtttcatcatattggtcaggctggtctcgaactcctgacctcatgatccacccgcctcgatcttccatagtgctgggattacaggcgtgagccaccacacctggccaattttattttattttaattaatttaactttcaatagccacacatggctagtggctactgtattaaacaattcacttctacatacttcagctattattattctttcagtatttgttcattttctttatttcctttttcccttcagcctttactcttctctcctatggctattaacaagctctaattatccctttatgtagcaggtaaacagactgcaggaaaatgtaaacagaatgctgtagggtggtgatttcagtcattgtttaactccttttccttctgggtggaactatttttcctggggcctggcaagtatttagcacttgttttgctaacatttagtttgcacagctaaaccaagatttttgcagaatctcagtgggcgggaattacattccctgtagcaatcaaatcatggagacatacgatgtctattcccgtgctccacacctgcttggttttgagatgggcagagtatctcccaacattttcaagctttcaactcagcttgaacatttcaacaaacttcagggaggcagagaggaactggccatattctatggaagcctcagtttgccttctgggaaataccatgagctctcccccgggtgcctcctcctgcttacgtgtgtcctctgctcataacccagagtgcggcacacagtaggtgctcagaaatatgctgagtgtagttcagtgaaaacgaaattgagaacatctcaagtgagctaatattttttggttattcaaaacacctctagtaaacttgatgggggctgtcaaaaacttgggaggttcagtttggctgggatggcaaagtaagtaagcccttataagtgcatttgctggcaaactggcctgaaaacatgagagtggaatatttccctgggctactggcacttactttgaggtcacagaaatagattttctgatggtacttcctgttagccaggacattattgctcccccttgtcccccccaccacccctttttttttggcctatccctagaaatggtgtgaagaaagtaaataaaaataaagctaaagcgcgccggtaatctcagctactcaggaggctgaggcaggagaatcgcttaaaacccgggaggcggaggttgcagtgagccaagattgcaccatcgttctctagcctgggcgacagacagacagtccatctaaaatatatataaaaaaaaaaaaatgataaagctaaaggaccggttgcggtggctcatgcctgtaatcccagcactttgggagtctaaggtgggcagatcacctgagctcaggagttcaagaccagcctggccaacatggtgaaaccctatttctactaaaatacaaaaattagctgggcgtggtgatgggtgcctgtaatcccagctactcgggaggctgagacaggagaatcacttgaacccgggaggcagaggttacagtgagccgagatagcaccactgcactccagcctagacaacagagctagactctgtctcaaaaagtaataataataataataaaataaataaatcgctaaaacaactctcaagagaaacttttgaaccacggtttgcttccccacccccatgatttaaagttgcgattgatttttattaaagtaaaacaatcactatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctcccgagtaggagaaagtgagtccaaagttcccaactcagctttgtataatgtagggttccttttctttgccaacgatataaatttctattttgtttgcagggaagagggatggggaagattagaagcctcagaacccacagaataataaaagggttaacaagtgaaagctggaaataatacgtttttaacaaaatgggcagttcttctaattgctgtgcccctactgttcaattcctttttatgtcctaattcattaaattatgtacacatcaggcttattatttacagatgtatacacttccaagtggctcatatgaaacagatgtttcatgaaaggtaacagagaacaagtgatctaaaccctcctttagtgggtatcaagtgagtattatggcctattacctgcaggtcttttgctattattttgaactgcagtgtccagtacgggcaggaagattcaatgtatctcctgtaggaacaagtaaaaatacaacagcactataagcaaacatctgcatctcaaaataaaagagggtatgtgcaagtgataggcaggtggtattcacatttgggctccggtagatgtgtgagtcagttttacaagcaatttgagaaaaagagacccattgcattacaggaggtgaggtgtattgagcagaccatctttagagaccagtgttaccatatcagttagctggagaaatgaatgaacacctcttttcttttttctttttttttggagacagaatcttgctctgtcgcccaggctggagtgtggtggtacgatctcaggtcagtgcaacctccgcctcccgggttcaagtgattctcctgtctcagcctcctgagtagctgggattacaagcacacatgaccacacctggctaattttttgtattttagtagagacggaatttcactgtgttgcccaggctgctcttgaactcctgagctcaggcaatctgcccgcctcagcctcccaaagtgctaggattacaggcatgtgccaccccgcccagccaaacacctccttttcaaaacaaggttaacatggcctaattaaaataagcatgaccagttcaccacgttgccgtaaactgggtggcatatgtcagtagacagttatttcatacttcttcagaatatcaaagagcagtccggacgcatagctcacgcctgtaatcccagcacttaggaaggccgagacaggtggatcacttgaggtcaggagttcaagaccagcctggccaacatggtgaaaccctgtctatactgaaaatacaaaaaattaacctggcatggtgggggcacgcctgtagtcccagctaccgagaggctgaagcaggnnnnnnnnnnnnnnnnnnnncagtagtacatcaagccccgataagtgcattagctgctaactgccctgaaaacatgagagtggaatattaccctgggctactggcacttactttgaggtcacagaaatagattttctgatggtacttcctgttagccaggacattattgctcccccttgtcccccccaccacccctttttttttggcctatccctagaaatggtgtgaagaaagtagataaaaataaagctaaagcgcgccggtaatctcagctactcaggaggctgatgcaggagaatcgcttaaaacccgggaggcggaggttgcagtgagccaagattgcaccatcgttctctagcctgggcgacagacagccagtccatctaaaatatattttcaaaaaaaaaaatgataaagctaaaggaccggttgcggtggctcatgcctgtaatcccagcactttggaagtctaagatgggtagatcacctgaggtcaggagttcaagaccagcctggccaacatggtgaaaccctgtctatactgaaaatacaaaaaattaacctggcatggtgggggcacgcctgtagtcccagctactcgagaggctgaagcaggagaattgcttgagcccaggaggcaggggttgcagtgagccgaggtcgcgccactgcactccagcctgggtgacagggtgagactccttctcaaaaaaaaataataaggaatatcagagagcaataataattgcctctcaaagtccacagtgagagttattatttataaattgtcaggagttctctaaacaagaacaaaaaagcaattggagcgaaaagatggctggaattgtgtcattttggacgttgaaagctgggaacagttacaactgaaatattaaatgggacatgaaatattaagtgacataccaggtttattgcatatatgaccatgagagtgcatttcattttgtcttatggagctctaaaaaaatccatgtaatggattaaaggtattaaaactcccatattctccctggctctacgccagggaacaaagcatgataaataatcccaatagacagaatatgtgggaaggaattttaaaatgtatttatggcggacatattgacctccctaactaataaaaatgtatacatgaggttttgaagaaaatgtgtagcccttacaacacactgtagtgttagtatctttaaaatattacccacgtctctgtgacatatggctgtcatcctctgtctttaccctggaagtgaggaaatgcatgaattttatagtaacatgtacagtcactgttaggaggaatagtttttatttcctttatcttaaagctgggctgaaaactacaccaaatctggattttgtaaataaagctttcttggaatgtgtcacacctatacatttacattttgtctgtgactgccttcccccatggggggcagagttgaatgactgtgacagagaccagacagcccacaaagcctaaagtatttcctatctgaccatttacaaaatttgcagaccctgccttaaaacattaaaaaatgggccgggcgcagtggctcacgcctgtaatcccagcactttgggaggccgaggcgggcagatcaagaggtcaggagattgagaccatcctggcgaacacggtgaaaccccatctctactaaaaatacaaaaaattagccgggcgtggtggcaggcgcctgtagtcccagctacttgggaggctgaggcaggagaatagcgtgaacccgggaggcggagctggcagtgagccgagattgcaccactccactccagcctgggtgacagagccagactccgtctcaaaaaaaaaaaaaaaaaaaaaaaaaaaattaaaaaatgaataggactgttaggaatataaatgtgtacttggtttctcatttatactaatcttgcgtgtggattcaggggatgaactcactttcagttcatttcctaactgtgtgaccttggccaagtcatttaacttctctaagcttcagtttcctcaggtgaataacagagatttaaaaaaagaaaaaaaaaaactgatcgtgttaataatccttgctcttcacacttttgttaggaggcagcaaatggggtaatgtgtgtgaaaacacccctcaagttgtcccccgccatataaagtgtgctgttggcagattctgctgaactggctgaaagtatttatttcacatcacatgtaaggatttgtatgcagatttcatttttttaattctttttttttttaaccaacactgattgaacttttgatatgtactggacactcttttagccctgagtatttaaagtcaaggccgccaaaatctttgtgtatgctagtaacacacccactcatgacagcctctgacccccatcagatcctttttctagctggggccatgtttgccttgtggcatttttcagttgtctgtttgcgtgggcaggagatagtgtattctaacttctttataaaccagcatgtatcaaggggtctggtccctggcaggtgctcaataaatgtttgtcagcagttgatgttgctgactgataatcactgccttctgctccccaaaccaccttggtccttgcaatgatttgggactttgggttttgaacagcaattgaaggctctccaatgagagatcgctgtggtaaagaggggtttaaagaagccatttctgagggggctaggcagcctggattggggattggccaggaaatcctacgaggaatgagagcacttctgattaatgcctgtgggcctgggaaggaaaggacagctgagagagggaaaactgacatgacttgctttcctcacattagtttttagagaatctcttaggtacatcagaagggaaaattattttgagagggaaaatggaagtgaaggtcaccaaatcaagatggggaaagaagggaaggtgaatagcattgagattcatcagcataagcatgatacaataatgataataattgcttgtgtaacactattatgtggcaggcattgtgcaaagtactttaaaatgatgttatttaatgctcacaatgatgcaatgaagaatatactatcattttatacaagcagaaattgaggctcagagaggttaagtaactttccaaaagtcacacagccagtaagtaggagagtgaggatttgaatccaggaaggccgactcccgagttcatacttccaaccatatgcctcagacaacttgcctataaaggtggacaagtttcgggaatatcaaaaaaagacctgaaccttgggggactgctctcaattggaaggttggtgaaaatgtctttgaattattttttcaagattttcttaacatttttaaaaaagaaataatgctaaagcactttgaaactcttagctttctcatacctaggaatcactgctctgaaggaaaaaaaataaccaacaatgtagcattcctgtagtttgaacagttctatatagaaacttgagaatcttttctttctttttgttttttgagacagagtttcactcttgttgcccaggctggagtgcagtggtatgatctcggctcaccacaatctctgcctcccaggttcaagcaattctcctgcctcagcctcccgagtagctgggattgcaggcatgcaccaccacacccagctaattttgtattgttagtagagatagggtttcttcatgttggtcaggctggtctcaaactcccagtctcaggtgatccgcctgtcttggcctcccaaactgctgagattataggcgtgagccaccgtgcccggccgagaatcttttcaaatgaaatatcaagtgcatcctttgaactgatgcattatgtattagccaagtagagggcacagtaaggatgttcagtgtctacttcaagttactcctctcacccccctccacccccgcaatccccagacatcttgggaaaagagtcattcagcccctcatttggggcgtgctagttctgtagacagtgacagaaaagctattgcacaaccaattctggatattgggttcattcttgtgccaaataaattttggttaagggagtatatgtggccttcaggtgagggaaggagaacctgcgtaggggctgggggctcagagtcctctcctcctctgcctccccgaagagccctggagctggtggttgtgcagactccatttggcctgagtgactgctcctgacagtgttcagccacacgccgttggactgccgccagaggcctttggaatcttggtcttagctgctgccattctccctgctgagggctgggttctcagcagggaacatgcagaaggggttagtgagtgtgtttgtgtgtgccttctaattcctgtgtttgcttctgggggactttcctattttattgctctgactggaaagaaaacagggcattatttctgtctccttaacttctttcttttgaattttccagttttacttttgttctttatgctgggttaactgtgtgtctgtctgtctgacttagacgtaccctgcatactctaaaacttcctgccagggacagctgcttgtgacaggagttctgcacagtcctaagaggggatgtcatagtcttctctcaacatgggggtcagacccattcccttgaacttaagaccatttaagttcaaatccatgctttttatttagcagctgtatggccttgaacaagttacctaaccacattatacctctggtttcttcttgcctgtcaaaaagaaatagtaaaactagactagcaatctctttctctctctcttttttttttttttagacggagtcctgctgtgttgcccaggctagagtgcaatggtgcgatctcggctcactgcaacctccacctcctgggttcaagcaattctcctgccccagcctcccgagtaactgagattacaggcgcacgccaccacaaattttttttgtgtgtatttttagtagagatggggtttcactacgttggccaggctggtctcaaacttctgtcctcaagtgatccacccgccacaacctcccaagtgctgggattacaggcttaagccactgcgcctggccaagactagctctcttattgggtcactctggggatcagatgtactaatagatgaaaaatgcttagagtagagtgaaggagcatgactagcctacagtatatgctccatgagtgttagtgattactattgttgaaatgtttgactagactctggagatggttctgttgttttctgtggtgaccatattagtcgcattattgatacggacttaatccacttttccccagataataaataataattaataaatttctaataataaagcattagctattatttttacatgtttttatactttttatagtttacaaagtgtaaatcctgcaatgtagtaagcgtggttgtcatctcaatttttctgaggatcaggaaggataagtgactgctagtaagaggcagaattaggaactgagctcataccatctgcattgtaggactctgcagtttccatttctccagagctgtagtattttctttgttgtccccactctttggtcccagagtctccccaccagtagtatcctcagcctagatcagtgtttttcaacctcagcactatctataattggggccagataattctttgttgtgtaggaggggcctgtcctgggcattgtgagatgttttgtagcatccctggcctctacctactagatgccaggagcagcccccaattgtgacagccagaaatgtctcctgatgttgcagaatgtcccgtgagagacaaaatggtgctggctaaaaacccctacccggccgggtgcggtggctcacgcctgtaatctcagcactttgggaggccaaggaggaggatcacctgaggtcaggagttcgagacgagcctggctaacatggtgaaacccggtttccactaaaaatacaaaaaaatagccgggcgtggtggcgcacatttattaattccaactacttgggaggctgaggcaggagaatctcttgatcccgggaggcggaggttgcagtgagctgagatcgtgccatggcatggctgcccatgccaggttgggcaacaagagcaaaactccatctcagaaaaaaaacaaaaaaaaccctgccctagattaaggaaggtggaagggaaatgtgtttgtgggaggaggggaaaagtggaggtgaaggttggctatcatttattgagcacttactgtgtgtcaggcaaattgcaaacgttgtctctggtttaccaacagaaatcaggattatctgcattttcagcaaagaaggactagggctcagagaaataaaactctatggccatttgtaagtggcagaagagagattcaaattcaggtccacctggcagcaaagcttaccactttcccgtcacctcctccacacaattttatgcaggctcatggcattttctttctttttaggaaccaagaaaacccacacagtgaggattaaatcggtttcaaagttattttgaggctgttcatatggtgcatacctgtaagaaacaaaacagaaaaatttctttgcagcaaaattctgagtaagccaagcattattttattgagaaaaagagggttttggctaaattctagtgtaatcaatcatacttgaacttccttagatcttagacgagtggcaaggtatgtgacaaagcataatttcatcgttgtcttccaagtatttcccttttggttttctgtcagactggtactaatgtggttttcaaatagatatatagtacataagcaacgaatgtgtgtgtggatatctgaaatgaatgtgaatgtgtgtatctgaaatgatatacatgttaatgctcctgttttaatctactctgtgtgcaggaaattcgatcagataaaataatgtcatttattagtgtgatagttccttttgtaaatattatgggaatcccgatagaagatagaagtgaaatatggaactgagtgagttgatgttgagaaaaactcttcaggggacctcaatattgcaaagcaattagcttcgtctacacatgactcccgagacctgttctagcatttgttcacttaatgcagtttcatttctgatgcctccacgttcagatcattaataagcagttagatgtgtcggcctgttaagtgactgtaagagaggatttatttgaacactggcataagctatcttagtatgtcctagaaaatagtgatagaaaacgtgtttaaaatgtcatgcaaaacaacctatgagatatttttgaatatattccttgtggtgagaacacatattatcaaaatgaaatgttggtgttgaacgtgtcatggtaccttatgaaaatatgacagcacttcccgtggtaaaagccagtcccaggaataacttctattgctggccgtaagcccagacaggtgtagctacaacacagagtgattagtgggtcctgagtcttactctctttctaaggcccaaactatcttgtcaaatttaaccatatcttgaatggaatcagtgtttggaaagttataaccgtgagttaaaagcaagagaattacaaagttctgcacttctcaaatttgagtaagtaggcctgaccagagcaaaccctgtgaccttcccagactaggaaacaaatcagggagatggaaaatgagaatttaaaaagcggggggggtttggtgagataatagtaaacatattaagtcatttacatctcatttataaagtctgaaaggattgttgtgttttaaatttcctaattctaaggtgctcagttctccctctcctcatggtatgggggaaggagtaaatgaactaatgtctattaagcactttgcatggtccctaacacagtaggcgctcagtaaatagtaattactattagttcaggctcttctggtacaactttgaacacactgccaactaaaagccactgccaaagttctgtgagagtgaacgaagacttctggtttatggtaagcataaacacacacagcctgaagatcttaatgcattaagtacttaacaaggtggagtatttagtaaggacctgtgcaaagggcaagttgacagagttctgatgctaaattaactcagcaaaatgggattacaggaaggttaggacaataacaagacattttttatgttagggtgtctcagacatcaatgtgcgtaaaaatgatcaaggggtcttgttaggatgcctattctgattctgcatttctggggtggggccaagattctgctttttttttttttttttttttttgagacagtttcgctcttgctgtgcaggctggggtgcaatggcacgatctcggctcactgcaacctccgcctcccgggttcaagcgattctcctgcctcagcctcccgagtagctgggattacaggcatgcatcatcacgcctagctaattttgtatttttagtagagatggggtttctccatgttggtcaggctggtcttgaactcccgacctcaggtgatcttcccaccttggattaagtgctgggattacaggcatgagccactgtgcccggccaagattctgcattttaacaagtttccaggtgatgctgatgctgcttgtccaggaccacactttgctgagcaaggctttattaaagactcaaaaccaaattctttcccccagcccttccttttgtctcctgcctatgttcagcacctgtttcatatgtggtcagaatagcagagtttctcacaacccagctccagccctcggccaggatccctggtgaccccggcaaacacacacttctttagggtcacgggcaggttactgagtcaagactgccaaagcccaacaatgatattttccttcactccccatcgtcctccctctctagccaccccaaacccgggactaatcttggagctgcttaataataacaaagccagcagcagagtaaggcaagatttcaaagcagagtttttcttgtttggcaattacctaattcaggatgcgattcacagatttgcaaaacccatgtgtgtggaaaccgtttctcctgaaagatgattaaaagcagatcctctcctgaaaaggcgacataaaaattaagtgagtgacagtatggagtcttcccgtgccccaaatgtttggatgcatataaattacattttactaaaatgtctacacacgagttcatacacgcatgcgcacacgcaaatagcggagaatctggttctaattacttgtactttagttgaactttggcgtttcctttgaatctctccctaatgtatgtgagctgtaggctttgcagtcctgcagtgaatccacagaaaaagggagaaaaaaatccagataggctctctttggtgccaacacaaatgaagtccaaacgaacattttgaccaaacgcaactttgctcttcttccttaattagctgaaattactcccttccactgggattcggagctctgggctcaaaattcccctggggccatgcaggaaatgtcttttgctttataactcctttttcttttaaagctcagctgcccagagagtgcattaaaatactgtcttaatcacagaaggttctagtaaaaaggctaggctttcctaatgcatgatgcctgcctgcctgtaatcaggcccaacctaaaatcctgaaatctgtcaacatcgttttagccagccgtaaattagctctcacaaagaaaaaaaaaaaagtatactgagctctcttaaaaatgttatctgctacttaatctaacctttagaaaaatgccaagcatgtaaggaattgtgaagggagctattgtcgaagactttctgtgtgtttaaatgacactcaggtgtgttgtaacaacaaggacatttatactgtgttttctcaggtgagttaaattcgtaagtgccaagtcctcttaacaggcagcaatgttaatttcttttcttttgggaatgaatcaacccaagagctgtggcagtgtttaagaaagcttcgtcagtgggaactcgggaattctgcttttgtaccatcccagtcggtggagattttgtttagctttgtttttgttttgtctgcaaacaacctctgagtttgaagtccttttagaggactgtttctcaaaatgcaatccggagacctgtgcccgtccgcaaggagagaagttcagacattgagagcaagtgtttcaaaacttttggagcaatttgacagggtaattttatgtccattaaatctaattttttttaaagagttggagcttgtgctttggacgtcgttgtttttccttaactcctatttcctggagattcatttgtattgaatttgatcaatccatgagggattgggggaaagactaagaaatggtgcttcaccattgatagtctgaaaagcacgaatttaaagcaaatgtccttctccctaacctcaagaattcccctgctgcaggccacactttgaggaacattgatttaaaagcaatgagtcccatgactaatttattgtacaaggaaggggattctagctttgttttccttagtgatagttatctgtatgttgtgggggtggagatgtctaaaataggggctagcagcttccgaggacaatgctgcagatttggttcattctcatcttccctgaggctcactgtctccactcatgtgcgcagttcagagcagccctctcagcatcactggtgctgactgtgctctgggcggggacccacagagccaagcatccatctcacccgagtagcagaagttcctctgacttgcccattccctgacgaagcagggaagcccatctggttagcagtttggatgccacattggaggctgctgcttgttgggcattcaagcagcaaacagaactgagtaagtccataagtaggcaaggaaataaataaaagcaggagacaaaaagcagatccgaattattcctctaagactgcttctccaaactgaaatcacatcaggatggctgcagtgtagttgttttattgaatgacacaagcctcttttccccctgggaagtctaaaaactgcttttttggcctgcctgagatcgctgaatgagctaatacagaacacattgtctgctgagccggcagagttttcaagcaaaaattttatcattccatagactgattgtgcttgcctgcaataaggaacaaaatgtttgaggcctctcaagggcatttgatgaatctaactctaatttaaagggactaatagattattgatttaagcaggatgacagtgaacagatcaatggctgagcactctgtatctgccttaaataccaaaaatgactggtaaaaggaaagccatgggctgtccccctgcttatttcccactgactttcttggggggtggaggaaggcaaaaaaagaaaaggacctctgataaactttgccaaagtatgtttttgctaccttaccaaaaaggcaagagattgcattaaagtacaaatcttttatattgatgccatatcctggtttcctggttgtaattctagaatttgtcttggcatgttcgcctgaggctagctttggtgatctgacagactataccactgattttttttttttttttttttttttttgccttgcattgttctcagtgttataggccacatagaggaaataaaagaccactgaccatcaattctgagggtgatatttgaatatatatatatatatatagagagagagagagagagagagagagagagagtcaaatacttaattttttactaccagtgggaaaatttttccaaagatgattttttttggggatcgtacataacgtttttccctttctgtttttgtggcatttgtagcattcaaattatgttcatttatggcatttgcaggattcaaattataaaaacagtagaaagaaccaatttatcatttaaaaacatagcccagtcacttcctcttggaaggctcccttgatttctcctgggataaataaggcctatagttcactctgacattatattagtggttcccaaactacttcagtttggattcgcctgggaatactttttattatttttattttttgttttgtttttctgttttaaatcttacagtcagccaaaagggaattttttttaaaatggcaattcctagctccattctcagacattctggcataatagatctgggatacaacttggtcattaggacgttaaaaagctccccagctggttctagtgtgcagccaagtttggaacccactgtattatcattgttggtttattctctattaggccaaatttgtcaaggataagggattatgtactatcattgcccatagcgtataacacaatgcctggcatgttatgtcactcagccaaacaaatgattgaacacatgaacagtctgagaatctattgtactcacatgagaaagttcctagaattattggtgaaatcaccaccacctaaataaaaggccagggctctcactattgattacttacaatagaacattttcgttcatggcaactgttcaggaaaagccttctggattcattcatttgttataaatgactcttatccataggaaaagatccaatctttgtaaaatgctttgggatctttaatgtccagtagacttcccgttttttgtgtgctttgccccaagtttcttgggtattaaattatgcacaattttgtttcctttctttgggaaggtgaaatgctggactcccttcagtgcatgtgtttgaagtggcatatttatggaaattactacccacttttgaaattcagggcatagctctgacagctgattccagccctaccagaattctatttacaactttcctagacaggccagattagctgttctacacgaacgagtaggaccttaaaacacaccgctccccaccttccttctgtgaagaactcaatgcgagattgatcatagtggtgatgacatgactctgtcagttgttgaagcacatggatggaagtagaagcacacaaatcaaaccactccaaaaggtttgagaggcatctggggaaggggtcacttacgttgatatcagggagtgtaaatctacacaacctttctagaagtcagtttatcaacatgcattaaaaacaaaatatttttaaaataacaacctttgaactgataattacacttcagtaatgtatttgaaggaaataaagatgtggtgagattagctacaaagttgttcatcacaatggaatgttttctgtgaaaaatatttatcgacaaggaaataaattgatgacatcataggttaaacaaagtcctcagcagtgtcagtataattccaccttagtagacaaacccaaaacatttatgtgcatagaaaaaaattctggaaggtcgtacacagtgaatttctctgagtgaaaagattgtgggtgagtgattctgtgtgtatttttccttagatttttaatagacagtgatacattgttttctaattttaacaagcagtgttttcttgttaattcgctttcagtgaagctgattagttccgtgtgaagaatgcttttgcatctactgcttgatagctgataagctttagtgacatctcagataccagcccttctataaaacagttgctgccactgtgccaacttattcaaagcaagggcttcctatctgccagaaataatgtactcaagattgatatcttcatcccagataccttggttctaaccagtaaagactataatagatttatctactaggacctgtactactcaaatgaattcattccaagattcttctgaattatgaaaatactataattatagttgattctgttccaaagggctaattaattacttttttaaggaagcaaaggagtataagagctatttggtttctaattttatcatttaacaacttagagggactcttagtgctcaaaatgaggaagaaaaaggaaaaggaaaaagttcatgtgctaattcaacaaatatttattgattatctgccatgtgccaggacctctactagtcctggaacacagatgtatacaatgcaggtgagtttctttcccttatgaaactcaatatttagagtataggggatggcagatgtagaatataaaattatatacaaacatctaaaatttgaacactggttagggttttatggaaataaaatagtgagacagagtgaccaggaatggagaggggcattttaatgagagaaatcatctctgggaaggtagcatttgctttgtgatctaagaaacgaaaaacaaccagatatttgaaggtctgagaatatctagaaaggacaaatagttatcacaatagcctcagttggtatgagagcttggcctattcagaagacagaatagatgccaattatatagaactcaataaattaggggactcactgaaggaaatgatgctgctaaaatgccgtgtgatgaaaagtcttgtagaacatactaaggagtttgactttgatctaattggtgactattggagggctttagataggcgagtgaaacagatggattttaacatttgaacaactatcttgactgcttgtttgaagaatagacactaggtaggaagaaggggcatgaagtgaccaatgaagaagctattgcagcagttgtgagaggcgatggtggattattagcatggtgtggtagcaggatagtgatgtggggatggattaacaataagtttagtgggtagagttgacctgacttgctaaaagcttgcctgcaggataatccagtcaggagaatatctactctgggagattataagcagtagggcaactggaaactttatattctgggaaatacactgtgtattaaaaagcaatttggagactagaagattctggaacattatttaaccacttttaattctccttcccgatttccatcttattttatgagcatatttacctgtgatagaagtacagccagttcttgctttgattctgagtacaatcctggagaattaggggtaggagaacaccccgttcttatattttgtgaactcccatttcccatggaatttgggtggttagataacaggatggaggattattatttttttaatctagaataaagagtaacatgacttaaaagtgaatcgcaccactctgtgtcatcattagttttaacctactgcttctcaaatgttaattgtacatttagtcatctggggatttcatcaaaatgcagattcagattccacaggcctgagctgggacctgatactatttttctaataagatcttaagtgatgccgatgcatgttggcccaaggagccttctttgagtagcaaggatcttacccatattgttattaatgaagatcagttatggctgcatcatgctaaagaccctcccagtacacttgttgaatgaataatttgggcattttcttcatttgtccaaaggaaaattttaaaatttttatttatttatttatttatttatttatttatttttgagacggagtcttgctctgttgcccaggctggagttcagtcgtacgatttcagctcactgcaacctctgcctcctgggttcaagcgattctcctgcctcagcctcctgagtagctgggattacaggcgcacaccaccacaccttgctaatttttgtatttttagtagagatggggtttcaccatgctggccaggctggtctcaaactcctgacctcaggtgatccccctgcctcagcctcccaaagtgctaggattacaggtgtgagctacaaagaaaatttacttttggttaagtgagcaacaaggtcaagtcgtttgagattctacatgaatcagaagctactggggtttgtagtatgattatctgaatttgtgtcttggctctaccactgctctgctggtcttagttagacaagtcacttccttcctttgagtttctgtttctgttgtggctaaaattgtgataaaaaccatggccctcacagttctgtgtgagctgtggactgcaagtgagagatgtatgagactgctttgtaaaccgtagagtaccacatcaatgtcagtgtcaccactgctgggcctacaatgacagctgtttttatgagcccattcttgctagtgttattgctgaatttggggcagaagcatatgaattcactgttgaaaaaagtaatgaactaaaatacattttctcttttttctccctctaccccatctctattatagcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaaggtgagtattcacacttctgtgcctgatgaactctcattctccatgtactttatggaggtgacctacccagttccaaaaatgggctggatgtgtaacatcacctcccataagtgtggtgaattcagttatattcagtggtttttattacttccttatatatctttggtttaaaattcagaaacttctgcaaatgactgatgagggtcaaaggttctaaggcccttaaattacccccacataataattccttttagataataagaactggctaggccaggtgtgatggctcacgcctgtaatcccagcactttgggaggccaaggtgcgcaatcacttgaggttaggagtttgaggcccgcctgaccaacatggcaaaacctcatctctactaaaaatacaaaaattagccaggcgtgagtggctggtacatctagtcccagctactcaggaggctgagacacgagaatcacttgaaactgggaagcagcggttccagccagccaagatcacaccactgcactccaacctggacaacagcgagactttgtctcaaaaaccaaacaaacaaaaaacaaagaactggttggaagaatcttgaaaagcatcgttctttttctctttagaacatgccgtctggtgtctgtagttttatcttatttttgaatatgactgacagtccactgaatcaacttgcagggaattcaaggttgaaactgggatttgtctgctggctgttttcctcagctctgtggcctttgaattacagtttgattttcagcctgtagggacttgctactgtatgtgtgtcataaattcaggggagctggatttaaaattcctgcctacagaatactggaggctgaacatgtgtcagagagtagtatatggctgctttgaatcaagcaagacaattgttttcaagtccaacagtcttaattgagtgaaagagcttcttcttttttttcaggaaagaaaagaaacatgacttcaaaggcaaatacaactaactcatccataaaaaatttctcaaaggaactatggctgttttgaactagcccttccctagatatataacttctttaagtcctctctggatggttgtttacatctgttgtttatacatctaaattgcatgattcatttgtaattgttaacatgttggaataatgttacaggtactccatggcattttatatttggcttagcagagttagcacttaactgtatatattggtcaggcactgttgtataacaaaccatcctaaaactaaatggcttaagacaacaattctttatttagcctgcaattctgtgggtcagcagtttcagccaaactcatctgcatggttcacctggacttggctaggctccaccatgtatctctgggcagttgtaggttagctagttggctctgcttctaggggtgctgactgtgggctggggagactcagctctcctccatgtgatccctcattcccatcaggctggccctggcttgttcgcagaggcagggttccagaagacagaacaaaagcacataaggtctccagaggcttaggctaagaagcatctcattactacttctgccacactattggccaaagcaagttataaggtcagcctagactcagtaggtaggaacatcaactcaacttttgttcttcttttaaataaaataaaacgaatctgtcaacttgaaaaagcttttttgtagagatgggggtctcacgtatgttgcccaggctgacctcgaattcctgggctcaagtgatcctcccaccttggcctcccaaagtgctgggaatacaggtgtgagccaccacgcccagccccactcaatttcttaatgggcagagcttcaaagtaataagtgatatagatatggaggggccgggggaatgggtgtcatttttgtaattagaccactgtactgcatgtctgattgcctatgaacacaaagtggttggggaccctagctccactgcccagcatgtcatacatagtctggcatatagtgggtgcttaaagattgaacaaatttggccaggtgcagtggctcacacctgtaatcccagcactttgggaggtcaaggcaggcagatcacgaagtcaagagatcgagaccattctggccaaaatggtgaaaccccatctctactaaaagtacaaaaattagctgggtgtggtggcgcttgcctgtagtcccagctacttgggaggctgaggcaggagaattgcttgaacccgggaggcagaggttgcagtaagccgagatcgcgccactggactccagcctgacgacagagtgagactccatctcaaaaaaaaaaaaaagattgtacaaatgcgtaaatgtcactcagcccctcaaagtaattttgtgagtttttcccttcttttcaaaccatttaaataaacatatgtattatggtttatgaatataataaggccagttttgggaaattcattaaaggcttaggaacatctctctgcctctggaattgtgctattttatggcaattctcttttctccagtagattctgacatggtagtcaggaaagttatatgggcaaccagttggcagctgactaaaaaggaagacatttgttcattcaattattgctttattattagtaacccctagctgaacctacttaaatttatcctgagatttggaaaggtttcagtggaatagctagttcattttgtccacttgttgtgcaatatataaataaatgattttctaatgtttatttgaaaagtaaatgaaaagatacttctttatttctgaaaaatgttaagtcatctcatgtccagaaatctgagtgaggtatgctgtaactcagcgtacctgctctcatcattatccaacgtgtctctgtggcacatactaggagctgcatatgaagctgtttcatgatctgtatagcacaaactgctttaatcagctcatagtcagtgagttctctgagcttagtttgggattctgactcttttttaggaaaaaccccaataaaaacaaaacccataccggcacaaacaactttgataagctcagttaagtgatacagagtcatattatggtgtatctttttaacagagctataaacccaataaggtcaggtgagttcggcagccagttgaatttgataatatttttatattgtgggtggattgctcttctccctggtcattgggaaagacttggtctacatttaagcttgctgggaaaatacagtgacaaaattcacagaactgagaaacatgaggaggtaatggtaaaatacaacagccaaagaaaaagaaatataactttaaaaaaattaaatataattttattgtcatttaaaaaaattatcaatacagtatagaatttattgtataaaaatagaaaattaaaacaaccattattctaccctgggagggaacccctgtaaaactcagcttttctgtaagtatatgcatattgttattgtttcagaaaaatggaattttgtgttgtatactggttttaacttaatctttaataatattttatgacccaaatttaagcaactgcatagcttttatggttatacaattaatatagtagtttacggttatgtcataatttatttaactgattaaggtgcttacagtttttttcgattataaataacactttaaattatggcctttaagtatatctctgaaaatttccttaggataaaattttccttaggataaatcagtataagtggaatttttagatcactggctttgtatatttttaaggctttcgaatcagattgccagaataccccgtagaaaagattattgtctagtagtctgtaaaaagtaaatcctttcggaaagtatctattatctcccttgtgatataataaggtaatgaatccagaagcaacttttcttcttgaattctgcctgtatttaatttgatatttactatgggccctgtgtgtggtatcattttaggataccagcagatgcaccataggccccttgttgaccggtagaaactggcccaaccattggctggaaatcaaagtttactactgtaagctgagaacctctgctctaaagtaggactcccaaacagagcctggtatatcttcaagaagtaatgcctacggtggcttctgcctgtcataaccaggatgacctaattgactattatttggggaagagaactttccgtcctcctagggactgggtgacagtctcagcctctgctgcagccatacgatggtggtcagaatttaacaaatgggtgtggtccatctctgggaatgaatggtcagcggctgctgtattgacacagcattaccatggcagtataaccactagacacactgtagggatgccctgtttagggggtttccaggtgagcgatggcagtttttgtgtaggggacaaagagtacacaaaaggaatgtgcagtgtggttagccaagaatgtttaacagtataaaataataaagcaatattaaaaaaataataggacaaaataaaataatgtctttggaaaacagtcttattgctcatagctaaaatttaatgcaaaattttggccttaatcatattttacatttcaacttttgtagcttttgaggaatgtgaagtctagagtgagaatgctgggatgtgaattctagctagactacttataagcttggtgcaactctctcttttctcatctggaaaaatgggggtgatattacctacctcatggtattgttgtgaggataaaatgtttttactatgtataaagcatatagaatagtacctagcacatagtaagtgataagtactaagtggcacatacatgcttagttattgttttgttttgttttgtttttgttgagacggagtttcactcttgttgcccaggctggagtgcagtggcgcgatctaggctcactgcaacctctgcctcccgggttcaagcaattctcctgcctcagcctcccgagtagctgggattacaggctttacaagcatgtgccaccacacccagctaattttgtatttttagtagagacggggttactccatgttggtcaggctggtctcaaacttccaacctcaggtgattcacccacctaggcctcccaaaatgctgggattacaggcgtgagccaccgctcccagcctatcgtttgttttatcattaagttattataatgacttttgcacacagtgatgtaacatcaattataatcttagtactgttcttgtagtgttctttctgcagttctccattcttttctatcaaaataacactgcctctttccttcaaggctcacattaagaccctactactccatggagcctccctggattaccctagtacagaggttgccaaattgcttctgcaaagagccacatagtaaatattttaggctttgagggctatgtggtctttgctgccattattcaactctgtcactgtagcatgaaaggtgctgtagataatatgtacaaaaatgggaatggctatgtttcaataaaactttgtttacaaaagcagtggaccagatttggcccttgatgatgttattcttcttacaacttctaaaactcagaagctggtgccccaaagctctcatgccaaaagtggcaagcccgctggttttgctgggctatgggcctgggtctgctgctccacttccacactgctaaaagaagttcatgtccacctgcccagggctctgtggcttagaagctttaagccatgtctggtcattcctccacccttccaatcacactcaaatcccactttcccatcatccaaaatcagagaaattagaagtatccaggtaattgagctacgtccagaaatacctgacgtcacaccttggagaggtttctggaacatagtctatgctgttgtatcagttagcttcttctgcttaacaaataactcaaatgcttaatgtcttaaaacaatagacatttattattcattataattctggataggtcttcttgtcttggctgacttggcttgggccaggtggtctaggacggtctcactcacatgtctggggccttggcaggatgaccagatcctctccccctgttgttgctcaccattagcctagcctaggcttcttcacgtggtggatgggttcccatcagtaagagaagacaatcaccatacaatcatagcaagccaacgccacttatccagtgaaccagctcaaacaaacacttctcaccctctgcttgtatcacatttgctaatatccccttggccaaacaaattgcgtgactaagcttggattctatggatgaagaaataaacttcacctcctaaggggagaagtgacaaagtcaccttgcaaaagggagagcctaccagaacttgcatttggttacataccgtcttctattattccctagtttgatgggcaagtctcttctgacaaccttattcaccaatcattcatccttaagcatatgtttgttgaacacctactaagtttcaggccctatgccgggtgctagagatacaacagtgaacatgacaaagttcctcatggaatttagtgtctcacacaagggacagatgataatttaaatttggaaaacaataaacagaatggtctaataaagaataatttaggggtattctatttcacaggggtcaagggggcctgatgtgatgggggtcaggtgggatctcatggctgaggaggaaccagcggtgtgagtcatagagagaaagcattttaggtcagaaaccaaacacttggattctcggagcatttctacttcttctggctatgtccattgacttctctgggccttagcctatctgtaaaatgaaagcaaatccacaagtttgaacccagtaccatgtcaaatacagacataaaagcagtgaacctaataatggcactgatttcttgttagggctggcttacgtggagtaagaggtctccagtgtttgtacgtccaagtgtggagtagagggaagaagaaaactacccttgttgggtgccttctgtacactaggcatttgggcttttttttttttttttttttttttaacccatagcgcttttatttctcacaacagctctgcaaggtaggctccgtgacccacattttatagatgaggtaacagagggtccgagtagttaaggaacgtggccaaggacacacagctagcctttgctagagctgggattcaaatccttttcctgttaaaaaaaacaccccactgcttcagccacacttagacagaaggtctgaagcagtggtgtgttatggtctagagtgggggtttcataggccaccaaatttaaaactaacagataggggcatatttttaaaaaacatattgtcttgatcatttcataaaagaaatgacatctctgcgacaaaaaattaaaaaaggaagcgcttacaaggcagtcagtctttcccaagaagggacagttagcaggcagaacccacacatgggcatgttcccagatgcagctttgtccttgctctctacattttgcctttgatgggtggaaacttcctatccctaagccaacctttgggggccacaatccagcctgtcctgcagaaggccccagggcgaggcctggcacagccgtgatggcgtgtcttctccacaagggcgcagaggaaatgcttgctgaaggtcacattggtagccttctatttaaagcagtcttttaagagtttaaactccactagccccctcagtccctcagggctaattttgtccatttttctcatctgcctttgttttgctagcctctgaagagagggaggccctcatctccatgacagcgttcggctgctgggctgggttttcctggcagacagcaagcagaatgttcagtcacaaaaagttttgcaatcaggaagatggatgtctgcacttaattttagaacttctattaaatactttaaatgagcttaatgattttatttgaccaaggccatttaaaaccacattgttgtttttaattggagtggataaacatgaacatgatgctctctttggagaatatttttagctttcctcactctgatagttgcttctgttttaggggtttgctgcagtattgatcccaaagaacaaaataacatatccaaaacaataacaaaaacaggacactctgtgtaccactctgtgatagctgaatgaattatgaaacctgccataaacttcattactatattggatcacacagagtagtttccctcatagacccaaaaagcgtccctctgttccctgttgctataatctgccaaccatggaggatttacatgtttcctcattcattcatcagacatttattaagtgccttccatgagacagctccaggatatagaaatgaaagttttgtgtatattttttccaatgctgaatcccattgcctaaaaaatacagagaaccaggcctgtccaataatagggatgtaactggctcaagcccagctgctggctgcttggaggcagaaaacatgagaagctaggtgtggtaaaaggatttaaattctggcttttggggaatgaccaggctcaagtctttgaaagaccattccaaactttaggctgtggagaggggcttaaaaaggggaacgtggaggaggggtgggagcatgtgggagtggtgctgggtgcaaggtctgcgtgttcagttccggaggccgtgttgagtcacggtccacctgaagcacagcgtgccatcatttcagcaatgcccgggttgtagactaacccttttgaggtaatctctgcaatttcacagctgggtctccatacctggtttgtttaaaaattagctcctggaacttctaagtaagtgcctaattagataagctagtagttcaagagagtgtctggtaggaagggaggaaaacaaaaagtttttaagtacgttttaatgctgagagcaagaaaagaaaaaaaaagttttaaaatgcaattttaaagctaagctcctcgattacaggtaaatggtaaatattcattggatggatgaatgaatgagcaaggaaacagtgtggcatgtgctgtgacaattgtagctaagggtttgatgggcacagagaaggagtctcggatccctctgacacattcatggaaggcttttatagaagatgtgattttatagatgtgtaagcattttccagatgaggaaggggagaggagtgttccaggcaaaagttgaagatggggctggaaggcaagaggactcagaataaaattgcctatatagagttacatggaaaaatggaaatctatccattctgttaacatttattttgcataaccctatataaacaactagggatccataggatattaaagacactcaaaaggactcaataaataccatttcctcagagaagccttcctttggaacccccaggttaggtccccctcttttacatttgctgttgttcgcctttgtagcacttaacacaattgaaattaagtcattattaccaagtcattattaccaagtcattagtttaatgtcagctataaactccaggagggctgggcaggtctctcttgtcacagccttattactagggctttgcatagtgctagggaggcggcacatagtaggacgttaatgtatatatgcttttatcataagttatatctaattatacagtaattagtgtagttataaataacgcataataagatataattgtataataatgcaaatagtatattactttcatacattttatctaattatataatgaattgcatctaattacatagggcttgggatgatacattcatgtaaacattcatggaattatatataaacaggacaaggtctttggtgaccaaagtctagctcatttcttagtaatttctgccttctacctcagttaaccttcattgcaaaacgtatgtcctctctgatactatctttaggcaaactcttaagaactagtgcctggaatgatatactgacgtggaagagtactgagggctgttagtgctttaagaaaaatctcagcttagagaatctacctccatatcgaggaacctcaagacagctgaaatgacaatctaccttttcctagtaataattcctacggaaggagaaaacacttttcttcttctaacaaattgagaactgattttggattgaaaaagcagaaaaatctgtctttttttttttttccttctggtgtatggataaacaggaagttgggggcggggggagtgaattctgaattagcccgcaactctgcgtgttttttttttttccttgagttggcgtggtaaaaatagtttatttaatttggtggttttaagaggcttataaattttttaatggttaaacgttcaggaatgcttgtgtagatgcttactttgcttgttgtttgaaaatatctagaacactttcatttgctgtttttgttataacaaactaaaggtctgctattattgcaattatcctctttgtttctccaccttttactagaaaagttaagagagctttccatatttccttctcctgggtggatgcctgtaaagaggtgatatgaaatgaaattgtctggaaaggctttccttcttcatcagcccccctctaccttctcattgtcagggcagggctcagagcccttggtcttcccactctctacagttgcctctctccccacccgcgtacctatgtaaaaccatggaaataataaaactgtcttatatcttacattcctatagccttagtgtttctaatgcattttcatgtatgaaattaaattaagccaggcttagctgaagtaaaaggaaacccccacaaggtacaatgtttgctacaggacttttttctcacatcagctcttgactggcagccttctcttctccacacagtgattaggactcctgccagtgctgcagcttgtcatcctcttaggttcttagcatcatcttattctagctactggaatgaaaagagagcgtgggggaggcagtacacctgcttcttaaaagccccggccaagaatggcatacctcattggctagaatgggacacgtgaccaaaaccaactgcaaagtcgactcagagatgtagtctagccatgtgctcaggtacagacctacttttagggaaagaaattatggatttggtgaagagctaagtttctaccataggttttttttatttgatcctcatcatatttagagaagtaggtggaatcgattgtttccccctccatttcacagatgaggaaactaagaatttatgagagcagattctaccatctgtggttttgatttataatgtgattctgttactgaaatggttactgtgagaacctccttaaatacatttctgtaaggttccctgaaatttatcaaactatcttttcaaggcctctgattctaaacatccccatattcctagttcattcagctttgacattttgagaaacttggaaagccttacccaatagaggtagacctttatcaggggttagattccagtgtcatcacacaaggcaaagattacacgtagacaaaattaccccagaaaatccctttgaaaagcacactgctggagactgacatatgtctctcattaggacctacaaagccagttcttgccatagctctggaaacagatcactccatggaacaccagatgaaacagttgttttctgttctcttgttgtatcaaatatgtgtccttaagcacaacagtcataccagcacaacgcaatgcttatgtcctgaaaaccacgcatccctctcattgtcttcttgtcactatctcctaccataatagtttctttgggattagaatttctcttgtgccttttaggaactatgtctttttgttgttgttgttgttattgagtatttttccacttcagaaaggaagattaaatgtgtcatatggataagcaacaccagaagggaaaattttgttctatggaccctagaactcatccctgaaaaaaaaaaaatagagggaaataaaactctgtgtgcatctctgcctgtacaaagctagcattgtctggggtgaaggggaaaagctggggttctggcaggccggccccattagagccttgtttcttgttccatattgaaaagatgacattcctttgctagcagcgtcctgcctggatttctggcaccagttctgtggctagcactattgcctggggcatttttgttggggttggttttgttttatttcaaaagcagcaaaatgcaggctttataaatgttcaaggtagaactgtttttataaagcttgtcaccaaacttgtcagtacagtcaaggtggcccgtctgccagggtgtctgcttccttttcactggtgtcaagatgtatgagaaggcatatatatagtgaatttcacttcttaacttgttctcaagtgtttctgaggcagcccttgtgttttcacatgggcttctcctccctctcagggcttcatgtaatgtttcatttataacagagattggtggatttgcaaagtaaatatttcaataagaaaaaagcaagatcttcggtgaccctctcggttctgcttctatggaggtattttctatgtctggcaggaaaaaaaaaaaaaaaaaaaaaacctttatcttggctgcaactctgaactggagcgtgtaaaatgtacttctcaggttctgtgagccttaaaataatgagcagtagaaaactctgaggtaggtcagcgatggggagaataccatagttttataaaggattttcatggttaaacaaatttggagaaactagaatgaccaagcaatgttaattctccactgggcttttgaatctgaaaatagcagcaattctaagtacacaacaccaccattcatacagccctggaaagtcccccacatcaggaaaattatccttattagtcaaacccagtagggatcatctgactattcctcagggaaatgagaatttttgtttggatcttacttctctgtattgtactcaaattgtacatgagctatgccacatctggggactttgcgattatggtcatgttttcaataagaaatacttctgaaagctgctgctctaatttatatgtgtcattcctcattaacataaataaattcagaataatagcatgaggtggtggtatttttttttatttttcagtttccagagtcatcctgctctgttaggtgttccttcagctggctgggaccctaagccagtttacagtcccaacacttgctaagatattgtttgatgacatttattctgtttggctctacagtttgtcaatctcatgatttcatcaaaaacgttatgctgaaatgcttgaatatcttttagtatgtttgttgtgttgagctgtgataaaaagtatgaaagttttcattccaataccaaaacgtagaaagagggtatcagaaattaagtgattctgctaattcttgttatttcactaaaatgaaattaaatgtataatttctaattcagttgtattttgctcttaaattatcattttctgctttaagaattaggtggaaagtatgccctacttaaatgcatgtttggtgctaattcttgcctgttgaccaaaaatttgagtctcatgttgtgtacagtatacatacagatatcatttttttctctaagtatttgtgacaggtaagatctgtgcaaaattatgaattacattacaaatcgtaaatgggtcttactgtcctcactgaatatatttggtttttaaacccaaattcataatgcaggcacttcttttgctatgctcacgtgtatgatgtttgctgttagagagttcacaggattgatatcccagactttggtggtttaagatacctaaaagagtatttttgaattattgagtctacatcaggtattcctttgttatttgattatttttatctgtcttatttcttatgagctctgggcctcagaaagaatatttctgttctccactacgtacactatcagaaatatgagcattggatgagggatggtaagagtgacctccaaggaactaaatgtttacctgtattatatcggggtggataagctattatccaaataacaaagggggggggatcccctgcaaaaaatcactatagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttctttttcttcaagccatctggggagcacagtcaatggatgtgggtaaatgtttgtttctgaatccttgctggaacccaagtcacctctcctctcatggaagtcctctgccatatccacgctgaccaataacattctaaagtaggcttcaagatcagtctccttggctctgcagtgctattactcctgcaggaaatgcatctggcatttgttactctcacagtaacatcctttcttccattcacagttgaggccctaactcttcccattttagttatggtaaggccaggttatgctgcaggaacaaactcaaaattacaatggcttcaaatagtagttgtgtatttgtcactcacaccatgtgtccattttggatagatagttctactccatgttaccttcactcaaggaccaagactgatggagtcacctccatttagaaaatcactggcccttgaattaaggggaagaacaatggagaattgcccacttgcactggtatctttctactgaatctcaaacacatcatttccactcacaactcattgactaaagcagtcctcttggcctcacctaatccaaatggagtagatgaaaatgcaaacataccatgtgtctagaagaaggagaatgggcagttgccaatgtttactcctttcttctgctctaagaattacaatgattttttgttttcccataaccatgtggttctcagtgtacttgtcttgcacagctgcatttatatgcactggataaagggtcccctccccagcaatatcaaactctttggggcccttaataagaggtttatgtaaaaccttttgagtagagatactcttatttggctgtgccttctatttttacactccattctctgcagacactttttacaagtttcttaagaatagtttatagggtagatttaggaaaaaaaattgtgtggcaccccaaattgcctccctccaaactgaatatgatcataacgtatctttcattttatctttctacagtctcccctgcctttctgggacctccccaagcagttaaagggcacctgctatccttgtctttatgtgagagacccagtcgtgggcctacaactgtcccattctgtgtaaacaccattttttccacaatggcttgttgagtcttccctggagtagaagtgctggcagccatcctgaggttgcaagtttcctgtagtggaactttcattgtggtactgattactatttgaaactctttcatgaatagtttacttagtcactgtttttctctcccactagtgtgtaagtgctatgagaataggaactttgtaagtcttgttcacttctgtattctcagcacccacagcaaatcttggcatgatgtaggcactcaataaacgtttgttgaatgactcaataataaatagtatgtagaagaggtgggagaaaacacagaattagagcacatttgtactagatccaagttatcacaggacaatagctatggggcaaatggaggagatgtttaggatactgttggccaagtatgtcctaacagatcagaaaggaagaatgaaaatgtcaataggcatcctttattcatttcatttttagttctaggaaagtaaatgctcatctgagattcagaggtatgcagaggtgcctgccccatctgtcttgctgtatcttcctagctgcctattgccatgctgctcttgggcatggggtaggtgactcaagaacaacattggggctcagtatgccacctgatgagatggctttttggtgtctgccaagggtgactgtttcctttacacaatggttgaacttatcaattattcaggttacttcttagccccaagttgaactggttttgggtttcaaatattggtctttccctgtttgtcatatacaacagtgaaataacagatgccttctgttcattttgaagtgataaatcctataattactacaagtacttgcatactgcagtttattgaggatgtacatatgcaacatctcctttttataacagctctattatgtaagtaagacagagagtggaatcccttctcccttagggtttaacttctagaataagcatatgaggtaaatattgtatatggttaaaatgacccttaaatcacccaagacgtgtcccagttaccattgctgtataacaaaccatcgcaaatcttaatagcataaaacttttttatttggctcacagattgtgggtcatgaatttatgtaagcatagtggggatgatttgtctttgcttcctgctatctggggcccagctgatgacagtcaacatctggagtaactcagtgtctggtaggtattggagttgtcttcagttataggtctcgtagttggtgttgcctgctaagtcctcagctagaactgctaactggagcatcaatacaagcagcttcttgatgtggcttgggcctccttacaaaatggtggtctcagagttgtcagacctattacatgggggctcaggggtccaaaaacgaaggttgcagaggacaaggtaggagccacatggccttttattccctagccttgcaagtcccatagtgttcctcctgtcaaattctattggttaaagcagccacagatccatccaggtacaagaggaggggacataaaccctcctttcattgggatagtgccatagtcactttaaaagagcatctgggaaggagctattattgtggccatctttggaaaatccaagctgctgcagactgagtttagttttgaatcacaggctctttcttcagttagatgccagatgaagcaggtggcttgttcttgagagcctgttgtaggaaaaatatgcatctctgtgccctcggaagactagtggctcattctgaaaagcagatgggaactgagacagactgagggagctgtgggttcccaccacccatcttgccctacttcaggggacacactcactcagttaaacggcagatggacatgtggctaccacccacctttaagctgctgtgagtgcgttctggctttcctggtgactgagaaaaatgcagtacccttagtatcgacatgacgtctatggacacagggagaaaaagaagaaatcagaaggcccatgtgacacctggctctgccagctttatggaaacagaccgcaagctgatctctcagggagtggtctcaagttcaggccccctgctttctcctggcttgcatcagatcatatcactattctcatattgattctaggccactgggtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggcatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtgcatggtattatgcagtccatgcctgtctctgaccatgaattttatttttcttttttacatttcaaattagattaaaaccccaaaagctatttattaatttgttcctatttaaaatttaaacacaaaatgaaatggaatgtgctgaattttgttcgaatccttataagtacatgtgatgacttttgaaagaattgaatttcatggattttaaggagatctaaagaatgatggaagtgtttttgacagctctgaattgttactttgttagtcagagttgaagacttggaagtcttcaaatctcatacttggttcaaacatttcattaccacctaccaaggctttattatctctcataaaggaagtggattatcactgatcacagaaacaacaggtcatgttaattctactgcatctttcaacccctcttctactggatgtttttgaataacagccacatggaagtgaaacagactgataagacttcctccctcctcttgctcccatgcatacattaccagcagtgcaataacgaggaagctggaaaagaacttgaatgacccacaaaatgcccattacccttgaataataataaataaaaaacttggttatatttgtttggaagtgagagatttgcatatttcacaacagactcaattttgatgaggcggaatattgtagaggtgtgtggattctgcttttcctattactggtatgcagccccttagcctaaaccagtaatttccattggattgggaatcacatagcctgggttcaaatcttggctccatcgtttggacaaaccactgaaatccagtttcatcttttgtgtaataacatatgagcactggaataattttgagaagtagacagtgtagtatatacacagtgcttctttagtgccaagagcacgtatctagaatttgctatattccagacccatgtttttaactcatttaatcctcataacagctctataaagtagatgctgttgctgcaacattttccaggtagggtgtagcacctgggccaagtctgtgaacctcccggttacttctctttccctttccctttaggaacatgattttctgcctatgtcatgggccaggttaggttcaaatggtagctaaggtaactaactcccatctttaacattatctgattcactagtccttgaaagtatggcaaggatgcattttggtgatgtttcatataattctaaaggtgagagtcaatccttttagttgtgtttagataaaaagatacctgatcattttcttcagaaatcagcccattgagaagttgttatttattttttcttattagagttaatttttattattggatttgagaaaccaggtgctttattgggagggcagggcaggtaagtaaataatgcaggctgatttgttacagtagagggtggtggggagtgtagcaaagatagtagctgtcttctaattctttgctactgcatgcctcaatggagtacaagcttataatgatgagaatcacctggatggcttgtcaaaggatcgattaattgatcctattcccagagtttcaggttcagggggtctagaaatgtgcatttctaacaagctcccagggaatgctgagtgctagcccaggaaccacattttgagagccactgccctacaggaatgtggaactagcactgccaggtttttcaatatttcaagagaattcctctattacttgaggattatggctttttcaaggtattttttggttctccagacatttcactactaaaaaccactcagatcatacaatgattaggcaagaaatattaggaaagaacattaagtcaatctcttgcatattttaaatctattctttaagtattggcaatgtatttaaaagtttttaaaagactgtgtcggccaccactgagccaaaataaacatgtctgttagctcaattcagtttggaaattagcagtttgcaacctctgccttaaatgccaggaagaaataatggatgaaaataaaagaattatgttttttgaatttttctgcatttaaaaatttttgaaaaacactggccaaatatttttaaagctagcccagaagctagtccagaaatgtgctttccttttataacctaaaaggcagatccataaactgttagaattaacagattgttccctcggttaagcatgcagagcctgtctgttatggtcactgaatcagcctatcagctggtggcaggcatggtttgtgtgaatgatcctagcaggacagtgcttctgtgcatattgtacatattgtccctgtggtacattgcagatatttttcctcttcacctacatccaacttaccttctttcctggtctcaccttactctttgtttttagctttctttgcaccttttaccacttccatttgctttgtgaacacttctgtctgtctttaaaggcagtaaagactagtaatcataataacagcaaatattttttgactgcttatgctctgccaggtactgttttaggctattaacaaatttaatattcataacaatcccacaaggtagaaaatagtactatccccatttaaaagacaaggtaaggcacagagaggttatgtaacttgtctgagatcacacagctaataacaggcagaggccgaacttgaacctagggtatctggcagcaggacccaagcccacaaccactagactacctctgcaataagaagcctctgctttcagctcccttttttttcctacagaacctggctggacatgtggggatgcttagcacatagcagcacataatgctatggaaacagtcatttccactttccttctatattcaagtggtatgtctggcttatcaaacatttgtcgcaataaaaatatgactgtatgcaggctgagacaaagattactgctctttgaaatttctggagttgcctgatgacactcatgtaggatttagttgatcaaaagctttacttgatttggcctttgaaaaataatcattttggtcaatagcagagcatgtactcaacaaaaagtttcaggcatcactgcatttagaacccagtagaccagcactgttcaacagaaatatgctaacaacaaatgcaagttacacatgtaactttaaattttctagcagccaaattttttttttttttttttttttttttttttttttgagacggagtctctctctgtctcccaggccggagtgcagtggcgtgatctcggctcactgcaacctctgcctcccaggttcaggtgattcttctacctcagcctcccgagtagctgggactacaggcgcgtgccaccatgcccggctatttttttgtatttttagtagagacggggtttcaccatgttagccaggatggtctcgatctcctgacctcatgatccgcccagctcggcctcccaaagtgctgggattacaggcgtgagccacccgcctagccctctagctgccacatttttaaaaagaaacaaatgaagttaattttactaatatacattatgtactgcaatatcaaaaattatttcaacaattaatataaaactattgaaatatttttacatagtaatttcatagttagtcttcaaaatttgatgttaactttcacacttccaacacatctcagtttgaatgagccacatttcaagtgctcaatagctacatgtggctagtggctactgtagtggacagaacagccctggatcaaagagatgtgagaattacagccaagcgacacaggcagagaaccccaaaatgtcaagtgcaaacagacatggagcgagaggcagaaatgattcaagaaagcatcgggacacaattgttttaagggaattgactttcaaggaagataatgggaaaacttggggaaattttgctaattggtagaaattttagttgaaaaaatatgtgtacatatatagtcttcactagtttatttagttgaattaacatttatttgaacctagaaaaagaatcacacatactgtggtagaggatgtcagatgataatgagagagaactttggaattatttgaggacaagagtgattccatttgagtgacttaagcttcttgacctctagaccctggttttctagatcagaaagtcataaattttaaaatcatatttcttctttttttttttttttttcactcaaaaaaagagagtgtgtggctttagttcccatagagcttctggttcagatggtgcaaatgaagcactggctttctcagccttgttttggtagcataggaaaacaaaacaaaacccagagataagagcaagggagactggaggatgtgattatgagtaaaacttctgggtgcataatgtcagcagcacaaactgtgttcattctccatgttagttaatggctaatctagagattgtactgccatttgctgatagagcacagtttaaaatattttatcattaatgtgacagggagtcggataaagaaaatgaagcgtgattataaaatgctaattatcgttctcaagtgcatattgggcactcacaaatatttgcagcgtaatttgctttatttattatttcagtttggttataaatgttaattcaattgcagatggtatgttggcaatttacagagctataaagttatttggaaatcctaatattttctaccaaaatgttccgttagtgaaggatgagctaaattaaaaactcctgctctttagagttaaatacattaattggcaagtaggctgtagggatttccagatctgtgctggctatgttaactccttaaaggagggaaagacatgatttctaatttagagtgggaattttctttatgagaaagggcgaggaggaaagaggtgtctttttcctaccacccttgtaacatttcttcaaggctgaggttttcttcatgtcctggttcatagcaaaagagacatgcttgaagccacattttttctgtagtacatcaatagtttctgagaccgtgatgttgataattagggtgtatgtgtacgtgtgtgcatgtgtgagagagtgagaaagagaccgtgttttctccaacctcgctgattactacaaaatatacatatgttttagccaggggttgtcaaattatggcccataggctaaaccgggtctgctgcctgtttttgtatggccaagagctaagaatttttttttacattttaaatgcttgaaaaaaaaattaatataacatatgaaaattatatgaaattcaatttcagtgtttataaagttttcttggtacacagccaatccattcatttctgtattgtctatgattgctttcattctgtgatggtagagttgagtatttgcagctaagtctctggcccacagcttaaagagtttctatttggccctttatagaaatctgccaacccctggatgaggatatttaaggtgtagtttacaaaatggaagctttaacctattttttttttaacctccattgtcatatttatggaaacacacgaattctggagtacaactgggtttaaaacatgacttttcatttttgaaagctgggaaggttataaatatgagtcttagcttccttcatttatagtcatattaataattgaaagaagtgatattatattactaatgtaaataattttgtgtttcacacacacacgatacactcaaaacactctctttgcctccaaaataaggataaaagtaaaaattattttcttttactgtcaaattaaaaacataaactaagctgtgttcctggaatattctatttgtgttaacaattaggaattgtacatagaagcacagtaatatcagaaaatgtggccaccttatataactcgtttggaaaaatgtcattctttactaagaaatactgtgcttaattaattcttgctcctaggaggtcaacttggggcactcattatggccttaattggtgatataaatcctcagaccccagaggaaaaacacattgagtggttagtggtctctggccttttgggtgagtgtgcactggtgccagcctcatctcagagagtgacagcttctggtttcatggcttcaggtctagccccactcatattaggtttaaaggccaatgtgcaacagcaaataaatgcaataacttgtcctggtgttttgcattaaacagtgtgagacaacccactaccttcagacttggaaaaatgtgtttctgtgaactccggttctttgtattaaattatattcattacacggcccatctggagtctcctgccaggccaaaaatcatcttacagacattagcaaaaggaagttaaatgtaattttttttaattgtatacttttcatttccatttattttttcccttttattggagaaagcagatggaaaggaaagcaggatcctctctcactctggttcccttcgggaacagaggcagagcattcctggctgctgctcctctcacacgttggcttgaggtgatgatggggctgtctagattctggggataattgctggaaaggtcaggagttcaatttgaagctcacactggttggggttgtggagtttggagggtaagaacagtgcagtggcttacattgggctttcactgaagtgggttgccacgaattatatttgacagtgtggaaatgaaactcacaaatatcagatatgatgcagttccattttgtgtctggttattgacttgagtattttgctgggagttgtctttttgctggattttgagtcaatgcaaaaagggcccatatttgggagactgggctttctttagctcgttggatcttaccaaaccagccatgtgtcacaaaaggtatagagctaaggcttatgttggagacatgctgagtgtgtgttcctttaataagacacgtggaaatctcaaatatcagtgctagaaggcatgtagagatcatttcagacttgtgaaatggaactacagaaatggttcaactgtttgctcagagtacaaagccagttaaaggaagaaagtagactagcttagagccctttggacttctacttgggtagaggtagaagtcacttcagccatcctacagccctggcagaggatatttggccaacgaagtcactctcccatgcaaccttccacccatccatgtgagcaaatacttactgaatgccaggcaaggtgctggatttggtgctgaggatacaaaaagctagagttatgacaggtcttcaacttaataaactacatcagaacaattctatagtcattatctgtatataccctaccatcatctgccacttcacccaaatgaattgctaagttgctgagtttggaagggtcttttaaattcggataatggtgaggtacttttttggctacattctgatatatccagcacatatatgcatttcctgatgatggtcttcacggacaatgggagaagggctaattttgaatttctaataatgaatccttgtatccctctgtataattttatttcaatcaggttccaatcacagattattgattttattatctaagtatattcttcttactctaaatatttttcttagattaggacaaggtttggattaggtcaagtatacctatgatgacctctgatttacattgctttacaacacacctgagacttggagaggagagagaggagggatgctggactagttcccctgctcagtcacacactttctctccttttgtgctgggatggtgatgtgaggtgtctggtgtccctgacgcagtcagctaacagcttccttaagaagcctggccctgtgctaccctcagtggcgtttgacacagtaatagacacacattacagacgtaaatagcaactccaggttttcgcttccatggaagtgtgttaaagttatgtccactaaatgggttactttggctttaaataatagaccccattgcttctctgttcctcagcgtgcgatgtggtttcacctaccactctctgctttcaacaaagcagataaggtatcaacacaattaaaagtgaaaaataatctgtctgctttgccggtagtgaatgcttacagaacacacactgatacaatagattttaaataatttatgtccggcacttttttttttttttcaatctgtaaatgaggacacctaatgcggaatggtcggcatgatactctatccttcccccattaagataacaagatgagaggcaatgattcagatcagtatatttttggagctttgagcggataaaaattaaaaattaaaagagatgatgttctgaaatactttgggtaagcaagctcataaaagccatttggaaacctgaaattacacattaattcagaatctccttctgaggggctcctaaaacacctttctgttttcttggcaggatgaaagcattacttttgtgtcactgcctggtgttttcacagggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccaatctggagggatttattcagctgctataactactgttgacagtatggggaattggccccacaattccccaaagtctagggactgtgctatcccacagaaacaaaactgctaagctgttaacaagaggtggttcagatctttggtggttaaatgtagtttaatcatgatttacgggggcccggctctttttcctacacctgcctgtgaacatctcctaattattcatttgagaaaactctgaataaaaatatcaatcttgaatatgtgtgtgttccgaggaagaaggccagccatgtccaaggaaatgttcagtcctgtttcatctaaggaaaataattcccaaatttcatccacaggctgatgcttaggagagactgaagtgcttttggatgagttcaaaataaacactccctcctaagttatctcttttgtccttctggagaaaatgagaagggtaaatgacgttccatggaatgatcacctgaggaaagcaaaattaggctgaaacacccccaaagctcctagatgaggcttcctggcctgggggcagggtctgacaccccatcttttggagtgggttatagcatcagggaccaccatccgttaacaagcccatcctgggcagcagaaagctttgtgggccagatgggaagtagccactgaggagaaaaatgtaattttgatacaggaaatagaagaagaacagtacagcttttcactcaagatatatgtttcttctgtctaaagccagcaattttggaaaatgaagctaagagtttaaaaataagggctctgtcagggaaaataaaacaggtccccctacatccattaggctgcctttaattgaaaactggagaacaatctaactaattggcaggtacctcttttattacggagactgtttttccccttctctccagtgtaatcaaaaggctgctcctctttttatcaactaaagtcaggtatgaaatggaaaagcagagaggtaacacttaaaaaattaattgtgtgtgttctgttaaatgttctcctacaaaacaacttcagaaagtgcacagcttaaggtctttgaaacagcagcagctccaggagtgtattttcatatagcatggtgcttaggtggaagctataatgtgctaattgcagacaagttcatgttgtttaaaagaactttttcttttgcattggggacctatttaatttcaaatcttggcactgtgctgacataatatagctactttaattttaaggatcaagaaagaggagcctgtgggtgaaatttgagcctattttttgctaatttggaataaatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtagagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatccattttgagagctggagcttaagtaatattttctcaataaacttagtgagatttttgcactgtcagagcagtgtctgtggtgaagagaagcagaaggctacatccaataaatccctgttatttttcagttgtcagacttgacttaaatgtaaatgcctgactagctttccttctcccattctcatagactctatgagtttttcctttttactccaggttcaggatggaaccatgtataagcgagaaaaattccagtgagaagattccaacatggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatcgccatggtgatgtgccttgccgtcaaccagcatgttatggtagagccatgttctggttttgttaatggccaaatgttgcataccaaacttctaaaagagattttaaaattcatgctctttggtaaagggtttcagtatatttgagcatgttttggctctctctccttctgcttacctttttctcccccgcttctcagtacagatgagaaaatttaatttgggtccagatgagatttagtaattaatgtacaaagcagctggggtccgctaactcctgggctgtagctgagcagctattttgttgcatttttttttcaataaaataattgaaaatttaaaaacttaaaattcattggcttcttgccgtgttatacttagagtaatcctgataatagatcggtaactatggatttcaccaaggaagggcacaaaataactgacctaagtaatttagaaaacagatgtctttagttggttcaaattctcagaaccagatttaaagaaagcatgtggagaagagcgaaatcttgcattttagaggcttcgtttccccttgtcatacagtttttcttcctaccacatcttaattcaaactcttgagaagagacaaagtagtccgcaagatatcatatttatgatatttagcctactgcacagaaattctttgggtaactactcaacctcatactcttcaccttctttttaagtcacctttatttcagtggcttccaagtagtggtcagagacacctaggggatttataatgaactttaagatatcctcttgaaaccgtgcgtagatatgtgtgctgtttcgaaggaaattttatctagtttcaaagaagttctttgtgttcttttggcttctcccactccccctgcacccccacccccaagtcccttttacactacaaaaataaagcccagtagtaaaacataaaacccctcctgtaaggtttttctttctagcttttactcaggtcgtggaatttctcagaggcatcccaaggggatcctgtgggagaatgagtgtgattacagtgaactacttaattctgtctgatctacagtctttaaacataaggtcaaccagaagagaagagagactatccgagactatccaagactgccacgtcctcataaaggaaaaagagattgaacacttttgctgtagatggtattctgtagcctggactgactacataatttgcaggactttatacaaaatgaaaatgcttgtctcttattcaaaaattatttagggctgggcgtgcgtggtacctcatgcctgtaatcccaacactgtgggagaccgaggcaggcaaatcgttcgaggccaggagttcaagtccatcctggccaacatggtgaaaccctgtgtctactaaaattacaaaaattagccaggcgtggtggcaggtgcctgtgatcctagctactcggaaggctgaggcacaagaatcgctggaacccaagaagcggaggttgtagtgagccaagaatgcaccgctgtactccagcctgggcaacaaagtgagactctgtctcaaaaaaaaaaaaaaattataaaattattttgaattttaagacagtgacagcagagcagtaaactaagctctgggcccttctagatgcaaggccctgtgggactgcacagtcacatgccctgcccagaacacagctcttcactttttgaagacagtttagcagtgtttacttgccttatgaaacttgctccctgaaaattttgttttgagataattggtcacaaaacctggtggacttgttgcctaccaattaaagtggggttttgataatcagacctatatgatacctggtcatttaagaagtatggtatccaaggtcatgttttggaaatagaaaaagatatattttcacctaaattaaaggacattttatccaactgagtaatctctccttactattggtttccagtttacgttacctagtaacatttcttccctggctcatgttcctctaaaataaagaacattgtgaactgaatacattggcttcacgcccttcctgggacatcatagactttggaagtttagaccttgatgtctgatgatgtgagttcaggttctgagttaagaacatgggccacctttttgttggtattctcagggagttttaattaattggggattaaaaggattgagagctgtggtctctgggtctaacagaggttcagctctcaaggattcacctgacaaaatccaggaaaatgctgtaatcatattcttctcgaaagattagctttacagtgatgatgttttgctaaacctgtaatctctgccttctttagaaccatttttctacgcatattttcaaaattcaggctttcttttctaatagtaagtgtgccgaggaagcttctagaccaagggaattgaaaggagacttttaggcctaaaacacatggtcagattctcagtgaaagaccagaagataccctccaagttagcaggcaagaggtgctatagactaacagatcttatagaagccatggctacacctttactaagtccccagcactgggaccatgtcctgatggggatttattaccttttttttttttttttaaacaaaaataaacaactctcagcttttgcccttgagacaactcagctttcttgtttggagtatggatttgtggtctttttcttttttgtgtcctggagtttggccccatctaacttgacttgttcaatgttcttttcattacatttatgcccaccctccctgcctagaaggaaactcactgtcatcaaaataatagggtgtttttctactttctccctccctctcacccattgtctttcagtggggtgaaaaggtcttcacttttctctttctccccccaaattttgctatgaataacttctcagacgttgtcacgcatagacttccactctctccagagggtgttttttgtttgtttaaggcaacgtgtttcctggtttaaaaaccatgtttcccagagtagctgtgatgggattattccacactcacctcctactggcagcatttactactggctggaaatgagcattattggcagctctctgctggcctggggtcacactgcacagagctccagccttgctgcatggctgaatgactacctgggctggtcatttggttacttttttattcagatgaggttagagtcttttagtgagtgaggaaaatatgactaagtaatgcttttccttcttttgctctagaaggagaaattatccttttgaactttgcatgggatagaaattaactctgcaacagcccagttcacatagatgtactttccacaccactttttgggtggattcccctgatccaatgctttttacaactaaatatagtgccaaattgcctttaaaaattttttaaaaagccttaattcctttcttcaaacaatcatgacacattccacacatgttaaacctgatatcaatggctctaaggctaaaaaataacttccattcaaaacaccacagtatgaattctcacaagcaaatgtatgattaaatatgagtcagcagattgcactgttactttagaaagcaaggattcttgggctacattcctgcctagacccaagggcaggctcaggggattaggtatttgtattgatacccagagctcaatatctacttcagatagatgcatgacgaagtcaatgaatcacagcttcctggacaatcttggcagaatataattctgactctagccctctactgcacagaagagtacagtgtctctctagtaaacactttgcatggctttaagatcttccccagtttaaacattagcccccttttccagctgtatcttacgcacacacacacacacacacacacacatgccatcatttacatctctgccagcctggaccactggctgttccctgcactttcttactcctgatctctgttgcttacccataatattcttgggggaaagcctgcctttccaattctactttttccactagagctgagatcaagtgccagttttcctcccttctaactcctttgaattcctaaggcctttatttgctcagtaaatattttatgtgtctgcaatatgtggatcaggcactacagtggatactttttcactgtctgcttccataaaagttcttatcgcactgcttggtggcatcttacatagtgttcacttgacttactgtttcttctgtactgagaaaggacaggaaccacctttgtatgctccaagaaagcttaccacatctactctaattggcatcgagtgaatgtatcaaaaagtgagcaattaaatatagagatggcctttggtatcatgaagttgtccatccccaagagcctatattgtttagaggttggacactgtcctatactatttggggatctttattttaaacatagaatgtgtatgggaaattgttcagaaaaaactgaggaaagaagttttgtcaataacagtagctgctattcactggacgcctgctatgtggccagactgtgctaacactttgcatgcattccctctttggatacacaaagttctctcaggaggtactttgtcatcatttttttacaggtgaggaaattgaggtcttagtataactcacttaaggtcatacagatagtaagtggccgagtcacagttcaaatccacatgtgcctgaactagacaattcaccaggccagtatctaaaccaacagaaatcaccccctgtggaagatagtggagattattgtgtgtgataacatctgaaaattagaaggtgaaacggggttcatgtgtgaagaaaaaaaatctaaagcaatagtttgagggtatcagaggagggaagatggcctaacccaattccatatcaaaatatgcaggagggagggagatgaaccacttttttccatgtcctttcttgatttgtgatttaagatatgtccatcaagaaaattataaattttatgtatttgggtagagaaggatatttaggtgtaaaaaagacagttatcttgccttttgatttttgcttctttctgcactgtagataataggaatgattggaaacagtggtacttcataccctcagggagacagaagtaatctgagtcagatgtgggcattccataattactgctaatacatgaaccaaatggctctaatgcatatatagccttctccaccatgtgagtttttctttttcctttttggttgtacctcagttctttggtaacagcagtcaaagagcatgaggtaggaagattgaaaaatccacggttagaaaatgcttgactcagtgtgtaacacagatctgtctttctgatctcagtaattggtgttcattgtgttaccggcttaactatcataaacaacagaagtcatgactaatcaagccatggttaatcaagaaaagtcataattaaccaacaagaattaggattaagcaacagaattcattattaagcaacaaaactcaagtttgaccaacagaattcgtgattagccagcagaagctatgatgtataacaaaagacatagtcaacgtgcacaagtcacagccaacagaggccctgactgagctgattccaactcagatcagtgggtctgctactaacagctgagaaatctgattgtttaattgcgtaaatacaaatgatatcaccctcaaggaatacatttaagaaactaaggtataatccaagacggttactatggctctggttatagctaggacttcatcaacaattacaattacaattgactaacaattgttagtcaacaattattatttgaatatcttctgtgtgttgggttctgtcccagccctgagctattcagctggtgtgtcccagtacaatttattaggtgttgaaaaattgaaacattttcctgccagtttttgcctgaccgttgccttgggtcttcccttcctccatccaactgtactgtcttagttccaggggtgtcatatttggcactgcctggaggccaccttgagtccaccaacttgtcagctcaggttcctaggaaccagcctttatacctatcctactcccctgtcagggaggcatgagtatcggcaaggaaggtggcacacttgatggcactgagacaccttaatggataaatgcacagtgcctattgggctccctgaggctggggccaccagccacaggttggcattcccccatgtcacctatgtaacctctaaagcagacagtgctattgttttagactttaagtatcatccttgaataggtataacatggaaggaaaagcaaaataccatgattgcctaggagaggaagcatccatgtatgcttagatcagtcagagaaggcttcctggccaagtgacctcatagaattttcctgggtttactgagaaaaggaagttcccagaaaatgaaagagtaccattacggtgtcagcagttccagagttggtagcagaaaaccaggtgttgtttttttgtttgtttgtttgctttttgagacggagtttcactcttgttacccaagctggagtgcagtggcacaatctcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatccgcccaccttggcctcccaaagtgctgggattacaggggtgagccaccgcgcctggccgaaaaccaggtcttaagacttctagccacaatctcttgggatagtattgaaacattccaacttcagtccagcacagatacctgcctgaggccctcacagaggtgttacgatgactcagttctaagatgaatataaaagccctcatgatggtgtcctttaagccacaggctggtttccagaagttgctattcttgcccatgcagatagacagtctctctttccttagtctgcaaataccacctcttctttcgccaaaataccacctcttctttcgccaatttctttgcccgcagaaactccccaagtctcactctctaggtacccaactcatcacttcctggtgtgatgacacacttggaatcccagaaatttgtggctggagaggaccttccaagtaaactgcccaatccctcattcaggggaagagagagcttagtcccagatggttgtgacttgctcaagtcctctcagtgaccatgaggagcttgcagcccaggcgttcaactcctaatccagggctcgacctatgctacctccactctctcctctcaggttgctcctccaaatgggactgaattcatcctctgtacacgctcaacttttgaacctcctcttctccagatgtgtctaaccatcccttggcttcaataactgtcccaaactttgtcctgaagtttgggggttctaattttaggtgggaaagatccatggctttaaatcagtcacatagtaagaagcttattttttttctctgaattcctcaaacagaaaatcttgagtcagtgctgatgtgtgtctcatgctggccaagctcccttttcagcaagaagtgaggagggctggggctcctggcctgcagcagacacagtgtccagtatgagtgaaatgacatctgattattgtattatttgcatttctcttatttcatgagtaccttctaatattgacagttggtctggttttccaagtaagccagagataaatggtttccactttaaatagtgtcaaaaatagaaggaggagtcaacctaaattgaaatattagctaagtaaactttaggtgtatgaggataactgcccccaccccctacccgccacacactctgggtcctcaaagcagtggtctacaagggagtgaggtttgtataaactcataatatcaatgaaggaggaggagaatttttatgatgcaaacctctattcggcttggagggcacgtctgtttactcaacccacgtataaaaatacctcatagcatatattttagccagcaagtattctagcatggtggaaatgatttactgaaacttagaccttctcctgaaatccagccaaaaatctgatttggaaaaccaagaagtcctatttagtttctgccatcattgttactgaatcacactgactgggcaattagtgacataaagttctttaattctctggtcttctttcatttgagcatcgtgagattgttcttctctcctttctggtcactgactaagtgtttgctgaactaaaaatttggtttttaataaaataaatggagggggtcacctttgtccatacctcattttcttcccacgtatataaaagaccatgttttccattgtgttaatgtttctcggcagaagagcgatggaggtttctgtaaactgagtttctacatctggcagcagaaagtggcccacagttatattttttgtagggaaagatatgttttcagatgaccactctgcacagattctgggaggatttcacagtatttgtaacctgttattttagattctaagcacatttgtagttccagtggcacaaaaataaactgtgttttcttggaaaatgtgtgtgtctgggatatgtgacaggacttgcaaccttaaacaagatttccaggcacttatagttgaaccatgccagtaaaaatatgcttatttagacattaaaatcctagggtgcccacgtaagtatcctaagcaatgtgtgttacatgagcattctttgctaatgtgctttagctttgaacgttcttagctctggctcctgcagtgttaatgtactgcagggaaagttgaactcagatggtggggcttagtttctgttcaacacatttgatgatgtgtttcttacattcaagagagtagtttctcgtgtaggtataagtcacatcacaactggtaaagtagacttcctcactcttaatactcatagcaatgtggaagtttttcttgggcattcagaagagagaaaaggcagcaggtatacccttcatctgtgtattcggcaagcatcacttgatcatccattgtctgcaaagctgtatgtagaaacggggaagacaaagaggaagttggggaccctttcttctggagcctgaagtctgctttatttcatcggtgtttcccagaaaatcaggataaattgcttcttttgtcaaaatgtgattttcaaaaagttaaaaagcaaaaaactctttcaagtgtttgtttagtaaacacatgccaaaaatttatttaactcattgatgaagggaatagtaggatgacaaagctggtttaaaggaggatatgagaaagatattcaggtagatagaaaacgagagagaaaggagggaaggaaaagagaataccggaataagattgcaaagctagatacaaaatggttcatttcctacagggcaataaaacaataatatttggggttattgttcatctggtcagaaatgttttgcacctacactagacaaaaattatgtgtaatttaccaattttctacagtctgtatagaatctgggtccaatcaatagtaaaaagtaagtcaaacaaagttatatttcctgtgagtgttagatgacacttcgatgggcttgtcagtcagtgctgtagtacattactacccggtaacgctttctgcaatgatgaaaatattttgtatatgtggtgtttaatatggtagctatgggccagatgtggctcttcagcatttgaaatgtagctaatgtaactaaagaactgaattcttaattttatttacttttcattaattttgatttaagtagcctcatgtgactaatagctaccatgttggacgacatagctctaacatgccattaaatgggcagacactcatttttatttcttgtttccaattttggataatttttttaaattgtattttaaatgttgtgagaggagctatgtaaaagaactcagagaagactcctttgaaaaaactaactcttgcattaggcaaataatttctttttctttcttttcttggttttttttttttttttttttttttttggttgttgttgttgttgagacagagtctcactctgtcacccagactggagtgcggtggcacaatctcagctcactgcaacctctgcctcccaggttcacgcaattctcctgcctcagcctcccaaggctgggattacaggcacgcacaactgtgcctgctaatttttgtattttttagtagagacagggtttcaccatgttagccaggctggtctcaaactccttacctcaaatgatcctcctgcctcagcctcccaaagtgctgggattacaggagtgagccactgcacccagccagtaatttcttttattgggtaaaaatcctcatatattggttttcttggtagtgcgctcatctgaaattgttctcgtcagcaagggagccagttatgaagctaagcctgtttggagggaacccaactctggtgttttccaagtaaatcagcttggaattaactttcctttagcaagataataatggtcatgtctagttttgattaaaaggggcttttgggtttgcaacaaaggaagaaactattgatatctcacgaggattttaaggtttatgtaagttaacttttctgctgccatcacttcgttactcaaaaagagcaattaatgcattgataaggttggctttgatttctgatgaagctcatttgctttactgagttttttcatcttcttgcttgcttgcagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatgtaagtggagtctcaaaaaactttttccctgttttccttatctctgtgatttgctcaccttccacagtcatgtggaattcacacacgacactaacgaaatcttgccaagggtaggtgtgaatagagatgacatgaaaatggggattgatatggagattttgagatgaaacttgagtgacagttggtggaaaggcaggagttaggcgtcgtggatgtcagatttgtattccaaagcagtggctaactcactgtggatcccagagccattagcagtaactcaagcatattacacagtcacacggtgactccatttcccctatcttgacaatgggtataaggatcttcgcctgtatcggtgaggataagataaaatgataggcatgaatgttaacagtagtcataatttgcccttttttaggagggaaggattgtataacttgtggaagaaacatttcaaaatctgggacactggcatttttccaaacttgatttcgtttttcttctccaagccatcttttccaaacaataatgcactttattagtgcaaaagatattttaaaaatacattaaaaattggctactggtccataaatatctgatgatggggatttgaaatataccggctttagtataaaaagagtatgtgtacactgcaacaaatttcgctctttctctatttgatgtgtacaaatgtagggaataagaaagtattaggtggatggcttggctcaagcaggcatagggaggtcatggggctatgtgcccagtgatgctcttgtggggctgctgctctttctgtcactccatcatggggggattttggtgatggcgtgctgtgcacatgtgagcagtgggctgggtgctgcgtggggaccctagagatacctgagacatggctgctgccctccaggagcataggataaagagccaggcaccccaatcatgatcctctaatggagttggaggaattacattatgaatcaagggctcttagatgttggaactgggaaacgtgacccttgggtgaaaactgattgaagaggtaaagcccctgtagccaaccagaggcattactctgagggtgctcagctgggaatcttgccctctgctgggagctattgctcagggattgtagcagatgtttgttggtagcccacccagatatctttcctaactgtactcctgccccttcacctttcctaactgtactcagattttagttttcttttataccccttaggtttcaatgtttcagagaaagcttcacagctgggatccactcagtcaattaaagccaatcagtgtattttatgttccagccgcatgcgtgaacatgtaacctaggctggttcaatgagagggaattcaagactcgtgcgtagaatatcaggacaggagtacccttccctccatccatgtgaacaaggaaacaggtagccacaagtacccctggtggccatcctccaatccccagggaagtcagctgtaggacaaagcatgcactgtagatggaaaagtggaaagacagaaatcaagcccttaatagcaccattgaattactgaaccagccaaccctatgaaaccactgcctccaggtcgttttgttatatctgccaagaagaacccattacagcttttggaatgagtgtcttgttaatatttagagtcctcatgaatgagaatggactgggtcatcagacaggaaagcatcctgcatgtgccattccttctgggaagctctttttcctctggacaattccatctgcagatcatgggtcacttggccacatttcatccagttcctttccctctctccaaattttagagccattgagttactcaaaatccatacatttgaagataggaagctaacattcaattggctcaggctctaaatccttccactgaagagaaaagcaggataacctgaaatagccagattattcctatgtgtgagattcacgggatgatcaccttctgctctagttttggtctgatgttctgtagacatggatggcacacagcatttctgtgggagaatttcagttcaggctgaaattataaatgagtaagccagatgtggactcagggaaaatcagtacttttgcattattttgtgtgggctggagacccatttcctgcttacattacttaaaacccatatcctgctgctctgtaaaaactggcagcttggttggcaattaaaaaaaataatgtttacacccacaggaaaactccagcatcagccctcaaggagcttatcaccttaattagatttaaaaatatagaaatgggaagaaaatgggatcattatgtccaagtacacaaaaataaatgtatttttgttagaaggaaattgaagggaaagaaataaacacttggaatgtagagattgagagtctaattggatatttttaaagttgaaacagaaggaagcaggcaaatatgagaatcagtaaccaattataccacagtatacgcaactgaaatgaaaccaagaataatagatactcatagaatgttagaagtgaaaagggatcttagagattgattttcactcacctctctcatttgacgtacaagtacactaggactcagaaagatgacacggttctcccagcagtcccaactggctgaagacataaccaagactacagtgaaatcggccacctctcctccccatgccttctctgcagtagcgagattagcaagattcacattccattctagccataggacatgtcagttcatctgtatgtgtcagaatcctttagatgagagtgacagaaaacccagctcaaactggcttaagctacacaactctacgcatgtcactgaacagtccagagtaatatgctggatccaaaggcacatgtttgtttttggggcattgtttctctttgtctctcacagctgatttttgctgtgctggcttcattcccaggaagattttccccatgtctaacaaagaagggcaccaacagctccagactgttaatctattgacccagcaaaaagagagactattagatcccgattgttccatcaaagcctagggacagattctcattggcctaacttgggtcatgtgcccttctgtgaacgcattgctttgagcagggcattgctttgggcaggggatagaatattgtgattagccaggtctggatcatgtgtcaatatctacagcccaggattgaggttgacttcacccaaaccatgtgggtggggagtgtggaagaaaatgttcctcagaggggaatcagaaagacaggaggcaaaaatgacctcatgtccaccatgatttgtcaggtcccacagtgctgttcccaaggcactcttctttatgctgtgggagaaaaaaagaaggataaaactgagaaaatttaagaatcattatagtaatagctaactggacagggtattttctatgtgccaagtattacattaaccactttttttttttttttttttgtgtcacccaggctggagtgcagtggcgtgatctcagctccctgcaacctccacctcctgggttcaagcgatactcctgcctaagcctcccaagtagctggcattataggcgcctgccaccacgcccggctaatttttgtatctttagtagagatggcgtttcatcaagttggccaggctattcatcatgttggccaggctggtcttgaactcctgacctcaggtgacccacccacttcagcctcccagagtgctgggattacaggcgtgagccaccgcgcctggcctgcattaaccacttttaatgctttatcccattgatcttcataacaaccctatgagatagattagttacaattcctccttcccaggtcccaccatttttttggcagatgtggaagctgagacacagagacattaatttactcaaggtaacacagttagtaaggggcagtgctgagatttggaaccaggcagtttgatgagaaagtctatattcaaactgaaatatatactgcgtgccataggaagcagcgtttaaaactccgagttcctttttccactctattttattgccagtggttaataaaacaataaccatgctccttgctctatattagagatgtatcccctagaaaatcatgtgcaaatttaatttttatagatcaaatttgattttacatgtgtaaggggatttacaagtaaaagaaatcctttaacgtggcctatcagaacagtatgcttatttcttcattttttttttttttctgttttgtaaatgctgctgggtataccttgtattttccaagggcttataggactagggaagcctttttgcagagaaacagctgtctgtcaaagcatagaataatggcaagtgaaaaaaaaactcgatttttagcagcattctaaagaggtggtacaatagtttatgaagaattggagaaggaggcaaaggaagcaaactgactcgaatgatgaacttctgctggtggcgtgggaggtttgtaatgatgtcagaagaggaaagcatgtggcaaagccctgaaataaaaacaattaatgaaaaagagaaacaataaatgaaggcataacatttggattatgaaagaaatgtccagacaagcttacggtatagataatagctaatggtccatgatgggaaagaagatttaagatgatactgtttagaaaccatgggagtaaagccctagaaagcctgatcatatgcatttaagtcagttacagaaattcaaatgaatagttcagatctttaagccaaaggtcagcaaaccattttttaaaagaaccagctcttcaggcatggtagcgcgctcctataatcccagctactcaggaggccaaggcaggagaatcgcttgaacttgggaggcggaggttgcaatgagccgagatcgcaccattgcactccagcctgggcgacagggtgagactccatctcaaaaaaaaaaaaaaaaaaaaaacccagctcttttttaaaagatgttagaaattttagaaaatatttttgaggccctgtgcagtagctcacacttgcaatcccagcaatttgtgagaaggagatgggaggatctcttgagcccagtagtttgagaccagcctgggcaacgtggcaagaccccaactctacaaaatttttttaaaaattagctgagagtgatggtgtggacctgtggtcccagctactcagctaatcgggaggctgaggaaggaggatcacttgagcctgggaggttgaggctgcaatgagccattttcatgccacttcactccagcctgggcaacagagcaagaccctgtctcacaaaaaaagaaaatatttgtccctgtcttcattacttaactctgccattatagcgcaaaagtagccatggaaaatataaacaaacaagtgtggttatgttccagtaaatctttatttacaaaagcagatgaagggctaggtttggcccacaggccatggtttgccaatgtctgctttaagtggctcatccggtggccaaggatgccacttagggctgctctgtgatcccatcccatgcttctcccctaccagtagacacacccagcttccagccacactacaccatgctgacttatgagccgtatgtctccatttttctgaggatttacctccttctccatcagttgaaccccaggagcctgatgaaatgtcatttcctctttgaagcctcccctaagcctcattccacactctaggcagaattattcattcttccctccccaaccctgttttctcacagtgcttcgcacaaagctccatgaaccgcaaacttattatattatacagatagtatgattcttcacacaccagtgagtctccctggctggattataaactcttaaaaggcatgcatcatgtctttctcaccttgtagcccctgaatatagcatgaagctttgctcggtgaagttagattgatcaaggggttaaatgtgaccagttttaaaggcaaacccatcttctccctggctttactttctgaaaagttgtcagaggcaaaacaattctaggtgtgtattcaaatcgcagtcattcgtttatctgctaggggcccagaacaagttactcaacttcttggaggctgtgttttctacctggatgagagaaacattggtattgactaacagcccaggcgtgacatgagaattgatgcttttaatcctgtttagacagcagtgtttccataagctgcttcctcttcccagttccctcccccagaagacattagatcttctagggcttttgccagtgaaaaaggctgagctgagcaggtgtcttggggagttgtgcatgacagaagcccagttaagagggagaagcaaagatggacatgtattggggtttggaccttacttttgccaaaccttagctatcaaagaagggggtccagggataggggagacactggggtcaggaggtcagaaggaaaatggaagacaagaagtaggccagaattatgactcgggtgctgtgaggaagggagagtagtataccctggatgcccctgaggttaggctaggttcccatgggtcattggcctcctccaagactgggtgcccctaccctgtgtctgtaacagaaacaccatggaaggtactgttgctgccaccccctcattccagctcctttctttctgaaaaccactggccgtgaattcacacagggagcctctttgtattgctctttgaggttatgtttatgtgcccatgcccttgagtgatgggcaaaacatgtctttgattttgtttgagaatgctttttaatgtttatttcacagcatttttttcctatgacagtttcataagtgtatttgtagaatagagcaattgaataatctctgaatttaaaagtccctaagcactcattgacaccttctcatttggggcatattgagcttaaaaacagcttttcataaagtctctaaattccaatttatactttagacatgaacgtccccatgggtcgattggatggaatgaatgtgctttgtatggacacttagatacttctgtgggaggattttgttgctctgtgtttctctcatttcccctttactgttaaacttagattaaaacaaaccttttggactaaaggcacttaacctcagttagaatcacctttgcttgtgcacaaattatattgatgtgctcattggttctactgctggattttactggcttaataacagggaaattcatattgtaggttgcactgtgtagttgggaaattacataaaaatcatcatcagggcacttaatgtctttctaattttagtttatttcttcatttgttcccgtgttagatcccagcctgttactttgcttccagggttcactgtgatcattttgttctgttcaccagaaactaccattaacccccaccttctcttcttgctctgtggcacacaaatccctgaagagccccccaaaagtaagtgaaaggctggaaacttcctacttttatacctaaaaatgtcctagaagctggaaaataaaaatctgctgcccctttctacttgccaaatatgaatatttgcctgcatctgtttaggagatttaaaaaaaaaaaaaattatgtttgggtaccagcagcccggtgatgtcagtgccactgtgggactcaaagcccattaacactcagactgaaaaggaagtattaaaattccttcagctttactaatatatttctccccactgcctgtctcctggagaggggacactcagtacattctcaccttagaaaaatgagaaatttccattacacaatagaacagcacaggggaaagaacaaagggctttgaagttagcctgagctgaggtcaaatgcagccctcgcctctagctatctcaacttgggcacatggcaaaattttgcttcacgtgaaatgaactaacccattgcgtggagattatcacagaaatgttgcaggattgttttgtggattggactcatggggtaatgcatttagcaccgtgcttggcacatagtaagtgccgaatgagagtggttgtctgctactgcttcttttggtgacacagtttggttgccgctgttgctgctgccacagctgtgttttattatagctacagccttgattatacttcaggagaaaagttaaaagtagagactctattcattttgaattgtttagaacaccacagcttagaagtgcagctccaaatattatgtcacagccttaaaaataaagtttgcaagcatggtttctaaaataaatatccacctttcttggctacttaaaccgggagccaggtggctcatttgcccagagatgccgagacatgtgtaatcagagaatgggagagtatcctggtatcctggaacccaactccatggagaaaactgaactggggtgttagaaaggacgcctggcccccttccttcctcagtcagctcaaggtgaggccatcagggtcttccagcagtgctgagcccaagctaaatcgccacagagacaaagttgcccttccccttccccgtcctcccagcagctgcctttctttgctcatctggcaccttccatctctcctctgccttatttgggactctgtggcctgccttcctccagatccgtcatgtcccttctcccaaccaactcctgtccaccctgtggcctcctcagcaagactgcttttgctgttagccacctgagaggaaagctggggaggatatcagtggtgctgtggtagttcatggtcatgaggggctttactaatggcaacagccccaagacttcaggttatcccatgcagcagataggacaggaatcatattctgattcagtttcctgagattgagagagggtaagagacctgcctgaggtcacacagctggtatacacccatgggtcttaattctaattcccagcatcctttcaactaccctttgcttctctaaacaatgaagttcttgcacatatttaaagctacacggttttcagtatcttcacctgtattcgctcccacatcaaatattctataattacaggccgggcacagtggcccacacctgtaatcccagcactttgggaggctgaggtgggtagatcacttgaggtcaggagtttgagaccagcctgggcaacacagtgaaaccctgtctctactaaaaatacaaaaaaattagccgggcatggtggtgagcctctgtaatcccagctactctggaggctgaggcacaagaattacatgaacccaggaggcagaggctgcattgggccaagatcgagccactgcactccagcctgggcaacacagcaagaccctgtctcaaaaaaaaaatctataattatgtggtttgatttaacgtgtatactagtttaatgcagtatttccctaagtgtaaactgcacactgtgatatgaaatataattttagggaatattgaacttggcataagacagtatgaactcatttaatgataaagattttcctttccaatatttattgtctttttattaccaatgagaaaaatctcagtttgatgccaatacagccttaattaatatttcttgaatctctgctaatctgtctttttaacagatggcaacaatccctaggtaggactgaaatgtatttatttcagatgtctgcaaattttcttaaaaggccaggcagtaaatattttagcatctgcagtccatttggtgtttttttgcaactactcaactctactattgcagcttcagagcttcacaattgagcatggctttgttccaataaaactttacaaacacagtcacttgacctgaaaaccctgtttattttttgttttttgttttggtttgtttttttttgagatggcgtcttgctctgttgcccaggctggagtgcagtggcacgatctcggctcactgcaagctccgcctcctgggttcacgccattctcctgcctcagcctcccaagtagctgggactacaggcgcccgccaccacgctcggctaattttttgtatttttagtagggacaggtttcaccgtgttagccaggatggtctcaatctcctgacctcgtgatctgcccacctcagcctcccaaagtgctgggattacaagtgtgagccacagtgcccagccaaccctgtttattttttaccctacctttctatttatggcaaatgacacccctttcccctttatagtagtaatacaaacatttcctctaaattttatttaagaaaaaaaatcaattgagacagaaatcgttaagtgtgtagcagcctgtgaatatgtgcaaaattgtgaaggcagtacttcaaaggactgaagtttgagaaacactggttttatatgttcttgtatcttaggaatagaagcagagtctgcagctgtggcctgagccctctcagagtctctgtagtgcctcagttgctggtcagatcccactgacatgcccctgccttactgcctgccgctaacccttcctcacatgctgaactctgtgcaccacttgaggatgggaaggggggtcttgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaattaatacatggcaggggctaaaaacagtacttagctaagcgttagctcctgttactgttccggtatctgttatgatactgagccatcctggtctctaaagattggtgtattcattcatcagcggtccttagtgattgtacaggacagctaatgctccttccgacccagtggtccctttactcaaaacaagaagtacatgtccttgggactcaaatctacccccacaaagcaaggtgatgggtagatggggccagaagcagtttcagctctgagccaggtgatctgatgttggaattcatggcacttcatcgcttacacaatcaactccaaatgtccaaatgtgttagcatgggcagagagccctgcacagctgccccagcctgtccaacactgatctcttgtcatgtgcccccaaatgtgccacacactagccatcactgaccactcggtgtcctctcatgtgacacagcatccttaggcggtgcctgctgttctctctgcctgcaatgcctttccctccctactcctccttgaagccaccttcttcctaaatgagcaggcatgcgcacatacacgcgacacacttttctaacagcaaggagtgtgtgtgggtcactcttgcctctccatgctatgaagtgttagtggcacctctattgagatgactttcagagtcaaactgttttttgggtggtccaggagcttttggtgtctgtgtgtgtgtataggtgttgagagagggaaaactcatcgcacagaaggtccctcactggctgggggtgcttcaagaacaagtatggagtttggtttttatttatatctttaattgtgagcctagtgccttgtacttaatagatatttctggaatgaattgaaagcaaagggtacggctgggtgcgatggctcatgcctgtaatcccagcactttgggaggtggatcacgaggtcaggagattgagaccatcccagctaacacggtaaaaccctgtctttactaaaaaaaaaaaaaaaaaaaaaaagtagccagatgtggtggcatgcacctgtaatcccagctactcaggaggctaaggcaggagaatcgcttggacctgggaggcggaggttgcagtgagctgagatcgcgccaccgcactccagcctggacaacagacggagactccatctcaaagaagaaagaaagagacagagagggagagagaaagaaggaaagaaaggaaagaaatgaagaaaagaaagaaaagggtacctaaggactggggattctgaatcaggaacttctgtctgatcttccaagagttaagagatttgaacacgtgaacttaaagtgaaatacaagcccaagaaaacattaggtcttattgatatcatgagcccatttttacctttcccattctgcctcctctcccactttgcaccatatgagtgatagcatgttacccctttcatgacatgacatcccaatgctgttttttccatggtggatgtaaacagatgaagcttgtaaataggtcctaacagagatttactttctctcaaaactacacacacacacacacacacacacacacacacacacacacacacatttcatcaaatcgatcatttcttaaggtgcactattattttgtataccactaaaagggaaaacggtgcctattaaaccaagacacactcagattgtaagacaggtggcaatttcagaaagggggagaggaagggagagagggagaaaccagatatctggtttcaaccctgtaagaaaaaaggaagtgccttacattctaaactggaaatattgtatgttttcatcttgagctattttttattctgctttaaatagacattgataaaaccttagtgcccaaagacaatccccagcaaagagagttggctgaataaatatgcaagtgcttctaaaatagctggcagagagccctttgtttggaaacaaatgtctccctaaaaatagcaacctgaaattctcctgcagtccctgtgttctggagcaatgaacatggccctttaagtaccttctcccagtgacagcaattctcaggagagtggctacctaaatcgctcagtaaatccttgcatagagtacagtctggaatttgctcctcctggagtggtatcaaggacttaaactctatctcttctccctctgctatcacaaaatattaactgtcatggttaggttatttctttcatccttctccctttacagctggaaaacaaagagttgagcaattatctgatgaattagattaatgaagacaggcatcttttagtactgggaccaagcaaagcaaacaccctgttttctcaggagaaggaaagtttttgtccaaaatacacacttgattgttccgacacttcattttaccaagcgtaaaatacctccatgattaaaaaaaaaaaatctgctcctttcattttcaaaatgattttaggacacaaatattttattgatattggaaaatgcaactcctccatttttctttgcttgtttttttgggggaaggggattataacgtcagttggtctgacttctaaacaatattttggtttagcaacattgtttaaatcttaaaataaaactgaggaacttaactagtgtttgaaaatggacccatttaggagccagtcatgatatggcccttccaaagggaaagataaaagttgcttctagtaaactctgtggactcaagagatttaaggaggacaggaagagaatcaagtgaaaggtaataagtgaaggagtcccactttatgtcctgaaagtgtccagacacaatgtttgagtagttttaaactgaatggaaacttggatattgtgtccttggactttcagctctcagaaatctgcaaatatgcagtctcagaatgtactcccaccctactctaatggatgcagtgagtgagttatttcaggaagaaaggcatcagggcttcctcctgtctcttggggctgaggaaactcttggagatggccttccccacattcttaaggataataacggtgtccaggtctatggagtgcaaagccccattttgtttttacaaatagtgccttctgtgtggcattgtattccttaaaaatagaattgcatccatcagattgaagtgtggtgctttactccaccagaatggctgacactaaaaggactgacaatagcaaatgtttgtgaaatgtgaagcaactggaactctcatgtgtggcttgtggaagtataaatcaagccaaagtttggaaaactctttggcagtatctcctaaagctaaacataccaatatgactgagtggttatattcctgggaacatactcaatagaaatgagaatatggacccacccaaagacacatacaagaatgttcacagcagatttattgataatagtccaatcctgggggggagggggaacaaacccatatgtctgtcaacagtagaatgtgtaaataaattgtgacatattcaaatcatggaatatgcttagtaataaagaactaacagcatggatgaactcaaatgacattgagtgaaagaacttagaacaagagacaagaaacagtctatattattccatttgtttaaagatttaaaatgagcaaaacttgtctatatgataatgagaagaatggtggttaccctcagaaaggaggtattgactcaaaagagccacatggaatccctgtggggtgctggacattctaaactttaatctgatatgtacatgcaaaactatgtgtgtattttatacctcggtgaaaaggaaaaagattaaaatatggagtagtggaacggccatttcttcctgtgcatagagaaattgtgttatcatcaagaagagtaatacctctcattagaagaatcttccttcctgttaataccttaacatttcttcaggcagtgttttaacatcttggcattttgccttttcctctggtttgagacccttttcacttcagctttgaatgtgtaaggagcaccagaaatgcactatgggccatgatctactcctagttccctgactatggttatctaataccccaaattgcatcaacccacctaactagctttttcttttagggctatgcactccaaattaacaggccagggatttctttacaacttgttatatttgaaaaattattttacccatcagataataaacagctaaaaaaagataatgtaagaattgttattgctaagtgttaaattatcagtagtggcagtatgttccttttagaaatatagtgttcaagatgtgatttatgaacttatgtggattccagtttaataattagctaattattcttttttccataattaaaaaaagcaaggtgctttatattttgattcattcattaaagggaactgggacttcaaatgaataatcaaattgagactggcttagggaagttaacaaaaagttttggctggtacaataggcaacctagttaaaaaaagccatcagagtaatttatttgtgagttctagatttatcaaaggttcatctttatttccttgtctttttttttttttgagacagggtcacactctgtcgtccaggctggagtgcagtgatgcaatcttggctcactgcaatctctgcctcctgggttcaagtgattctcgtgcctcacccacccaagtagctgggattataagcatacacctccacacccaactaatttttgtatttttagcagaaatagggttttgccatgttggccaggctgatctcaaacacctggcctcaagtgatccacacacctcgccctcccaaagtgttgagattacaggtgtgagccactgtgtccagcttccttgtcccttttatttttattttttaaaagtgtttaatatatactgacggcagaaaagaaagcagtaaaaatgacaaattcttccctaatgccagtttgcagagtacgagcaattaatccagcattcgaaatttagacataaagacatacaacttgtggtttcatgagatggtattttaacaagttgattgaaaatatgtaatgtcacttctaaaatatcaaaactaatggggttggttatctctgcaagagcaaatattaggaaaccctcaccctctttatagaaatatatttatctcttgttgctgtcttcaatgaatacaatgaggcttacaaaagtaatgtgaaaaaaatgacaactcaacagtaaaaagataaatagctcaattttaaaatgggcaatggatttgagtagacattccaccaaagaaaatatacaaataactaataaatacatgaaaagatgttcaacatctttagtcatcatggaaatgcaggtcaaaaccatgatgagatgctgcttcacacccattaagagggctgtaataagaaagacgagcaataacaaatgttaggaagatgtacagaaatttggacactcgcacactgctagtgggatcataaatggtacattgccactatgggaaacagtttggcagttcctcaagaacttaaacagagagttattatgggacccattcattttactcctaagtatatactcaagagaaataaaaacatgtatctacacagaaagttgacagaaatgctcatagaagcattattcataatagcaaaaagctgaaacacccaaatatgcattaattgatgaatagacaagtaaaatatgatatatccttacaacagaatatttttcatccataaaaaggaatgaaatattgatatatggtacgacatggatgacctttgaaaatattacgctaagtgaaagaagccagacacaaaaggccccatattctatgagatcatccatacaaaatgtccagaaagggcaaatccatagaaacacaaagtaacttcagagttgctagaagttgtcaagcagtggtgaatggggagggctgctaatggaaatattctggacttagatggtggtgactgtttcacaatttgtgaaatttgtgaatatattaaaaaccactgaataacacattttaaaagggcaaatttatagcatttgaattgtatcttaattttaaaaaaccgatgattttaaaatgttaggttaattgatgtaagggaaaatataaaagtaaaccttggagtcagattcgtatactaagttgtgtatgtgctagatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagacgtcatttaggatgtccttgacatttttcgttgctcttcctcaggacatccctccaggtagttagttattcaatctcatctgttttccaaattgaaataaaaaggcatgcaaaagcaaggcaatccttatgaccttagacccaaaagaaataacgatgggcatgaaattgagagagtacaataaagatggcttcctcaaaacaagagttgactctcctcttcattccatttcaaattctatactttaaaatagttctccttcaaataatgcatttatgggtattgtctatttctgtttgatttgcccttttaaagtagaaatcaactttttattttagaacatttttctctttattaaggtataacttacatatcttaatggcacagacttttaagtgtactgtttagtaagttttgataaatatatgcatccttcaaactacctcctaagatcttagaaggaagcatgggggagctttctggggttggaacattttgtatcttgatttgggtggtggttataattaaggtaaactcttccaatatctgtcaccataggttagctttgcttgttgaacttcacctacacagagtcacagtgtatgctcttttgtgtctagcttctttcattcatcattacctctgtaggattttcccatgttgctgcatatattggttgtttgctccttctgttactgagtagcattctattttatagataggcttttctcatgttgatggacatttgggttgtttctggttagaagctattatgaataacattgccttgaatatcctgtacatgctttgtgggaggcatggccacttatttctcccgggtatagacctaagagtgaaattactcagtcacagggacacgtgtttaattttattaaaagcagttcgttttccaagtggttattctacctgccattttaccctccatcagcagtgtatgggaattccacttgttccacatccttgccataccttgatatttcagtcttttaatttcagagatcctcctgggtctgaagtggtagctcattgtggttttaatgtgcattttcctgatgactaatgatgttccatttctttttaatttaataaaaaatttattaagttagaaagtataaaacaaaattatgcacagtttgatctcatatttgtaacaacacataagatttgaaagataaaacccaaaatgtcaaaagttattgccacgttttttaagcttacctgtatttttatcacttatcattttagtgcacatttgtttgtgtgattaaaaaaaagaaaagctacttttaaaaagcgaattaactcagattattctgagataaaacttcagttttcctgattttctaacactaagtaatgttgggcattgacaatgctttagatagaaatggttgagaaaaattgaggccaatactgtttttgcatttacttctttgtttcccccaagaggatcaaatccattcctaaacatttagaaatcttgatatctgaagataacatccatattcacctcagtgtaaaagaccataatcaggggtcagcctatgagccaaatctggcctgctgcctgtttttatcaataaaattttactggaacagccacatgcattcacttatgtattgtctgctgctgcctccttgctaaacaacagagttgagtagttgtcacagaggccatactgcccacaaaacctaaaatatctactatctggccctttaaggaaaaagttttgccaacccttgccatattcactcttaaaattttctattctaattcaaacactggttataagagtttagttccacgccaaatatatgtgcaatttgtaactgcagccttcatttctatccagttcatagaagctactcagtagttacatgccttaccatcctatctcaacagttcagtagggaccttctgatttcagctctggactgaaaattcttaaactattcctctcccagtctccaaaatctggtcattttaggtacagggaacataaaaagagttggttcctaatacaaatgcaactaactatgaagttatatccttttaaaagcacatatagatgagaatttaaacatccaactgataactctttttttagataaaataagtagcgactgtgaataaatgagcttgcttttcttatctagaaattgcctcagaaggcagttccagaagaggagagagaaaaatgtaagtggtgacactagcgttggaacaggtaaactcaggatgacttttctttgaacagtcatgtatcatataaaacctcactcatttatagccacacatgatatatagtgaaatgctctaacacttaagtccagctcatgacaaacttattacccttcactgaagcctttaataaactaccaaaaaggtatgtaaagcaaattcccttaagccagcatgatgcactggcccattttaaagatggacttcaagcaagaacagtaactgcctctgttttgtcagctgtagcacaaaagtcctcattcctaccctttatacacctaagggagtttgtgacaataaaatatcaagagtatcaaaaagctgtcaaagtgctttgagaaatcaaaatgctttagaaacagaggatataaatgtggttaattttattaactcagagccttcagagcaacctatgtctgggtctcccccatcaggcaaggaaagggcgttacctttctcctgaagtccacatcacccaagacttcctatctacagagcgtgtctccagtgaagagatctttgctatacatgctcttgtcacggtagaacttccccggcctacttagctttcaaactttgcgcatctaaaagatacaaccatctttcttagagttccttcctagatctaattatacaaaaccgggggtgccgcaagcatcacctcccatccaaactcatcacacacgttcctgtttcaagggtgaatcaacatgtgaactttgctgctgcagagagctgacagctgcttctgagttattcctggtgcctctgacagcttctaggatattctgggggaaaaaataagatatgagaatccactggagctttggttctgctggcctgtaattcattaataaatgtggaagagagctgtgcagtaggaaggaatgaatatacagtatccaccttagtctaatgtagaagctgtctattaaaaagcactaggctgagaacccagaatgtgacacctaggggccagccatgcccaactagctgggtggccatgggcaagtcacttaacctctctgggtagtgcacgtctataaaacaagggcattgaggcaataattggtaagatcccttccagacatcacacaatctgagacaatagattgtaacatccctttaattagagtcagtaaaacctcttcattgaaaatcatatttgcttccaggacataattacagtgaaacctaattcgtactgtgctctgctccaaatacagtagagagagagctgttaagtggtttttgaacataatgtgccaagattgacttctcttgctgcttttttctcatatgtcacctttttatatggggatctctgaacatttttgtcatggcgtgctataaaagagtatcatcattttagagatgaaatacctgagacacaaagaggttaattacctcactcaagaaaatatatgaaaacaaaatacttcaagcagaagtggtggagaaaaagaccggtatttgtgatatggaagataattgaagttgtaattatccactttacattttctaagggatctaccatggacatgtagacttaaaaatccatcaaaattgtactttctatgtcccttgccagtaaactgcggttgggaagagagaaactaagagaatggtctaaacaacctttcggtaggcgcagggggcggggcacgttttacgagtaggtggcaatatacacccatcaccctcctctgtataccaaacacagaccgcttgtctctggcttttcaccctcaacattgaagttttctttatttagcagtaaggtttctttattatcccctgaaaatagaagttgcccagggaaaggtggcaggttacatcacttcatggtgcctgagaggaagtaaagtgttgcctgcttgtttgagagcaaatttggaggtgggaggtaaagagaaggaagacatgagggcagtttgcaggaggagcaaagacagagaacactggaaaggcttggcccagactcaattaaggcacagaatttcattctggaagcacagccccgggtaagggggaggtctgcgggtcctcttagagccgtcgggcatctccattcctgtcttgccctcttcaaccacacctgaggtatattttgaaactgtatgttatggccctaggtgcttggcttaaggttctgtccgcagagaaggagacccaggctggttggtctccagtagacactgggtgagggacaaatggacacctgattagaatataatttaaatgttctccagtttgatggtgctgtctagaaagttctgttggtcacaagggctcgtatttgacacaaagaaatgtttgatttggtgacaactatgtgtttattgtaatcccactatgcgttgaaaactggattcggtttttcaacacacagtggaatcacagccaatatgtgcccaaatgtattgagaatatcactggtttccagtaagtttccccaatgttgtcagaagcattatttctttgcatatatggaattgagggatgtcctcccaggggaatggttctctgcccttgtttgtacttgatttctcatctaatgggggtaagaatcacattcttataaatagaaagactttttcaaacacagggtgtgatcattgtctcaaggaagtgtgggtaagttttttggcaaagcgaatgatatgaattatcacctccaggtagtttgattttggcagctgtcatacgaggaaaacaagggagatacggaaattcctttttaaagactcacgaattcaagatttatagaagtaaaatgatttggcaacatcaatggctaattaggggttgtgctggaaatagaacctggctgtactgtttctaaggggagtgcccttattaccatagcatgctattctttggagaggggtttttcaccagctgaactgaataaactacaaattaggattgtctgaaagtgagggacaatgtttaccccacatactttatgtggttccctcaaaaaaggcttaacgaatgttttttgaaaatggtaagcaaatagctttcttcttattttcctatttgaataaagaatcagccctcactcacactttcggagctaaagggggaaaaaataaccataaaacttctgcagcaatttttacaaactttttctcttgttcacaggacctattagtaacattgcattatttttttaaatggaccatttttagcgatagtagaagggagaaatctctcattcccattcctatataaagtacaatttaaaaactgcctctttaaaaagttgtagcattacatcctatgggcaatgcctaaggctgaagcacaatgaattttctgtggggtttcactgctgtgacctcgatatactataggttgttcactgcagctaggaaggaatttgtttaaaaagcgcaagaaattcttgaagtatccaagaagcatttgaaatcagaactgctacctttccctccacacaatgtgtggctgataacaaacatgcactttctgaggaatttgagcttaggtagttaaccgacagttctaatggactccagaagacgtacaaccaaataataatgacctacttttgttaccacggcacccagcataaatgatcattttaaactgcttggaaaatcaaactgttcagaaagtacttttacagtcaaggtcaaggtgtaggccagaaaaataagatgtaaaggataatttaatcagaacctttctccaacagacattagggttagatttgcaaagtaccagcagccccactggaaccaccatcttctccatcttggtagaataaagatgaagctcctaagtaattgagtacaaatcttttttatctcataaaagttaaggactgaaaccagactgacaagctccttcaaaagttttccctttacccttctcttcccccctcccttcctccctccctgcctccctccttcctccctccctccttccttccttctttcttcctcttcctatcctcttctttctgtccctttttcctcccatgtttttatttttcttttttatcattattttttttcatgagatacagtctcgctttgtcacccaggctggagtgcagaggcacaatcttggttcactgcaacctctgcctcctgggttcaagtgagtctcctgcctcagcctcctgagtagctgagattacaggtgctcaccatcacacccagctaatttttgtatatttatagagacagggtttcatcatgttggcccgactggtctcaaactcctgacctcaggtgatccacccccctcagcctcccaaagtgctgggattataggcttgagccaccacgtccagccctttgtatatttttaaaaggtcttcttttctagctcttggaaataaaatcagaaattatactttatgtggaaaatttcagtgtacctcataacattataaagtgttctgacaaagctcttcaaaagtccatatgttcatggtgttaaatagatgaggggaaaatagaacactcaaagatctagctcagaaagaaaattctcagaatgctaggttatcctgttcattttggaggcaacacaagacaggcagaatgaaagtgtggtgtcattttgaggggagaggcagaggacagaaggggcagagagagccggtgtggaaagagtggagataggatgaaggtaggaggtatttatgtgacaccaaatcacccctgcctcccatactcaaaaacaagctccttgaggtcagaaatttcaccttcattgtcttcatagacccccctcagcaaacatagcttcgggctcatgccttcatgaattgactcattcatttattcacatattttctgagcacttactatgtagactttcaacaaccagtatttattgtgtgctgttttagatgaaagtcagcatagactaaagggttcctgatgtcctgaagtttatgttcagggttgggagagggtagacacaggcagataataagcaattttacataaatagaaggtggtcatcactgcttagaactgtgctgtataatgtggtagccatgtaaatataaatatgaagctgagcatcatggaggtaaaggggtctattttatgaaaagtggtcacggatggtctgtctggcaaggtaacatttgggcagggacctaaaggaagtgagcaagtgagcaggcagatatcaaaggaaaagtgttccaggcagagaacagcagttgcaaagctctgagctgtaggctagggggtgagtggtaaacaaaacagacacagtcatggttcatcctcttggcgttttcatttatatggaaggtagacattaatctaggcaacaaagaaatgcataattaacaatcaagctgtgatagagaataagtaggggaagggacttaggactggctgatgagggaagcctcatggaggaggtgtgaagcctgagcacaagtatggagagaagagggcattccaggtaggagagcaaaggggagaagtttcctgggctggaataagtcttctgggaacccaaatgaaagaagactgctggggctggaatatagtaagtgaggaaggaagtggtccaatatgtcattgaagaggaagccaaagggtggtgttcttgtagcccacctgaaggagtttgatttttattctcagtgcagtgtagcccattgataagtgataaacattgagtgacatgatcacatttgcagtttgaatatactgattgtgtattctactgtgtggagaatagattgggcaaggggctgggaatggaagtggggtggttagttaagttgtccaggcaaagcataatgatggcttggactaatggagttaaaagagaaatgaaaaattaagttaaatttaaaaataaagagaagtgaatggattttgataaataaattagagatagaaccaacattaaatagcacataaaaggtacatggagaatgttagatggactggatggacggatggatggctggatggatggatgagtgggtgaatgaatggctggttactagttctctggcttccaatgcaattctggcaggccactctcaaactttaaagagaacagggtgatatctaagctggtacttagcggtgttccccttcttcaggtagatctttagtttcccatgattccttactcatgattttaataatggagttctgctggtgaaggtatcatattatttgccaatgaatgttcttgccagaaaaccttactgataattaagcatgcaactggaagcagggtgtgtgtgggaggtggggatgaggggcaggtgtatgtttatgtgtttgtgtgtaattactactttattcagtgtcagcagtgggaaagattgagttacttagagcagtgcttctcaaatggactatgtacaccagtcatctggggatcttgataaaatgcacattctgaattggcaggtctggaaggggacctgacattctggattccaacagtctcctacatcgtgctgatccttctggtcctcaggtccttctttgagcagcatgggcttagagcagtgatcagcaagtggctagatggcaaatatttgcagctctgcaggcaacagctccagaaatgccctgtgagctgccttctcatgtaaacccagcagtgggcctttgtctgtgactcgatttcctccttagggagacctagctggcgaggcctgcaactgagaaacaccaaaaatggtagtgaaagagcattgtatttttcaactaaaccaatttcctttaggatagaggtcaaaaaagctgtgctttgaaattagtcagctgtgggttcaattccatctccaaattgtctgtgaactggagtttccttaagtacaaaatggggctgagctgaccttggtagtgtgttatgttcatacatgcttgtacatgaagcatttagtcccaaaccatccaagcacagggtaaatgaaacaaaggacaactagtatacccttatgttttaaggtaaaaagggttttttgaggttttcgagggtagatagatgctcttggcattcctctaacaaacctaaatgtgattatttctcctgagtgactaaaactgtaaaactaactgtgattatctttgcttctatggatttaagagaaaacaaaacaactcactctgtaaacctccaaagaaaagccctccccttcgccccccacagattttcttgctgtttgtttctttacctcagtgtctcctactcaaagcataatgagtgctgtttttgctccagcaacaaggccctgcacaaagccaggcgggaggcctgtggatgaggtgctctgcaagctgagccagaagccttaggaaaatgcttgccaaacactgatgtttgactaattggtaatgtctgcggagttggcaccaggagaaaagaaagtaaagaggctggtggatgttgaggaaggaagacagacagacttgaagccaagcctcgagtgtttggagaaagagcctgcccaccatggagttcaaggaagcttgtcaaactgttttgaaatggtcggttaaacccctgaaggacagtgtgcccagatggccagcatttgatttagctgttcaggacagcaagagactgagacaggaagatgagcaaagtctcagatgtgccctcctgagtccagacagcttggtgtaaaattgtcctgtgaaaccctgttataacattttagtggcaccaaaaaagggtgctgggacaggggaaattccagcatgggccccatgctgtgtttggaaccagccatcctctgattgttgaactgaggtaactcacccagatgtttccctctttcaggcttagtgtcctctggaggaggagtagaaggaagggaggactcccctcctgccatgtgattcagcactggccagtccagtggataggatccaatcaggtgggatctcaaagcagtctccttccccttacctcctccctgagggatggaagggcccattcctctcaaggggcttccatgttccccatggtagggagggtagagatggctgccttaggagaaaaaagattcttatttctcctctatttgcatctgtccagaggactactccacacagagtagtctgatgtgtccactttcagaagcagcaacttttaaaacgcagccaaacatgaagactcgcctccctaggaacccttctctggatccgttctcatctttgcaagttagcattgattgggcctcacctccttcagccatgctactctcttaggttatctcttggtcagagtggtctttctgaagctaaatcaataaataataatcaatgtgtggctctctcctgctcaaaattgttcaattgttcaattttgagcaggagagagctcaaacgtgacaatgagatgaggagtaattagaatattacagctggttggaggataagtggatacaacagttttgaaaaacaatttagcattagttagtaaagtgaaagaggcatatacctagtgacccagaaaaaaatatagctattgcctaggtatgtgtatgtgtacatgtgatgtgtgtatatatacacatctagtatatacatatacatcctagaaaaatgtgtacaagaatgttcctagcaacactattcaaatcagcaatagaatgcataaattcaaacaatgaaatactatacaacaatgaaattgtatagtagaaaaacatggatgaggcttaggattcatcctaacatagggtcagcaacagaagcatctgtctctgacaactaaaaacacatatgttttatataaatctcaaaacatgcaaaacaaccttttccttaatggatagaaatgtgataaaattcagaaggaaactgaggaaatgatgaaatggacgatggagttacttctgaaggaggaggaaatgggaaaggaaacttcaaaggaaaacatgatatgctttgtcttaaaagtatgtgagggaacttcgggggtgttggaactattccatatcttgatcatagtggttttcccatgactgtatacatttgttaaaactcatagaactgtatgccaaaaagggtgaattttgtaggaggtaaagtatagctcagttgaaaatacccatgttaaagaaaagtatatggcggacacacagataatatttattatatatttttatataccttatgtataacttatattcttttacagctacgcaaggtactcaaaaaagtgatttttaaaacccctcagtggctcgctattttctcgggttagggtcagattgtttatgtggcctgtgttgcccttcatgtcctggcccctgctcgcctcccctccctgagcaacccacggacccgtggctgcctctccccttcatactatgattactgtctcagcgctgaccttgctggattgcagctgtctgtggacttctctatgtcccactagactgaaggctgcctgagtgttatctaccccttatatcccctgggtctggcacatcataggagttcagaaggacttgtgaagttttgttgagatatgcaggaatcccctttgattccgtagggggaaaaacaatgggaagaaatgggtaagaggtggagagtctacatggtgataattacttcagacttggccagttctacaggccaagggtttgatatcctattactgtggtaacaaattaccgcacatttagcggcttgaactaacacaagtttactatcttgtagttctggaggtctgacgtccacaatgggtctcactgaactaagatcaagaatttggcagcgctgcattcctttttggaggctctaggggagaaaccactttcttgtcatttccagctcctagaagctgcctgcattctttgacttgtggccacttccatcttcaaagccagccatggccagagtctttctcacattacattgctctgattgtaactcttcaggcttcctcttccactttaaaggagtcttgtaattacagcaggcccacctggattttccaggataatcttattttaggatcagctgattagtaatctcaattccatctgcaacttaaatttccccttgccacataacatattcacagcttctggagattatgatgtggacatctttgagtgggatgggggaggcattactctgcctactgcctacggtgaagaactaaaaaaattatccattgaaatttaagagagtgacagcatgtagcaaatgccacttcctggtttcaggatcatatggacttacgttttaacttttataccctaggagcaaaccctaagacaaggatttgaatgcatatagtttttgtttagtttgtgtgtttgttttacataattgccggaaacacaggtggagaaatagaaagagataaggaagtaaagatagccaatgaagagtgtgttttaagttagttattctgtgtgcaagtagaacttaacctggggaactatgagaagcaatgaaaaatacaagcctcagagttatctcaatcccaataagcaccagttaagggctgagggctgctcttaggagaacttcattccgaagacctgtgaaccacatgggttccagggccaaagaaagcccacaagcaaagagatacaagtgtgggtagttggaagtcagggcaggacactctgagaaagtcaaggccaagggggagatcgatatacagatagataggtagatagatagataggtagatagatagatagatagatagatagatagatagaagatagatagatacagatagatttatatatgtgtgtttgtgtgtgtgcgtgcgtgtgtatatctcaaattattaaagtcttctggtagtttctctggtgataatgtatttaatctttgtagcactttgcctcccaagagcaatgtatgtttgaaatctgccataaataatgtgaaaatgcttgaccaactgatttggttagcaaacgctctctggctaacatccagaagtgctacagttttctgtattttttattttgataaattttgttgtagaacaagaaaaagatatagacactttaaaaaaaaaaaaaaaaaagcagataccactttcatggcctgcaaattataaaaattttgtgtcagaattcttttctgccaggtaggaatttgagaggggcaaagaagagctcgatttaatttccctcagggtctttgctgaagggagaagaacagaaatctggattcagttttgttagtaaaaataatctttccaccagaaaatgtaaaaagctacattgttcaggatatttggacctattcatttcaatacagtctgataggtgggggtggggaggggagattttgagctgtgcagttttaatgaaatgtttaaggctgaaataatggttctatacagctcttgacatgatttattttattttgtgtcaatttgcctaaaatgtgtaatgttgtggcattccactgagggagggctgcaaagggctctcactgagtcatggattataatttacatctagaaagtctacacattccataattatggtgtgctatgaattagtagagtaatattgaatatccctaaaccccttattatggcttctcacttgaaatatgttttcaatatacatttattcagcagtgcttaaacatggcaagtcataaacacatgctttttaaatcatgtggctacattttcttcctgcttaaatgtaagatcagatgttattaacagcagaggggcaggagacgaaaggagagtgaagctgttaaaaaacaaatagcacttttcattttaaaagatatgtctcctatttatgatactgtttccccaaagcaaaagacggaagagtattttagagtgtcgtggtagtttctctagtgataatttattttatctttgtagcactttgcctcccaagagtgtttgaaatctgccatatataatgtggaaatgcttgaccaactgatttggttagcaaatggcctctggctaacatccaggaagaggagctaaatatttaactctcaaattattatgaacatggtccaaatgtctggagccctaaagaggcttcctataactgcttctaatgtgagaatttaacttcattctttgttgagagtggctcagacaccgagccacaagatgagagaattcctcccagggaatacaactgggcattttggaaagaaaggcattgcttttcaggacatttaaagttcacttcagaggctggcctcagtactcttgaaccaacttgagtcctatgcttgcaattcagcatgctgacactaggtggcaggcaaaactgaggtcatgccaaacttgtatagctaatgagccagaaggtattatattaaaaactcaaagagaattctttgtgaaagaataatatttgccaaaaatactctagaggctgcctccacttttaaatctaatgcattcattgtaaaggccatgttaatgcacactaacaaaaagctctatttttataaataaagtgaaaatatgcagttttatgggaaggggacacattactttgtttatataacaataatattatactttataccactattcaataaggtataataagttctgtaaatgtggttatgttttgctagccctgaaaaaatatgaaatcccatagataaatatattggtatcaggaaatactggaatgtgagaggactgtaatagcaccaaagtcaatcgaaaacactaatgagccaaacttaatgtgtcattagttgcctggatagtggtgtattatttcacaaaaggatagcattgtttattattttgcatcttgggcttttagttctccatgggtagtatagcacatggaatgcaagataaagtttggatatgtttgattagtgagaagtgagggaggagattgtatcttatgtgccagccagtagagtaagtacttactttgcaaacgatatatctaggtttctactttgttgctttcattctgcccagtcattggcagaaatcataaaacgatcccatagagggagcaaaaagaacccacatgattctattagacaatgctaaatgaaaaagaaaaccaattaacaaagtttaagtttaaagcagggactatctgtataaataagttttaaattatgtaattgaaagcatgatttaaagtaatgtaaactcttgggcaagagtaaatgccttacttcctaacacttcaatgctttgaataaatctttaaatcctggttttctcacttgtgatggtgagactcattcctgttgaaactttcagtgctcttagggggcttctcagagttcttcctcagaagcagcaataagtccttgctcatgtctagcaatttaagaaatgcttttactatgtgccagttgaagaaatgcctgactttatttggctcaatgcagctccaacttcctagagaattaaaggttcagtttattcttttataatcaatcatcagaaaatgagattattaacagtatagactttggaatcagtccatgttagttgaaaacccagcttcaccatttgttgacctaagactttgagcaaataaccaagagcatttgtaaaatgtgagtaatcatagtacctaccttaacagtagagaagtttggatgggtacctatgtaccgtgcttgggtactttgtacctggtatatagtaagtactacattcaataaatattaattattattactattattaatgggtcctcagttaccttactgagtctgagaagtactcagggtttttatactttttttccttaatagcataagtagagaaaggtcactgctcacaagccctgtgggaatgtcatgtgtgcttctcccgctcttcctgcttttccttcttccgtcaagtatctgggtgtaacaggttcccttatcagtggctttcctgggccccccggcacagtgtttgctgaacatacctgtttggatacacttttgtgacacaggtcatagtttttgtttatttctttttctttttttttcagaagaaactttgtgaaacacatctaatcacatttcaggtttgtattttgttttatccaaagagtccttacctgttggctttgggactagcacctaagccatcatctttaactaaaagatgggacaggctaatgctgggctgctagtgccctgaacactggaagaagttccagcttctgctgaggaggtggaggccatcactcctccagagacccttccttcaggtgcacccagatgtgtcattctgaagcccagaccatattctgtatgcttgccagtaaagtgaatgaaaatgatcaaaatagccatgtggctgtaggagaagcaaaatggagcaaactggatgtattgcattaatgatatgcaatggaaggaggagaaagtagtcaggtttgagttgcccagtgaaggaaaagcagcaaggacaggggcttggttttcactccactattagccaggcaagctgagtgttctgttggttacttaatttacgagggctttggatcagtcattctaaaacttgttcctcttttctttttcttaattaatgaatgttgatgaattctgaaatggaaatcttttggttggggtcagtggtcacttgcttggagtgatgtcagggcagtattgtctggtgtttagggacacaacctagctttatatcttggctctaccacctgctggccatgggacatcgggcaaataacctcttcatgtctctgtgtccttatctctttttttttttttttatgctttaggttctggaatacatgtgcagaatgtgcaggtttgttacataggtatacacgtgccatggtggtttgctgcacccatcagcccctcatcttcattaggtatttctcctaatgctatccatcctctagccccccagcccccgacaggccctggtgtgtgatgttcccttccctgtgtccatgtgttctcattgttcaactcccacttatgagtgagaacatgcggtgtttggctttctgttcctgtgttagtttgctgagaatgatggtttatgagttcatgtccttagcagggacatggttgaagctggaaaccatccttgtctcttaaatgggaaataatatgaatccctgcttcattaagttgctgggcaaatggaatgaatacagatggttcctgacttaggaggttggacttggaattttttttattttacagtgttatcagggtcttaaatgcatttcaacttagaatattctcaacttgcaatgggcttattgagatgtagccccaccttccatcgtaggtcaaggaaaaagaagtggcttacaagagttccagatacagagaaagctattagcgaaggtgaggaggacataaagatgacaacagtgataccaagtttccccatccactctcacctacccactatactaaacaatgtttttcctcttacctgctattaatatctcaccattcaaaacatattcagtagaacccaactcttagagttgatagggaaacaaaaaaataactaaatctcattttaagaacaagagataaagccaagagtaggttaagtgacttttctaaagtcacacagctagttagagacaaagccaggcctagataccatagtctgcagaattccagtctaatgctaataatatttgtcatgctaaagacacgacactggaataaagaatattaaagtgtgcatgcctcagaagacttagcagggtctgttccttgaaggctgaaatggaagttagattatgccaattcattacaacctcataagctagcttacagtaaaaacccaccatgggggaaaaacgacaaaatggaattgagacacttgaaggagggtaaaatgttttaaatcaaaccattcgttagaaagtagagtacaaacctagataagatttgtggtttcaaaaaacaaacaaacaatcaacaatttttatctctgggctctggtggatatggggggattcgtttgttacagctaaagttaaactgcagggaaaaataaaatgcagatgtgttgctgtgttgagcaaatgcagctgggcgtttctggaagaaatgttctctcagaaacttatcactgggagcagaaatggtgaaaagtttgtggggtaagtggcagagggttcttcatgggagttttatgaaagtcactgtgacataggatttttagaagccctaggaaaagaaagttggggagttttccagtgaaatttggattgagaaagaaaagaaacccacattgtgctaaacaagatggtggatccagttcagagaaattgagtaacagacgaaattcccagaatcatgagaaaaactagtcaaagacttcccctggggagcacccggatcaaaaagctgactccggggcctctctctacaggttgctgaggaggggcctgctgcagtaggaggctggaaggggtggtttggaactgagtcaagaaaagaccccaaacccacagggacagaggaagttgaaagaggggtttggcttagtggaagggaagggaggttggtcaagagaggcctgctgacaggaaagcggctgacaacaagaagcatctggaaagggccatttgatgctttaagctcatgccaagctaattgagtaatgtgagcttatgttcttgtaaattacttcaactgtatatagttcttcccctgagactgtcttactctgcttttcaaaattggttgtgtgtttgaataggccccgaatgtgctgcactctgtttgcgtgcacacacaaacgtcacttatcgatatagtctacattcgcaatactatgcactgactcattcagttttcacaaaattcccatattgcagatgtagtcactgaggctcttgtggggctgttttactgtggtgcccttgattcctaaccccacattgccgtatcatgaaaatgcctgtggaatgaggggactgtgggttttagtgtgtatttctgcagctcccttttataaggaggctctcttctatgggcccaactctgaatcatgatgccgtttgatttacgactctcttcttgaatgcctggagcagaatccctcagttcataaagctgaggacagaagttttaactataatcaaaatgaagactcttgctcttctttacccagggccttctcccaacctgtatctcctacctcttttctctcctcacagacagaccccaaaatcttagcctgcctattttgttgttgcatggaagtcaggatatctaggtcagtttatccaagtagaaagtgctactttactgagttaactctgtgaaaactgctgcctctttactttatagaaacaaaatcccttgtgtgcaggatattatctctggaagttttcaggggcttccaagtaatcagttagatttaaaatcaacaatgaaacttttttttttaagcaatggtgtttcccagtaacaagtgtctttttcattgttttatcagacactaagtcaattcaacctttttaattgtgaaaggactttaaaatgcccaatgctactacgtcagtgtccagaaagattggaatccacctgccaggatgggaggtttacacccatttcataattatatagaactttcttgttattcccataattcgactcagttatatcattaaacccatctggttatcaaaaggaaagggattgacttggtaatgcgggctccttttttttgctaagcatcattttgaattctatctttacatccgggttttagatgtcttatagttgtgatttttaaaatgtattaagatatagaattacgttcataataatattcttcaacagtttagagtagtgctattcaaagtatggtccatggaccagagatgtttggtgtgctatttgttactaggccccacaagttagggcctgacgtggagagtaggcatttagaaacttcagcaacttgatactgctgcaacattcaagcagcatttcatttttctagtagttcatctttactgtattttataaaagtatttgtccatgataaattagaaatggagggaaaacactagaatcatggtccttcatcacaatagtttgaggaaatctattgtataatatacatcatttcatttggtgcaacaccgaatgagatgctgtacaacaggttttgtgaaggagatagggattgcattttaagccttatttttcaggtaaatatacttgggttcaaagaggtaaaagcagttgatgtcacattttagttcctcttacccacagccagcattttccaagatactactctgctaatcacagacaagttgaagcaagcttaattacaaatagtcttgcctaagctttttaaaaggtttctttgtgtataattaaccttgaatgatctatgaacagacaaccgttaatgacatttgagttctctcaattcgtacaaccatttagataccaacaagctggccagttgcctgtgctttccaaaacagttgaaagatggtaactgcatagaactttaaggtttgaaagagacctaagggaaaccgcacagctacctggcaatgatcctctggcagacacatcagttaccatgggaagaatgtctcatggttgacagcattctatttgagggaagcagggacaattagaaagtccccacctctacctatttaactcctacctgttggccctatatctaccttctcaaggtactgagaataattctcaatatttggtcataggcattgtgtcccttctgaaacgtcttcctctacttcaaaccaaacatctctaactgtttcagtggtcgcttttgtggtatgcttcaggaatgcccctcacccacagactcaccacctggccacactctctctctctcttttttttttttttttcttttttttggcctattttttcccctttatttcttttttttttttctcttgttttgtatttcttttttcccccccacactctctacattctctttagtcaatgtccatcctaaaataagagagtcccattaatggatcctggtattccagaggtggtctgtccagagtacaggaaaatgatcatcttcctcgatccatacactggatttcttatagtgcaatctaagactgcattacttattttgtatccccatcacattgatgtcttatacaattgactcttaaacaatattagtttgaactgtgggtccatttatatataaattagagtgaactgtgtgggtccctttatatatgaatttttttcaaccaagtgtggatcaaaaatacggtatttatgggatgcaaaccccacatatacaaagggccaacttctcgtacacacaggttctgcagggccgactgctggactttagtatgcccagctttggttctacacaggggtcctgaaatcccctgcatataccgagtgacaactgtaaaaggataataatgctaagtccttttcatatgtatttccttagttgattggttattttatttattgacccagtgatttagtaattgatcaattccttccttcactcaccatccagtgaagcatccagccagcgagaccatggaattctgtaatatctgcttcgtgattttaatcctgtaagatatttcgagaagaaatcatgcttagtggaaggaaagcggtttaggctttttaatcttcctagttaatttgatctggagcctcagtgtctgggcaggccccaactctttggtccacacctcggggtatggttacccaattaactaattcccaactagctaaactctctagaatctggtttatcagtgagctccctggatagacactttgttatttttaacttccgccctcatcctcctccccttttagaatcactaattaaggaggtctctctactgtgagttttgtgacctctgtttccctggtaaccagattgcatatctgattgtacccagcatcccagcttctgatgacatggtcacagcgtcctataaccactaaggtgagacataggcaccaagaaatagttaccagacattttatatgggttgccccagggtgctgtggatggaggaggagtgagagagagatcataacattatttcacatgttataatgagcatgtatgatttttgtaattaagaaaagtaataatagaaaagattaaagagaaggaagaaatcactcctactagcttgttggctagggctcattcaggtcatggtgggggcttcctccttaatggctgtcatgacccactcatttcttaactccttgcattctggcttctaccccaaccactctgcagaggaaaaaaaaaatgccttttttaagttctctaatgacctaaatcaggggtcagtaaactgtggcctgtgggccaaatctagctggtcacctgcttttgtaaataaagtttttttggaacacaaccatgcctattcatttatactcattgtctaaagctgctttcccaggacaaccacaaaattgagtagttgtgacagagatggtatgacccgcagagatcattttgctgacccttgctctctattgataaatccattgatttagccactctagtggccctgaatccctcctcatcctcttcagcctctcagctgcctttggctctctccaccaattcttgaaaatactttccctcacccactgtgactgaattttatttttctctccttctctctctcagtcttttttctgtctttcgttctgacctttactctcctgtaatcatgcatgaggacacagatttttgtcttttgtgttcctatctacctctccagtgcttgcaacagtccctggcatgtacgtttgttgaatggatgaatgagtctagctctgtatggaggagagttgaatcaggattcttttgcatcatcttgcagaaaagaccagttcaaactttacaagtgaaaaagtggatgcccctgacagtcaaaaagggagagtttagcttagaatcatgaacatttccccttacacagccgaaagcctggatattttagggaacttctttctagtccattggccccaacacctcactccttattgtgacatactgtgaatatgtgcatgatgtaagcagacagtgtaaatatcctcctctttaccttcgaatttggtctagtctccaactgctttacagaacaaccctccggccccttcctccacagactcctgagcccctctgtggtcaccaccatggtactagctgagaactctgctattcgtttcgtgggaggtagctgtatttccaccatctttgcatagctgacctcaatcatgtttgttaaataaattgtcaactgaagaaggaagaaaggatgtaagagagaaaaggaaagaagaagaaaggaaagctaggcatagcttaagccttttattaagattagggctggcaaagaagaggtttcactttgtgtgctaatgctgaccaattagtagtgatcagctaatgctatcagctaatgctgatcaattgtatcatcggattctgaggctatatttgtgacaagagctatgatcaattagtatgtctgctatgggtgttgaaagaaggagagctgtggcttacaggccatgtttttccattctacttgcaggccaataaagtatacaaaaaatcttttaaaaaatgattatgtgagtagaatactaggtgcctgcctttggggacctcctcatcccctgtaataagtgactggatttttcatcctatcacaattaaacccaatggggtagaggtaatttttccaaaggaaattagggtggtggtaaggtagagaaatagatgctaagtactgctcctcccaatcaaccaaactgtctagggtccaccacagggagcaatcaagagtctaggattcctactgtagtattaataaaagctgttcatttgtcttaactcatctaagaatggactaagacagctggaatttagccaaaatacaaaattttatgtaacgaagctttgcagctgtgtgtgcagatatttctgaaaaagtcatcatccctttgccctcctctgttcccttgtgcaataagcatttccatgtggctgtgaacttgcctaacagcattagtaactgccatggagcaggtaattagtaaatttatggagcacttactaagggccctcccaagtccttacatccattttcttacataatccttacaataactctgtgaagtgtttagtattgtttctgtttgcagatagggaatcagaatcaagtggtgtgttcacatagttagtggtggtggtggtaatctgattcccaagcctgtgctcttaagcactcacaaattcaagattataacatttgtgtatacccatggacacaactgcaggtgattttgccacttaggaaacactggtaatgtctgttgacatttataacacctggaagagatactagtagagccaggaatgccactaaacctcctgccaagggccttgtgacaaagaatatttggccgaaaatgtcagtcatgccaagacactcatgtgtacatacacatgtacacgtggtttgggaccacctaaagtatccatagagctttggggtctgaacagataaaagacttggcttttaaaagacaaagctcactgtgagtaggagctggctgctaatattttcttaattaactaggagttgccagaaagaattttttcctaaaggcacctcgctccccccaaccagttcctactctccttgacatacatcctccaaataagacagaaaattcagtctgttcaggcagtgaaaataattaaaccgtgtacttcaagatggcccttccatgagtgcctcaataactctgcagcttggaggggcaatgtggcaaatccactcattctgggtggttggccaagggggtcacagttgtcctataatcagattatgttgctatatctgcccattggccatctgtggccatttggggaactattaagcaagcagcgctgacctaagtgagatggacgatggcaatgttccttggagtgatagattgaccagagggatggtgtaatagcctgccagtgggggctagcagatgggcaactttgacgagaagagcagtcagctccccacagggaggagcaagattggaaatgcaaaagtaaccttccatagatgcacccccatgatcttcaatgaagagcaagaaccaagcctgtgacagacgcaagcttaacattagaaactgcatatggcttggccatgtattgaaaaatcctttataatccctttcttgaagctattttaaagagtaatgaaaaatgtgtgtaatcatgatgtataaagatgttcattgcagcattatttatgctagcatagagtgggtaataaaggactgacgggaaaagaatggctatacaaaattaattcacactcatagaagggaacactatactggcattgaaagtaattttcttccaaaggccatttaataacatgaagaaatatttacaaagttaagtttaaatgaaaaacaagatcagaaaaattggatatattatttttgttgaaaaaaatacataaatgcatagaaaaacaataaaatgaatcaaaatgttaatagggcttattttgaggacatagataattaagatttatgtattcttcttagcaagtttcagcaatttctaaattgtctacagtgagcccatgttgttttttaaatgatacttttgtaaaatttcaaaacaaagaagcttttccctggtactaataaggttctcatgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttgagacggagtctcgttctgtcgcccaggctggagggcagtggcatgatctcagctcacagcaacctctgccgtccaggttcaggtgatccgcctgcctcagcctccaaagtagccaccacacccagctaatgtttgtatttttttagtagagatggggttttaccattttggccaggctggtctcgaacttctgacctcaagtgatccaccctcctcagccccacaaagctgtgggattacaggcatgagccaccattcctggcctggtggctaggcattttctatctggcatacctttgtacttttcccttaagaaagatggcagtgatgggctctactgaaccacaaggaagctctctgctttgtctccttgcctctcaaaggtgctcagtgtggcttagatatctgcctgggtcagtcctcctagcctactgtcattcacttgtgtcctgccctcccaagccagaagctgcaggagaacctagactttgagtccaggtgtgttacttgcagtgaacagttctcctcagacccagctggccatccaacgttcacccgctctccactctcattccctccgtgcccctgtgtgtgcggttggcattgctctgagtagcgggtaaagccttggggccagggctgtaaaggtcagacagaacacctctctgcattgttcctgtcctgcagctcctccctgggtagctacaagcccacagaccaagggctgcacccctctctcctccctgcccagcacacagcctcccttccagatccttcatcgacaacaatttatgaaaggctgaggatgtaccaggcactcttccgggtgctggtgataacatgtgaagaattcttgaaaatcctgccctcctggggcttatatcttttgggtgggtttggggagaaaataataaagaagacaaaacaagaagtgaaataaaaccaggaaggggaatcaggttgtaatttttgatgaattagttaaggaaggccttatgagaaggtgacacatcacatcagtaaagactcaaaggaggtgagggagacagcagacatctgggaggggagaaggggagagagggcacccaggcagagggaacagccagtgcagaagcgcttagctagagtatgccctggcatgtgtagggaccatcgagaaggccattgtgtctacaggggaatacatgatggggcccacagcaggagaaggaatcagaggccacaggaagagatcctgttcacatgggctttgtaaggctgtgtgcgaattccagcttttctctcttacttcaatggcatcagctgttttgcgcagaagagtgccacactggggtgaatagcatccaggtgtctgctccgtcgagcacagactggaggggagggcagggcagaggcagagagagtgtgaggaggctacagaagctaacccgatgagaggtgctggggccctggagagcagggagcgatgagtggtggggaggagtccagtattcacaggcctctccacccctcacacattcaggcccagttgcaaggtagctgtggaaattgaatggggatcagaatgtcagcaactcgtttctgataatcactgtctagtctgagaaacttattagtgccagagaaaagctattttcttttgaatggaaaaaaaaagagtacccttttaacaataatcaaagcaacatagggtcactgcagacaatttggaaagtacggaaatttgcaaagaagaagactcgaaggaggtgagggagacagcgagggatataaatcataattctatgttgtagaaatgtcttactaatatttttatttattttattctgagttttttctcggcatacacacacatatttaaattttccttacctcatgttttagtttaacattgcgaatatttcctctgtgtcatcaaatagtctttgaaaagattgttttaatggcaacataatgttccttcctactagtgtgagttaacttatatagcaatttgcttagtggaggatggggcttacaggtgcagccttgatgggcttcctaaaatttcacccccaaatcagataagcttagctacctggtaacagcagagttgatacccgaaggcctcctccaagggcagagcctgctcctgggagcttccgtgtcatggagaacaggcccatgttctgtttcctgcaggcagacacacatggagaaggcctgggagagtttgaacccagaattctaagagcctttactaagactcaccaatataagcctctcttcctccctgggaaaatgagaaagagaggtagagaaagaggccaggagtgtcaccctggtgaaaggcctgtctgtacatgaaaacccaaggccagaaaaacagaggtctcctcccaccattggaatttcagcagactaatggatgtcaagtacttggccctggtaaatgctcaataattgccatcttcccccttccactactgttcccaggaacataccaaaatttcataaaatgaatagtcccatgtgccaatttaatgggccaagctgaattattgggcggtcattgcttttctgccaacctagtgaaccccctgcagaaagcaggatgagttcagtgggttaccctttgatgtcataagtcatccttctcaccctgtgtaagctgaatatactcaaaaggaaaaagatcaatgaacccccaagttggcagtgtcttggtaacctgtgttggagtttaataattgtttatggatggatgtatggatgagtagatggatggacgaatggacatagagaaggcagagagggaagaaaggaggatagacggtgggtggatggaaaaaagggtaaattaagacaaagtcattgtatccttttttttctctgaagagatatgggggaaataatgattttacataagtcattgtagtcttttttctcaggtgaaatacaaacccaatataaaaacccctcatttctgttggaagtaagtaaagagacacattgtgatcttagtagcatattttatctgtttgagccccagaaaggaagatgggtgattttctagcttgagtgacataaatctgtgccctccccctgtaaaatatattgtcatttctgtgattcatttggcttttttttttttttttttgaagtggactgtggtttgtgtgcagtggatgaagtaattggagtgagtgcttctccctagagacagaatcaatcactgtggtagaagatggtgacattttagaaagaaactctgaggaaaatgtcatgcttaaaaaattagatttaaacacactggctccagattgatttttattacactcaaatggataccctgattgattatcagtcttacaaatgtttagcacatttctcacttctctaataatcagaataatctaattttcaatgtcatttaatgtactctattcaaggttataatagatcatatttctaataaaacacagcaattatgtaatgaataatacaggaggaccagcattcagattcccttgattttaaggcagtgccaagggaaggtcttagacaaacccatttctttaaatgtgatgcacattccaagtctttgcctgcattatagaggatgtttttttcctgctgatgatctgaatggaactttgccagaaaacttgacctcccccgacaaaaaaaaaaaaaaaaaaaaccttttgagaggcagcaagttttgaatccttttttaatatgtgttatcagtgcacctgaagaaaagtgacaggttgctaagttatttattgagtttctctagtaattgctgctttcttcccattttttatatacattcccaggagaaatactatattttagttctaaaaattttttccaatatccattatagcagcagctgacattatagatgttttagggtgagccacaaggtatctagtttggaggaagcttggctctatattttgagcccaatacctgattatgtttggttttttcaagagacctgactcacgttaggaagtaacttgtactttttctatttgtggcttctagccaattccagtcatgtccaaatctaggttagtaattatgaattcctttgttatggcttacagctccatttgatctggtatgcgtatgaaatggtatcaaaacctggtggcctaacaagcaatagcacttaaaaggtttattgttttgtcccatgttcttggtgaggggcatttaggggcagcagatagaacaatgaaggctgaagaggtagcaggcctgataagcatttagagactgaaaagaagggggccaaagcagaaggcccacttctaagatcaatcctagatgaacctggcagagtgagaaattcagaagctctgaaggctccagaagatctaagcagaagtaattgatgggccagtactaacaagatgccatttaacagaggtgaacattacgttctgattcagactcggccaaattggtagaggaaatacaggttgggaaggatcaagctgaggatctgatgaccagaagcttgccatgaaccaactcggggtagtcacatgtcctcccttttaaggtgtttggttaatcagatcatgaaagaccataaccctctgtactgggggctgatcagagcacaccttgaaacattagtgctttttattctgagcacctcattttaagagggaagttacctagaactggacattatccaaagaatgttgaccaagatggcatgagatcataaagctgtgtgctatgagatgagaaaaaggaaagtcatagtttgctgccatttattgagtgctgggccttttcaacacctttatgagacattaccattctttcatggtcatggcaactgacaccgagattggccagataatttgccaaaatttacacaactactaaagctacacagtcaagatgtaagcccagctgtctctctctctctcagcttttgtgatctcaccatatctgagattttctatagactgatgattctagatgatctccaaggtcccttccagctgtagaattctgatggtctctattcaggatatgagttcaaatatcattgcctgatacttggaaacattccaagcataaagagagaatactgtcttatggtactcaaaataagatgagattaacctgggaacacttgctgcttaagtaaattgaggttgagaaaatgaggacccctttgcagttaagatacttggcagtaaaatctgtctacatttttgaaaatattagttcttgagacattatgcagtttcctaaagccttgaggaaaaggagtatgtgtgtctgcatcggcctgccttagtctgtttgggctgctgtaacaaaaataccatagactaggtggcttataaataacagaaatttatttctcccagttctgaaggctgggaagtccaagatcaaggcaccaggagatgcctagtgaggtcctactttctggttcatagataggtgtcttcttgctgtaacctcacatggcagaagggggaagcaagctccctcaggactcatttaagatactaatcccatccatgagggctccaccctcatgactacgtcacctcccaaaggcctcgcctttgaataccatcacatcggggattaggtttcactttatttaaaatttaatttcattttaagttctgggatacatctgcaggatgtgcaggtttgttacacctagcaacccatcacttaggtattaagcctcatatgcattagctatttatcccgatgttctccctccccaccgccacctgacaggccccagtgtgtgatgttcccccttctgtgtccatgtgttctcattgttcagctcccacttataagtgaggacatgtggtgtttggttttctgaacctgcattagtttgctgaagataatggctttcagctctatccatgtccctgcaaaggacatgatctcgttcctttttacgactgcatagtattccagggtatatatgtaccaagttttctttaggggattaagttttaacttgcgaatttggagaggacacaaacatttagtctatagaactgactgttttaaggggttaagaaggagatgacctacaaaattaatgacaaaaatcatctttgaaggcttgaagggcagggtcttagcagagtagttaggatgggaaggagaggttttaaatgctgtcctcatagtggggacctatggttacctgagcagttcacaaggtattatagggggcccagcaagagggaatgagtaaggagtcatctgtggaacccggcagcccatttgagctctaacagtactgtttttactttttactgttcattgtcatatatggtattttcccacctttggaagatgagctattgtctgcaaagcatcattcaaagagggagtgagtttgagaaacagtagatagactcatcagaccctggtagatatactggataaggaagagaggaggataggtctgcctcttccatttgactcatgggccctcagatggattatggtgccagtcactgaggtggcaacatggaaggagaaagagttatgtggagcagctaaagagtccattttagggagaagatcaatgtgaggtgccagtgatatctaatgggcaatgggatggtcacatctgacgcttaggagaaaggtctgggctagagattgagattcgagtctcctggatatatgtccttaatagtggagggcttgggcatggatctcattacacatagaataagaagagggctagggacactcccagagatacagaattctttagatgggctgccagataggtcttgtggggatcccaggatgcagatgtctcaagttgagtgtttcttagctttctcaatcaagccttcaatctgttttccataaatctggaagttagcaatagttctgagagaggggaatcccagtccatgcctacctgcattcctctttttgaagttagttagctcaaggcattttttttataaccatgtttcatagttcttgctactttttaaagtcaagaggcatcctaaaaagttcccatagcccactgagctggccctttttttaaataaacctggttatgaacaagagccctgggatgagacagcaaagccaataatcatagttgaccacgggcccctctgtagtcaaggtacatggtagcaaaaacagtctgtgtgattaaaaatggcagttcctggagctgaccaaccattgtgcaatttcctgaatttggtcaaaagattatagggtaagtgggcaaacaggctgggcaagggaaagtcagcctggtgaaattaatgagaaaaatattattttagagtccagtgttcctttccagcttaagatctagacaaccttaaatgcatgcacagttaaaccatatgttctcaggataatgaaaatggctggggttgggggagggcggccaattcttgctgactgtgctttggttgttaattggaagggacttggtaaggggcggggggaacattctcgtgccagtggcttgttagggcaacttgacctctctgcctgcattccagatatttccaagatagctggccctgctttgcatatatctagatcaagtgggcaccccaaatctcttagtctggtttcctctctcaagttcttagaaggtcagttctcactcttcacctttctgcctactaaaatctacctggaggagataatactgcacccgtctaaaatgaaccaagggtatgataaaggtaatgaaagaaagaattttgaaatgggtgtaaatattcaatgtctagggtttactacaaaataatcttgggaggtgtgggagtaggaagaaaataagtttggccatgagttgaccattgaagcagagtgttgagtgaatgggggctgttacatcatggtctctactttaagtatgtctagattttatgtagcagatctgtttaaatataaatacgtattccagttgtcaggactggaggaattaatgacataccttttaaggtatgattttgtgttttaaagcttgaaaatgaaaaacagatatcctacgaaggaagacgggcaaactataattcacttggtgaatactatgaaatgcatgaggagttaaagtacttacatattcaaaattttagttctatagagatgatttttttcctgccatcttttgctttttttttttttgaaagatttgagtaaataaaacacaactatattgattgctacctacagacttttctggctacctagtctctcgttgccctttcactggatgggagcctccttgagggagggtggcctctgccactggcgcccaggcatactcttcaccacccctcaaggaatgattgacaggggagcagagaacttttctttagagaactctaggaatctttaagcccatcctcttcatctctgtgtgatttagacccagctatttgtgaggatccctttctgaccacgttattttccaaaggagcaacaggtaatgcaatggccttggaaagtctttggatgcttataaaggaagaattgtggaagaactctctttcacatcaccaaaaaaaccagtcatctgaagtgttgcttcctaagaatgtggagcaatcaataaacccccttggagtatcttacatgtcgacactcccttggccttgataacatctgccctccaaaggcatttggcgtgcatctgttgaacacatttgtatggattgtcactgggtcttcgctgcaacctggcaggattggacgccatccttcgttcccaggcctcatgagaatcgaaacatccaacatctctcaggcacctctcaaataccagaggtccccgactctctttatgttcccaagatctttactcatgctttcccctcagcctagaatattcttcacctagttaaacagtactcggcccagacattctgatgcagaatgttctgtgcagattttctctggctgacttcccactccccctccccaactagaaagaagcccatgtcacctgtgtttgccacactgtttccccatgtgttttcagggtgtaatgtcatgttaatctgtgtttggttaggtgaggaatgtgtgtgtctacctctggagcaggggtctacaaatactgcaggccatggttagggtgggggaggggatttcccgagagaaagtatctgtgcgtggaggtgtagggcaggggaactcactgctgtgcagaaaataacaactgacatctagtatgttgcctgatagctgaaataaaacaaaaaaacatgagggggtgagtattaattgttttattttttgttaaatttattttcttccctaagtttgatttattgcacaagcaacttcttaacaatcaaggacgttttttagtgtacaggtcagccaactctgcagtccataggttaaacccggcccactgcttattttggtaaagaaagttttactgggacacagccctgtgcgtttgttgacgtgtagtcctggctctttttgcgctacaagggcagagttgagtagtgtgacaaaaactgggaaggcccaaaagcctacaacatttctatctggcctattaggagaaaaatttgccactcctgggctagactgtgactcagtgaggaaccacgtctgcctcttcaccatcaacacctccagtaaccctcacagtgccgggcacagagttgcataggttcggccttagtctgttttctgttggttataccagaatacttgaaactggataattcataaagaaaaggaatttctttcttactttgagggctgagaagtccaaagtcaaggcactgcatctagtctttttgctgatagggaatctctgtggtgtcccaagatggcacagggcctcatatggcaagaggattgggtgtgttaacatgccagcccacgtctctcttccacttcttataaagccatcagttcctctcatgacccattaatccattaacccattaattcataaataagttaatctactcctgatggcagagcactctcggtccaatcacttcttaaaggcttctcatctcaaaactgccacattgcggattaagtttcaacatgagttttagaggggaaaaatattcaaaccatagcaggttccctgtaaatatttgaataaaattagtgaatgaatgaatgaatgagtaaattgacaaatagctactctagcttgtttatttaatttatgggaaaacttttccctcaatacatgcaatagtttctgctccctgatatctaaaacacttgctccttcacctctttcagctctcttctcagatggcccctcatcagagaggctttccctgccacacttcacagtacaatgtcccctgtcgatctttctctcttccctgcgttgtttttcttcataacacttattacctgtcattatattggatatgcatttgtttatcatctgcctcccccaagaagaaaataaacaccaagaagctggaaacatcttttatcaccgccacatcctcagtgcctagaacagtacctggaacatagtggatccccagttaatttttttttctagctctgtcaggattaagttttagtcatgtgtgtatcatttagtcagcaaatatttgaaaatgaatgatcacattaagaattgactgcacgcagcctaggatttctttgtatgtactctagttatttcttggatgttaactgccttccccctagatcccaaacactgtcttactggtactgatcttacacccacaaggtatgggttggtaagaaatagatggccccggggatgttggagttctctactgcttgctgatctaccattgcctttcctctctccaccaagggctggaggctgcctctaccttagaaggcattagcagatgtcttttttattaaaagggaaagaaagcccattctgggcatgggtgtgggtgttaaaggaagggaaaaggaagggcaaagggaagtggattgtgaagctctggcaggaacgttttgtatgttgtttcttggacatcttgtatttttttttttgaccccttagcagaagcattcccaggaatagaaactggattttctgttcatattagacatccaagactgtggctgtaagctatgcagagaatggtggagatggctttctttcttttccaaatgactctccagagaaataaatacctgagaattaaagttctgtaggccacaaagaagatttttgtgaactaaataggattcagcaatcctttacagacagtgcaatttgggatgatctatttatattgagaaactgataagttcactcaggggaaggctaagttggctacaattctagccaacacttcatatgctgagactgacctgggagctttggcttatttctgctgtttcattttttaagattttcttttagtaacacatgtggactgagagtgacccctcaatggcattcaggacaaccaaggccaagtagaaaaattttctagttatagtcctcattacattcttgttaccaacactaatcttttgaaaaagcaaaaagttttaagaattattgtatgagccatatatagctttggaattagatagaaatgggttcaaattctggtcctataaattactggcttaaatgtgacctttaaagtctcttggccaaagtttcctcatgtgcaacttgggaagtaaatcatgccattgaccacatggggctgctgtaagaattaaatgagaatgtatgtcatgcacttagcacagccagcaccccgaagggctggggttgatgacagcagtgatgttgcctgttcatggcaaactgtccttacagctgagggagatgcaagagaagtctgggtcacacaccacagccctaatttgagaaactggtctgtgacagttggcaattatgagtttgaatttccataatggattggaatttctctcatctttgcatttcaaagccaagggcaaggaatagttattattttctcatagtaattcttgtaaacaattcctgatgtgcaaggtaggtcaacaaattacatggaaccattcttgcataaggcattttctcacaatgacgtgctgtttgggtgtctttagagtaaacttgaaagaagttctccttctttgtgttttgcttccacatggcattgcattcacacacacacacacacacacacacacacacacacacacacacaattgccatgaaagtagagacttctgctttgagttcctctataggttatgtctacatcagcatctgttgcacagtagtagctcaataactattagtggaatgaataactgagtctatttcacattaagtcaatttctagaagtcaagagctagaagaaacaaaacccggagggactaaggaattcctcttcattttccatggataccattccaatcataaatgggcttttcccaaggctctctccacagcctatcacttctctggagcctgaaacccagatagccaattacataaagcacacactggataactccacttgggtggcacatgggcacttggaattctaagtggagaaggaggaggccctttttcctcctcctttgttccctcaccatcattgtgcaagctggaaacccttgacccttcctgctgcctggcaccttgcatctgctatcctggcacttccctacagtccctccctggtttagacatccctcttctctcactcggaacttctagcaactacttcagtggtccctatacccctaatcatttcttcaccatgaacagtgactcgtctaaacagcaacccctaataaacttaaaagccaagtctccttggccaagttcacacaatcacatgagctgtggtccagccacagcccagaactgcaagcctcaccctattccctgcagagctccaaagctgccctgttgcttctctctaggtctgcaaactggctctcttttctgcctggaaagcactcggttctcccagcctttggttagctcaagtctcctgctttggatatttacatagaatttaagtgaatgcatatttcaagatctcattccatattgaccctccagtgagcctctctctgcaaatgagcaattttggattctccgggaagttcaaacagcctttttgtgtttgtaaacatgggtagtttcactgacttctcctacaggttggattacacaaaaaacatgttttcaagcgcttggcctcaagtttattttctaggctgatttttgaaggactttatctggcctcctcttaaccttccccacccccaagtctggcttccatccttattgctctgctacaaatgttctctcgaaagtcacaactttctccattgccaaaaccaatgaactttgctccttcttcattctttctgactggcggctacttgaacacttggccaggctgctgctgcttcaaattcttttctccattggtttctgcggttttttattccaatttctcccacagttcatctgctttcatccccgtatccttttccctttcccatcaactactagcaattcccaaggattagttcctggcccttttttttttttttttatctttcctctctctcaccttagattgttcatcctcgcttacgacttcaacagtcatctctaaggtttgactcctaaataatctaactttggaggtgctctcttgccaaatccacaatgccattgctctgacagcctctggattcctaattcatgccccctcaaaccaaattcatcatattcctgccagaaactggcttccctactccccaccagctaccctacatttcttctctgttttgataccatcagtagcccaatacggggttaaaaccttattgttacctctaagtcgtcttcttcatccccattttcattctgttgccaagtctagcatatttttccttgcggtgattcactatatctccccacttctctttgtcctcattatttctccccatcaatccctgtctccacatttttcttcagtgacaccagccactccactccccttcaaacatgatgtagtcattcttggaagtattttctcatatctcccccatccagaatgttttttcctccccttttggcctcctgaatgagaccccatcctttaaaggccaccgcaaacctaaattccatcatgtagccacgtttttccaaccctcaggcctttgcgcacattggtcccttcatccagaatgtctcctagcctctctaagccccattcatttaagaaatatatgttgaacattccttatggagaagatactggactgtgcactgaggatttctgagtgaataagacctagcatattcttataagggtattcagctcaagattcctctcttctgagatgttttttccctatggccccacaggctaaactatcagcttcctcatctgtgagtctcagtaccatcttacaacctgtcccttaggttttgaattcatattgcttgagtctaagaatgaatatctcccttctgacatctagctcagtgcatgatagttatttctttagatgactgtgtcttttactagaatgtgaatctcttgaaatgataccttcttactcttgtgtctttaacatgcataatggcaaacaaagtgtaagtgctcaataactatttgagcagaagaagaaataaatagatggatatatggttggatgggtggatggttaattggttggatcgatggatggataggaagatagatggattgatgaatggacagagatagatagacagacagacaagtagatggacagatgaatagatgaaaggatggacagatggacaaatggatggataggtggatcaatggatggaaaatgggacagatgaatgggcagctgcattggatagttggaaggatggacagatggatgcatggatgaatgagtagacagaaggactggataaacaggcaattctttcttggatgtctatttggatggatagacagatggatggatggatgaaaaacactcccagttataagacactgttcagatctataatgattaggaaagaaggttatagttaattgactaatcatatccaacagtgggctagcatatatctcatacatagactgccaattttctaaaaattaatagaatgcatttagaacaaaagctatactgaacaagatttatatgtggtgattctgaagatccttagaaactttagcatttccaggacctcattaagaatcacttaggggtatatagactggcgtaaaccatttgaaatgctgtaaagtgaggtttttcatttaaactaactatgtgatataaacacctatatctacatgtagaccatttctctaatgatttggatttctaaaactgacaacatgaaagagcttctctacattaatatcttaacggtatttggcaaacatctggcaaaattataagccatttgtctatctctctcagatgtcttattgacatgtggatggctcaggcagaaatccatcacgtatattaagcaatctcagaaaacgttgaatcccaaggacatgagcgtggccataaatgttcactaagccaagttcagacagacagtcctaacattagaggtgaacccactggaagcttaataactgacagtttccatactctgtcttccctttaatctctagttatagagcaccaggctggaatgctggtctcatcttggataaaaattctttcctccctccctcattttttccttccttggtttctttctaccttccttcctccactgctgccttagcatttcacatctcaaagcttttgtgtatattaaatccttatattctatattatatatcatgtgcatttcatttattgaagggagaacccctcatgctttatttgactctgtttctttagtggctacaggactcaataaatgtttggtgaataaacaaattggtatagggctcccactatttttgttcatgttacattgtgttgcaatcatgtatatatctaaatatatatgagatcctgtgtgcaatgaacaaaaactgatgtcctcatttttcagataaggaaactgaggctcagagacattaagagactatcctgagcttacatagttagtacaataaatgacgagctaaaatgcaggcctttgaaattttatcccagggtccttccatttgtccattgtttctttcatattatttaagacctatggggaacagtgccataatttctgtgtgttgtaacagatgtgggtgggatctttgagtggtaggaatgaccaattgttttctttcttgcctcaaatgctgaatagagggaaccatgtattcaaatatcctgtagcataaaaggcatttgggcacgtgttactgttgcataaaaacactctttacacagactgtattacacagattattgctgtgtaacaaactacccccaagctcagtggcttaaaactataagcttttgttactgttcacagcaccatggatcagtcgggttgtacttctgggttcactgggctctctactgggtaggcaactctgctgatcttacctgtgctctttccgaggttcaagctggctccagattgatctagtgtggtcttggctggaacaactgggctgtcctctttatggtctcttgggacttctgcttctcttttcctaagctgagaaaaacttcatttctattttacataacattttaagaggaaatgtatgatgaaaatgtcaagcagaacttcagttcatttgctaaaaatgtattggcttttaaaagacagtagaaatgaaagatccggccattatattttatcatgatagagactgttatttaatatttgaaagcccataacttgttataaagaatatacatgacacagagcaagatacaagcttatctggaacagtctgttgctgggaaatttcttttttgccctcctgcccttcatcagattctgtttttgaaaggcagtctatgcctattccatgaaagaaatataaaggagtgtgcttgtatccctgctcaacttttttaccctgctcaacttttttaccctagatatatgggacccctatttgaagactattgattcctgaaccttagactgtcagccttttttcaaaaaagttaaaagacccactcacagtgtttcagatacacgagggcagcttgggcttcagcagaagtgaacttgagtttggcacagcgaagaatttcctgcctatgaaaattgattatggaagagatactaagccttttttttttttctagatcagaggttttttaaaaacaaggtgaattgatcatacagtaagtgtgtgagtttattcctggttaaaaagcagagggccagccacagtgtctttaatttcctttttttaacattcagttttatgccataaataaaaggcttcatctcagctcttattcatattgggtagctctgtcacaaacacgaagccacagacacgtgtgcctctttggacaggatttaggcaaagtaatcattgagaatagcccattgctgccagaggaaatgtacaaagaagcaccgccgggtatgaaggaaagcatctcaggggttcatgtcatccctcaactactcactgttgagttcctacttttatacattaagccagaacattttcttttttctcatttctggaattgaacttaggatatttcttatagctcatatgtccaaagaaaaggatttttcatctaaaactaaatctcttgccttgcaaggacgcgcaccacaccgtgcttgtctgaaaatgaatgcgaccacagtagggctgcccttaccagcccagacagaggagggaaaaagtatttgaaagactgtccacacaagaagaggtaaaatctgcatatcaaaaagtaaccagtgagggaaatatgattaaatttgttttgaaagtttcattagcataacataccactttaaccacaaagaagtatttgacgtctgtatattctgatatttcagagattttctataacttctttgaataattttaagaagctgagctaagctggaagatcatattaaactctcagaatgctgtgtccagactaatttcccccaagacttcaatattctgtaaaaattctaagcatgctccttgctcaattgctggcacaatggacaccaggtcatctcttagacttcgaggttgtaggggcctcctgtcaccttttgaagtacttgcacatatgctacatgttgcagactcagagcagtcctcttaggattccattttgacctccattttacaaaccctgaaatcaaagtccctggaaatggaataacttgattcattcaacacatactcttcggcaccctaccctcagcctggtccaaaaggcacatgtctcatgagtggcaagaaaacttagctgcagcctcattcactgaccttttttctctgtatatttgttccaatttcaactggaattcacatggcaggcactttattaggaaaaagacacagtccccaccttcaggcagattctgatgtagaagaaatgtttactcaccccaactctccccagtttacagtgggacgtgctatgttaaatgcttgaattaaatccttaggttgtgggaaaagtaagtctctaacaattagtaatagatccacctgccttcagatccatggtagctcgtttacatgatgagattagaaaatgattttttaactaaaattaaagcatgttttaatgtttttcttttaaatatatcagtgtgttagttacaggtcatccccaactcatgacaaccccatagttctaatcaccaactgtaactcattattcttgcagttagcaaggagctgaagagtcaagatgaacaaattccagactttaattttcaagcaagaataaatagaccatcatgcttcctttgctaagctgaatatagagaactttatggacaaaaataccatcaattgtattttcctttttttttttttttttgatgtgaaaggatttttagtgaagcattgttttcatctcttcctgaatccaagtgaatctacatcttttgcatgtttcctgcattaaatttttattgtgtgcctgaaaatcaatattccagatacatgcacaagtgcacacattaaaatgaacatgacttcatttatttccatgattagacattcaaataaaagtgcttgggtgtctgttttcatattcataggtcgagatccgtacatcagaggtatttgtataagtgacacttttattacattcatttcatttgcaatatgatagtggatcataaatatgttacttttatgccaccaaatctgatttgtagcacttagcccctcacaaggagaatacttgatattttatggagcacctttcatccaagaagcgctttgcaaacatcaggccgggttctatcaggtgtataaatcacatctgtgaccccctgaatgccccacctgcttcatcaaccttctggctactactgtaggggtggagagcagttagtgattcccccgcagaccccaacatgatagtgagacctttaagttctggaagaaagaggctcaggtgaactctgtattgccacatataggccctgacagtggacagaacaccacatttagttatatgtctaccttatcatttgcaaaacagttttgaggcccccatctgtgggtcggatcttgtattaagccctggggacatagagacaagtaacatgtggcccttgcctttcagatattcacagacttggaggggagggctttgatgcaggcttgacagtgtttgctcctctctttgcctctccattccctcccagaggtgcaccgtacctgaaagcagcttgtcaaactcccaggtctggcataggtatatgagtgcatataccagtcagtcgcaatcagagtgaaagaagaggtccaccatcaaacatcccaggcagccttggagctgagcatcagatgcacaccccacgctcccagagaagagagtcatctccccacccaccatcccatagcatccctcaatttaccctcccaattccccagcgttagcttcctaatctaggaccagtaggatccccctgccacacccagtaatacacaggcacagctccctgtagcatccttcattgtactcactacgctgtggactgtgtgtacatggggtagactcagacgcagcggagcacagtgggtttcctaagttctgatcctgactgtatcactcacaggatgcatggcctcaggcagggtactcaccttcctgtgcctccactttctcatctgcaaaatgggtataatagtgatatctactctattaggttgttgtaaggattgaatggcctaccatgaatagaaggctttatgatagttgtaatgaacactttcagtattgtggtaaataatactctcgtatattaattgcagtacatgtaataatagtgatgccaatattctattattattattattactgtcactgttttattgtatgatgaatgtctgtctgctaccataagtttttgctccatggtagcaacaaccatcctgttttgcgatggcacatagtagatactcaataaatattcattgaatgaatgaatgaacaaaacaatgaaggaacaaatgaatccacccactcatttggtgccactgcgatggcttctccaagcaccatttttcatatcagtctcctctgccactgacagccacaggccccacagtaatccccacaagtccttggtgtttaggtcatccatttcccccacggaagggccttacattcttcctgcataactaacccacataggcctttacagtagtctacctccttcccaccaagcccaccatctgtgtgtctccatgcaggtgctactgccatctcgggggaggctctgaaaggagctgtctcctctggagttgaccccaggtggtaagtggtggagctagcactagttccagatctcctgacttcccctgcagtacttgtatcgcccttgcctcccactgctggcctccaggggaacgagtccctgccctgccccaggagccactgaccacgaggcctcaaagggaccaatagtcccaagaacttggacaaagctaccatccctaggcccccgtggcttcttgtgcactgtgtcacctccatgattctggtggttcttggcagcccttctcaaacactgcgtctgcgttcttctagagtttaaaaccattgagggaagcagctgctgaagccacgtgtttagaaaatttgtccgtcaacttatgaagctgtatgtaattggggcatcatcaccagaggggttgtccctgcattttgtgggtgtggaagaatttgtgataatcccaggagtcctttattcacatagacagtggtggtgggacttcacgtaggggacaaaaggagtgtggaaagtagcctgaggttacacactgctccccttcgagtgagctgcaaaggctgctccaaattgggcccaaagcacagaaaatggtgctctggcttcacagttgtgattttgcaaacggcgtgtgtgatcactgcacaacccaacagagatgcccaacttggtgcccagctgcagctcacccagggccccttcccacaggacctcacccctccctttcttgcttggttcagttacttcatggtgacagctcacagtgtctcctctctcctggtaaccctctagagctgggtttgctcgtctgagttttccaggcccctggtggtggatggggacagtgaagcagaatgcttaggagcagacacaggtcctgcagacttccctgtggatgggattatggggactccttctgtgggttgttagtttgttttgtggtttctctttctgcacattgggttgactattttcaaacatggtattgttgggcctcaagttccttgagtgtagaaatggggtcataaggcccacctcacctggcttactgtggggatttcgcgagctaggattcttcacctgctgatgcccagtggcccttgccacacaatcactaaagggtagtgaggctgctgctgtgttttaatgtagctgtaggtgtcatctcagcttcagaatcgactcaaacagttcctggtatttagcgatgtgtcacctcccacagggctctgggttttttgttggtgttgttttgtgatataattcacgtagcataacattcatcattttaaactgtaccattcagcggtgcgtagtggatccactaagttgtgcagccttcaccagtaagtccagaacattttcatctcctaaaaaacaaaaccctgaacccgttagcactcccgatcctccctccccaccaacttgcccccgtacctgacagccacgagtctactttttgtctttggattggcctgttctggacatccatataatttagaatcacacaatgtgtggccttttgcgactggcttctttaaggcgtatgtgtgaaagcttcatctgtgttgtagtatgcatccataattcattcctttctatgacaaataatattccaccataaggacgtcctagattccacttccccgtcatcgggtgatgaacatttgggttctttccacttttcaactgccgtgagtcacactgtcatgaacattcatggacaagttttgcatagacacatattttcagttctcttgggtgtacacctaggagaggaattgctgcgtcacatggtacctctgcgtataactttgagaaaaactgccgagtactcttcctcggggctctgtttcagaaggaccctccctgcttagatttgactttttcactagctaaggaaggccattggcagaggccgaggaaaagaggggggtctgatcacctgagatcctgcgcactcacacacaagccttcaggcattccctcccctcagcagcccagactccatcctcacggagagccaccatgccgcctctgccaccctgcatgacccctttccccctcattgtgtctcctttgcccgccggcttctttgcattctctctgctttgaaccatgatacccactctcacccagcgtcctgcgccggctgggagggatcgggtcacagaggtctcgaggggccagtctgcactgggaaagaatacagctgaggctgcacttcccactcatttcaccagtgatctagaaattttctgagccaatgagcagtgtcatttcagagtcctgggggaaggaaactgtctagaagggtgttctcttcagacctgttggtttccttaggaataagtaagtgagtccaagtgaggaaggaacttctcaaccacgtgaacttgagcatatttcttagcttctccaagactcagtttcttcatctgtaaaatgggtttaaacttgcctacctgataaaaggatcaagtgagataccgtgataccatgttcaagggactcaaaaaaatgttcctggtctccccagctgccctccctcctggttaggtaggagtggctcgtacagacactgactttgtagtaggactcacctcccttttttcctttcttcccccttctcaccccttgctctttcctttcaccacttcctctctcctcctgctattgtcttactctgccctcagctcctaccccaaatatgggtattctcatggtgtggacccagggaactgccagttctcaaatcacccgtgtgctcttagggaggcaactcaggccagatcctcttagggcagatcagattatgccctgggtcattttgcagtgcagattcccaggtcacagtggtggcatgcacagccaggcagcatccagcctggcacccgctgggccccagagaacatggactccctggagggggtggcatggtctgtttcgcctgtctgcctccctgggtttcagtttctttcctcgcgagatcctagccaggggctagagctttgagttacactcggatttgaagtcatcccagaggtctgtgctgcaggaggaagcacgggcttccatagcactgtgtcctgggccctgactttgtgcctggcaccgtgcttggctcggagcatgcagagggaaaggacacacacctgctgtgggtccagtgttccagacacaacgtggagtcaagtggctaccagcgaataagggaatgaatggttttccaggctgaagatttcatactgtatcaattattatttttaagtaattttatattccaaaacagataatatggttcatacagaaagtttagaaagcagaaaaacacgaagggacaaaaaccatcatccttatctcctctcagatgagtttcttcaaaagtgcctgtcacttaattcagaaaactaaaaagcaaagacaccaaaatgtgtagctaggaaatactaattatgaagtaacggggctttgttcagagacctgacccttcccttacaatgtcactcagggcatcccatttgagggtaaagctcttggaaaaatccttctctcttcaagagatccagtccacagaaaaagttctctcacaacaagccaagactctgagcctcctgggtgagcccaagctctccaaacaactgacgggcacatgcatatacagaaagacaaacctagctctctgccggggtcccgcggctgccaaatcccttttccagggaggtgtgttattaccacctcttcccactgtttctgtcccaaatatcaaatgagcttaaggcagccttgggaggtggaacctcccagctcaggagcacaggcccagccttcagcgacccctgatgtgccttctctctcgtttccagctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacggtaagagatactcctgccccaggctgctgggagtgtggaaaccttgtacgtgcatgtgtgcagacacacacacacacacacacacacacacacacacacacatttgcactgggcctggcaggggcttgcatgctagccagctggggctatgtagtagccacttctttctgtgaggtagcctttgggcgtgggcaatcagtgagtaggctgagtgccgcctcactgcagtcatgcacacatgcattcactctagatgcattaactgagtatttgctatacgacaggctgtgttctaagccctggcaacatgaactattcagtgctgctctcagagactttgatctggtgaaggaaacaagtaaagccagtgaagcgttacatgggtcatgacggacctctgtacggagggacccagggggacggggcctgatcttttaaaaaccccaatccatctgtgaaatccaaccaagataaagaggccatcccctgggccaaggtttgccttctgtgagaggacatgtacaaaacccccaagccagggcctagaaaagtttggggtaggcatgccccatgcccagttgagtgaatgttccccctctgcttcccagcgttccactaggaatggcctttcactgagattggaaataaagagaggcaggaaaaagagaagtgagataaaaaggtaggaggtgtatgttggctggtctaggttgtgccagtggaggggtcatgaggtgctttaatttttccaagtggtttttgcatgtattatgttcactgatgtatatttctaacttgtggcatgtaatagacactcagtagatatttgatgaattaatacaactagaatgttgttctggcctctttaaaaagcttaggttgctcacctacaatgctatggtaaacatactttaaaaacaaaatccaaatattgtagcacttgctggcttggtgaatggtgttctagaaaaatgatagcatgggaggtcctgaagatcaaaagacaaaatagtgataccagaaagaaaaaaaaaaaacagtgagcggcggggctttggagcagttcttggtgagcatggggtgtagtgcgctaggatgttggtggtatctgtaacacaataatggtgaccaggagcaggcccagaggggcgcccatggaatctggggccagcacaaacctaggtggcttctcagatgaaaatgagactacacagttgggtggcaccagcttctgaagggctggcacccaccttaaacagacaagtctcctggctgagctcagagactttggctcacctggaagcagaggtagaaccttgagcagtacttttcaaaactcagcgtgcatctgaagcacctggtgaactcgttacagtgcaggttctggtgcagcaggcatggcctaggggcatttctaacaagctgccaggctgcttatgctgctggtctgcagaccagactctgaagagcaaatgagccgggctttgagaagcaacacccagggtggcactctggggtccacctcgcccattggtgtcagccaggagaaacactggcatgtctgccaggccgagggagagtctcggcttaacctcaaccagtcttcactgagtttggggaacactgtcccatcccagagcagggacacaggccaggacaagactggacactgtaagggagctttcattttcacctgggagagaaagtggaatgtgaccccatgtatccagaacagaggcctggaaccacacgaatgtacttcaagtcctactcagccaccatcagccccatgacggtgaacaaattacctaacgtctctcagcctcagttttcccatctctaaatgggaataatgtgaaatagttgggaggatgaaatgagacaatttatgaaaagctgctgtgatggaacccaaaaatatctacccagcagtggagtggcagaaacatcatccagacacgtaccttctactggatactaactgaccctccagagacctggcccccatgctgggtgcatctgacaatacagaaaagtaacatgatgaataaccaatacctgaaagtatgccatttatttcttttagaaatacttactaattgccaaccattcagtggcatttcaggccctgtattgagctgtgtatcaaggtgagggcgtcttgacctaagaaatgagggaactcaggctggcacagtgggaaggggcgaaaagagaagatgagagaaaacaggtgctgtgcaatggtggactgtgttgagttgagagcaagtgggaagtgagaatgggaaaagcctggcggagtcttgagtgccacttgaggagtctgtaaataatgaacagtaattgatggttgtggtcaaaaatctttattattatcattgtaatcattattacatctcatatttattgagcatttactatgtactagggaccatgctaagtactataagtatactaattcttttattccttatgaggactctgtgatttgggtttcgttgccctcatattacagatgcaaaagccaggtacagaaaggctcgataactttccccttgtctcttagtcaacaagtggtcagaggtgagacttgaacctaaacagtctgactccagggcagctcttttaaccactatactatacacagaatcccttgagagggttgccaaaaagggagaatggaagctggggccattggcggcatctagctaggaggagagagctgtgacccaggaataaatcaatcttgtagctccaagaaagtcagaggaaaagagatgagagtggggaggtcttcctgaaagaggagacttttgatccaggtcatgaggtgagcgactttatatggcaatacctagggccagtaactgctacatcagggtccccctccgcctcctccaggtggtatcttagcatagccaagtcaatccccagaccctgactcacctagtaatcaggtgaaacagctcccactctaacctggaggagggcaggacaaacacaacgtacagcatttgccgctcctggaacatgcgccctggtgtgaccgggattcctacaggatggctcacatgtgaggcattgccactcctgcgagcggtccctcaccactgatgagcagaacgtggagagataaacccccccagcttccttattcgttgggcaggatactcttaggtatcctctaaaccacgtcccagagtttcccaactagatcgagctctgactgcccacagtgatgatctccgctggccgccttccttccctgcccactctgttcttccagtgcttcctgggatctcctcccacataaactatcgtgcattccaattctagtctcagcctcggcttctggcctaagagagagaggcttccctgcaggcctccagggccctttcctatccaccccaatatgggggtgagtcacccccagtcctcaactggggcccaccctcctaaacacattgtggagacttcttgtacctcccagtcaggcagaaaaacagaaacacgattttatctctagagcgtggcccttcactactgggcatccttccggaggcctgctgcccaccgcggggtggagggcgctctgagccagtctcgcagctgaccgtgctcttcatttgtactatctctccccagatctagctgtgtttttattgtgagccacttaaaatcctttctggaagtcggtggtataaataaataacagcagccataacacattctctgcaagctcttagttccgagttgagcatttttaaaaagagctttttttagacaggcagttgcttccacggcaggaaacttcctgtcatcttcaccagagtggcatccctgtcagatgcctttggaattagtgggcagagaggaataagaaaggcagccaactgcgcatctacagatctttgaaagagtagttcctttttcttccctaattagggtggatttgggacaaatggttgggtccccggagaccgcaggaatggctggaagaggcagaaacatatccccaccacccccacctcaggccagggcagggcactcacccacaatcttcagagctagtatccctgggaaggtttctacccaatgaccctccgccgccataaaaggagagagggtggattccctgtggaaaggtggaaagcaggagagaagctatttatagatgagctttccaaaatagaatcaggactgaaccagaggtaacatcctcgctctgaggacgtgttctccgcttccttagggtgaaccctagtgagtatcatttgggctttagggcctcataaattcaagctcaactcttatccctgctacttaggagtcatgtgactttggaaagttacatcatcatttgcacctcagctccttcatctgtataatgggagttttaaaaacatccacctcctgcctggagggttccatgagaaaaatatatggagcgccttgcacagtttccggcacagaggagtcgtgccgaatgtgcagctctcctcctctccaccccatcataaatgtcttgtcattttttcgagccacatgcccaggttctgtaaactagcgtgggtgtgacagtgggacagatttccaggtggtgtagcccccacccccagctcgtgctgtctgctccgggccgcctctgctcccggcctcccactgctctgccgtgtgcgggccgctcatcaccaggtggggcctggcgggaggtaagctgtcctccgaggggcttgtgaatatgaactatgaagatttaagaagcccttaacctgctcagaaaaatgaccacaaacagaattattaaccacgaaagactttccaggagacataccatagaaaaggaaggctgttttgagcacttgtcatgggtggactcggtgcgctttttggaaactaacatttgccatcaaccagaggagcagaacctggaactcggggagctcgggctgccaggagagatgcatcaggagggatagaaggtcagtgggggccacgaaacccgagttccagtccccactgtcacctcacagctgtctgactttgagccagttgttaacttagtgagcctcagtttcttgctagtaaacacacctgtgctgccagtatcacccagcagcggtccccaaccttcttggcaccagggaccagtttcatggaagagaatttttccatagatgctgggcttggggatagtttcaggatgaaactcatgaaggacaacttagatccctcgcatgcgcactttgcagtagggttcatgttcctatgagaatgtaatgccgccgctgatctgaaggaggtggagttctggcgataacgctcgctcctggccactcacctcctgccgtgcggcccagttcctagcaggacaccgaccagtacccatccacgacccagggcttggggacccctgacctagaccattctttcatgttgcaacaaacaatgactgcatacctactgtgttagtttcctagggctgctggaacaaaataatacaaactgggtggcttgagacaacattatttgatcgcatttctggaagctagaagtccaaaatcaaggtgtgtgcatggccacgctgtctctgacagctctgggagagagccctttcttgcctcttgtagcttctggcgtggaaggcagtgcttgtagttgcatgacaccaatcctccgtcttctcatggtcatcttctccctgtgtttcttcacatcgtcttctctctatgcatgtcaacctctgtccagatttccacatttttttttataagggcaccaagtcatactggattagggcccaccctaattacctcattttaacttgattacccctataaagacactattttcaaatagcgtcacattctgacatactcgggctaggatttcaacacatctttttgaggaacacagtttaacccgtaacaaacagtaacacctagtgagtgcagaactggagtgcatggatgttacctttccatgcttgccgctctctgcaaagtctagctggagatcaaattttgtcacaagtgttgtgagtatttagaaacctctggcagcacacataagtcctgatcttttgaagaaaaatgttctgtaggcactgtgctaagtacccacattcttcctcagtgatggaataagggaaagacgttcccagcaaaagcaatagcatgaacacggcacagggtttcacagggatggggctgggtgggagggaggcagagctaagtttgaggaggtaggtcagggctagcttcctaggggctttgggtgctgggataaggtgtgtgaacattagccctagggagccaagggaagtttctagtcatgagaaaaagcagttcgaagaaggtggtgcctagctgctgtgtctggctggaaggcttcggcagggacacagggcagggcttttgatctttctcagatatgccctgcagctccagaaggcattcgtggccccttccagcagctgggaccactccagaattctagcatttcttggacatcctctagggccttggactatacccaccaccccacccctgcactcgaccaaggccccagatctctgaaccccaggagtgaaggggctgcagatggatagatggtcctttccaaggtcatgtcccagctcaggaatcttagacgatggtggtccaggagcacgcctgaaacgtgacctccaggggaatcctgcggcatcactcttgctttttagccaggctgctaggaaatactcgaaagattctagagaccctccctacctgccctctcccattgccctttgctcgaagccctctctagccacaggctgcaccatgcctttaagatcacgccctcctgtctacccagagctacagggtggctgccaagctgccttctccccacctgttggaggcatctggtcctaaggaaaatgctgcaggcgtgttgggggccttctcctctcttctcttctgttgggggcagacgttcccgaagccatgctctcatagtgcctagataatgtgtgtattgaccacaaagagatgttggccggcacataacattctcttcatagctgtgctggagctcttgtagccacctgatggaagcatccagagattccaataaggagggagatcacagatgcaaccacaggctttaggagtcaggaagttctaaccagaaagtagaaatatgtgaggaaccagtagggagggggtgacgtggtgcactggtgggaagcctaaacaccccaacccaactgtgtgggtgaatcccacaccctccggttcgcccgcgggatcttgcacaaatgattgcacttctgtgggccttcgcttcctcatcagccaaatggggaccataatggtgcctaccgcatgggggcgctgtgaaaagtaaagagagtcggtgatcgttaagcatgtagaacagtgcctggcacgaggcaagccctagaaaaaggggtggttacatgcaaaaacatacaaaatgcaggaattgaatgtgggtgacagggatggtctgcaaattgaacttgaaaggacatcagtctccaggatggtggaaggatttcaggcctaaggaagaaggaggcacttccatggatatacccaacattgccacagaattttaattctttatttctttaatgaaaatttacatttccttcttaactttgaaaaaaaagccagaacgcttgaacaaaccactgtaatacccaggagctgcctccagtgggatttaaagatgctggtgattccactttcctttatgggtcttgttctgaaagtcctgccagtccaggaaggcagcccgttgcagcagagaaccaaaccagcagaagaaagggatccatttgcgtggcaaaacttgccatttaattggatttcatagtagggttgggcttttctgctgcttaagatggccctggggggccatgggcgcgaccctccatatatgggccaccacgcggcatcctggggaggcgctgcagctcctgtagcccctgccgaagaggggacctcctctggaagccctggccagactctcagtcggcagcagatggaggagagccccttgcccttctggcttggctgttttcctcatcagcctgcctcatactcacagcaagggtcactcctcaccaccccactttctgcttctccttctctgttggttttcctccctgcacactcagaaatgctgctgaaaatccacgcttcgctggtgctccccacagccgccttcattaccaacccaagcaggccagggctctccatttgccgcagctggaagataatatataagccatttgaagcctcatgcctatgaatccagcagccagtataataaaacaccaggttattttgtgttttattaactgcctcttcccttcagtttgcataatagtgagttagatttacatgccgttaagacggctgtgcattatttttaatagaaggtacgacaggctcctctctctcagccctggcgcgtgataaagttacctcatgcaatgttgatgaaggtttcgttcacacttgctgggtcggggcaatgtctttttttccagatggatactctattgtaaaatgatttccctccataagcttgactctccgtccctctcttccgtgtcatcttcctacgaaccggataaactgcctattaaatttaattacggcccaaatggccacacatcttgatctcatgttccctcaagtgtactgtataccaccaaggtccttgaggaaggaataaaataaatctggaggatgcatgtctactctccacaaggaacgtcgtggaaggcaaagttgaccaccttcgtttttacagtgtctgtggcacctcgtgcaaactcttctttctggctttccatgcagacgttcaaagcaagagctagttttattcacttcctgtagactgattttaactgaggtggggaactaaagatatcagtttgagaaacacagtacctctcctgagctgtttacatttgtcagagaaccaaacgtcagccttttgttggatagtaaattacaaatatctcatcattttatctgtaaatatcttaatatgtattctaaatgaaagaagctcctgcaaacgaaagtaaagcatcagtgccattattaccatcctaaaataaaatgatctctaacacctaatagctcatatttctggttttctcatatatatcaccacctctttacagtttattttttgaattaaaatttagataaggtttacaccatgcaattggttgtcagttttctcagtatcttaagtcaggtttattgcagtatattttacataatgtaatttttatcttttttaaaggtatagtttgatgagtgtgataaaagtatacagtcacataacctgactccagtcaagatgtagaatatttccattgctccagagagtttccttgtgcacctgtggtcagtccccacctgccttcccgctcctggaaaaccactgaactgttctcaatcactatagttttgccttttccagaacgtcatataaatggaatcgttttgagtatgggcgttttatgtctgccttctttggtttagcatgcttccaaggtttatccatgttgtagcatgtattacagtttccttccttattaacgctacctagcattttcattgcaaagttgtaatcacaatttatttatccacccatcagttaatgagcatttgggttgagttgctttcaatctatagatttctctctccacttgtttttctctcttgcaatgttcttattgaagaaaccagttcattggttttgtggattttctggcattctggatgttgatagctgtacccactttgtgtagtttaccgtgtccctggatttcctgaggttatctagagtctcagtcagattcaagtttgatttctggccagaatatttcatgggtggtggtgtgtttttccatcaggacatcagcatgacaggtggcgtgtttttaagagattaacaagtactgatggtcaatgcttagagccattcattcatcagagttagaaaatggtgactcctcattcctttcttgtttgttagctggataactgcatacagagatacttcctctcctctgttacttgattatccagtggtacaggcataagattttaagtgttttaaaaggatgaatccgaccggacacagtggctcacgcctgtaatcccagcactttgggaggccgaggcgggtgaatcatgaggtcaggagatcgagaccatcctggctaacacggtgaaaccctggctctgctaaaaatacaaaaggttagctgggcatggtggcacacgcctgtaatcccagctacttgggaagctgaggcaggagaatcgtttgaacccgggaggtggaggttgcagtgagctgagatcgtgctactgcactccagcctgggtgacagagcgagactccgtctcacacacacaaaaaaaggatgaatccaggctaaaaaaaatgtagctgtcccaccaacaacctgcctgctcaaggctgacatgtcaccccctctaattggaaacacattgaatttctcccctcctatagagcttcccggaaactgtatctgatgacattttctctctctcctagaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctggtatgtgcctttttgagctctcaatgggtctggggagggagagagggcaccgtggaggggagggaggggaccaagagacattgaagatctccagaggaggttttgagtttcgactctagcactcacctgacttagtaggtggactcacctagcctctggctccttatctgtgaaatgggctgaattcccatccctcaggctcactgaggtctgcgaggctcaaatgggctgaggttggcaaactctacaggtgaatgctggtctgtttctaagtttaccccagaccccctgattttacaagaaacaaaatcatcacatatgctctcaggacccctggcacctgtaagttactgagtaatcattgccactcttcctcaggtctgtttagcaaacaggacacataaacattcaagcttcctgtgcgaccaccacacacggggacctctctcctcctaagtgggagtgcgttcgtgtgcttaattatagtaactgtatttgctttgcagaatggtttatacccaaagctatgagagacctaataaaaaagcaatgtttttatagcacttcaaaagctgattttactttccctatgttctgatgcatccctggaggccagtcccccatcccactttctccatgggcctccctgcgtacatacgtctaatgggagctgctcccatccaaggaaacagtcccagcctgaagcccccaccagggaaagagagggtggacttccagcctgtggaagacaaagtgtgctgacccccttaccctctttaaggctctagaagcagtagcgtgagcagggcagggagcgaaggggcatcagggatcccctttttacaggtgaggaaactgaggcccacagacgtgctatgactgaatatttgcatcctcccaaaatgtatatgttgaagccttaattcccaatgtgatggtattaggaggtggggtctttgggcgggggcgattaggtttaggtgaggttacagggtggagccccaagatggaatcagtgcccttatgaggagatgaagccaccagagctccctttctctttcttgtgaggatatagcaggaaggcagctgtgacctaagatgagagccctcaccaagaacccagccatgccagctccctgacctcagacttccagcctctagacctaggagaagcaaatgttgttgtttaaggggccaggtctctgttacagtagcctgaactaagacaggagggcagggatcttcccaaggtcacagatgggggtggtgcaagatcggggtggagtggggtatacggccagagtggtactgggctacctccaggcctaacaggatgtaaaagaggatatgaagcataaacaggagcccttagggatagcagagatgagagagttgtgggccacagtgagctagaccaccagagagtaacagagacaatgtgggcgaatcaataatgatgttaacaatgagctattagaataatgaatgaaaattactgggccttttaatgctttcctgacaagaacttaaaatgtaacactcagtagaatttcccctaaacctcataacacttccaagatattagcagagactggagttaccaccacagtgtctgagtggtctgtgaggtgactcacagcaaatcaagtccacagcaagcaatgctgtgtcattctgacagccctgcatcacgcagccacccagcagggcctggagccttcccaggcctcaggctctgaccttgaccttctgcttgtttcttaatccttcttttgtctagttgccagatgatgacagtttgtgatactcagccccaacatatggagtgagaggtatgctttgagatcctccgggaaagtgtcttatttctgcacagccacacacttagtgatcagggtgcagtctccacaagatttaaatccccttcctcaatttagaaatccccttcctgcctccagcacctctcttcccacatctcagcttacactgaatcctgcagcactcttccagccccatggatccaagcattagccattagccccttggtagagtcagtagaacagaaaccaatttttgtgaccttggtgaagttatttaacttctctaagcctctgtttacctatgtacaaaatagaaatgcaaatcaacaaggcattaaataaggtaattacttaaatgggattaaatacattaacagctgtaatacctagcacgtagtaggtacttagccaatgatgttgatgacaaggccaaagctgggttaacgtgggcaatttcagccctgtggtgggaatcaggaaactttcaaccactccttcctgggccatgggggtgaggagtctgggttggggtgcaataggccagggaggaaaatgtcccgatagttaaagggcaaagacctccaatcataccagacaaagttcgaaggaatacccatttggccctaggcaagagcttgtttccaagaatttgtagcaaaggcaattaatcacaagatcctgaaagtacgcaagttcaaagagcatattttgaatgagaatattaactggcagagctgtttagaagaatcttcttatctaagtcattgatatatggatagagtgggacagagtaaccaggcggatggacagacagacagacccaggctgaggttattctcagaccctagaaaggaaacccaggctgtctcaagggtcaccagccctgattgagtaccgcctgttcagagccacgtgtctcgtgttgtgtgtggtctctcaacaagacaaggtaatgcttccaactgcacgcctgccagggctggcactttcacaggaagatgcggtcagctgcgggacacgcagccgaggctctccaggaagggttgattcagaatcatgaggtgagagccctcataatacaggcagatggggatggaaggcctcacctgtcctgcccttgctcaccttccaggggaatttcccatcctagcctttgctcggtggggaccatttagtgggcagcccacagccgggcttccttcacgaggttgggtccagaagattctgaggccacactttgagtttcatgttttcccacaggagccaagtagccaaaaatgtctctattaagacaggcagcctcttcataaccactgcagatgggttttttatgtttctttcttcactcaagagttggtagcatcctagggctgtgttcaggcaagtgagggagccccggagcaggagtgaccccttcacctggctctgcccccatgtttccttctcgttcaatctcctttatgccttttcttccactctctctcacctgcctcttctcctctgcacgtaattaggatcaagtctctctcaacttaaaataaaaatcgtaaaaacaaaccttgaggtggtcagacttcggtttctctgcctcttctctccctccacccctcttccctccctcccatccttctcttcttccttccgcaaatatctgttgatgacctactgtgtgccgcgcactattctaggctctgaggaggcagcagagggaaccaagctaaaaccccagccctcatggagccgaccttctcctggtggggggacacagacagtaagcaagcagatacgtggattagacagcgtcttacatgcaacagaggagaacagaagcagaatcagggatggagcacaacaaaggagggctggggcttgtttctgtagctcagacacaggtggcatttgaagaaacctgaatgaagaaacaatttcccagtgtttcccagaaagagccaggcccaagaaaagacactgatgggaggggtgtgtgagtcgtggggagcctagagagagtggagttcaaaggccctggggcagaggaagccccggcaggttggaggaagtgagtgtgcctggaagggagtgagccagcgggggcgagaccttagatcctggagtggggcctgtgatcgtgcacagattctccttcttggtatcctatagagtcactgggttttgagcagaggtgtaccacggtctgacttttggtttaaacgtttgctctgtcttgtcatgtagcactgcgtcaatattggttgaagtcatgattctcacatgtatttactgagcacttacctcgtggatgtgagatggcagagtggagggtccctgccctgttggactctacagtcaactccaaccccgcctggcctgcccctacttttgccacagtatttatctcctcccctcaccctccgcccccaccccactgcacgcaatcctggctccacatagatcctgctttccttcagcttgccccagctgttgaatgtgggctctgaaactagcttgcctgggttcaaaatctggctctgctgcttactagctgtgtgaccttgggaaagttacttccctctctgagcctcagttgcctcgtatttacaatgaagatggcaatagaagcttcctttcaggctctagaaagcatgaaatgaagtagcacgtagagcttggaacagtgtgtggcaccctacaggcctcagttatgttcggtattattgttaagtcgcactatgccctcaggggtcctgttattgtccacattttgcaggtgaggcagctgaggcccaaggggaaggcaaagacccatagagctccctggaagagtttccagcctctggataaaggagggcaaaattgcttttgcaaaatagaaaaccttgaacaaattttcggatgagaaaatgacttgctttgccagggtttgtttaaagactgtggtggagaattcattaagtgctgtattttttacaatgaaattaaaccatgtgggaacacagcaagggataatgattcacttgtgattctgaagacagggttttcatatcagccccgtgggcaaatgatggggaaagctggtatgccacagtgatgcgtgggtggtgcaaccaggccactcagcagaagcagcgagagggtccttccttcctggacaggggctcatgccatcttgcctctgccggggttgcccttgtaaaagagccactgcctatgtttctcaaagctggaacttcagaagcgggactgattgtatttgtcaacacaggaggaagctcagagaggggaagtgactttccccaggtcgcgcagctagtaaacagtggagccagatgttgaacccaggcaagctgccttcagagcccacattcaacaggttgggcaagctgaaggggagcagggtcagtgtggagccaggactgggtgggcaggatgggtgaaggaggtaaatactgttgtaaaactgggggcaggccaggcggggttgaagagcttgactggaaattctagccgcccatctggcccaactcacaagggcgcctctctctgctatatcacctcgtggcactgcctcgagcctcagtcaagctctttcctgactcagagcctttttacatcccattccgtctgtctaggttacccaccctcttctcctcatgttcttcctggcctattcctcatctcagctgaaatgccatctcttcagaaaagccttctccgaccagccacccgattcctccctcacactgcaggtctgtcccaagctcttaaggcatagcgtaatgacaggtgcatttcccaaaagcttctcccccagtctgttgtctcagtgagagtaggaaccatcttagggttggtcgccgtggcagggttccaggctcgaaagggggatttagtgaatatttgtgaatggatgaatgagcaaatgaattaaaagtcaaaattcaaatcccagcatatatgctgcttttggaatatcacgcctgttaaggcttcaagatttaatgtctttccctacaagacacacggcttcctgagtcctgccacccactgcccttactgcccccaaggaaaatattcccatgccagtcacagcagcaccctccttctggtgacgcaaaagtgacggcctgtgtgacttcaaaatgtgatttgtggctccttgacgccctggagactgtgcagctgtatagccatggagggccgttcccatgtgaacctgtccctccctctccccttcctggggactcagtagagacaagagcccaggctggtggggagcgagctctgggcttaaagacccacagcctgagctcaggcttcagcgttgcgcctgggcgtctgtgccatcacgaggaggccctgggtctctcctagcctcagcttacccacctgtagatgtggcacgattaccccatgaggcaccaggaattgctgtggggtagccagtgtagcggttaagagggtgggctttgcagtccaactccctggattcaaatcccagctctgccatttaggagctgagtgaacttagggaagctaactgacctctctaagcctcagtttcctcaccaattgaataagtagaatagtagctcctccccattcaggttgctggaataaagaattgagttaattagttcctggcacatagtaagtgttcctttaaataagctgtaatcatcagtcttgagtaagcctaggctgcctttatgaagtgtggtgtctgagctgctaggcaatagcacctggggctgtgctgtctagttcagcagctgcgaggcagctgtggctcatgagcaccttgaaatgtgcctggtgtgaagtgtgtattgcaaaataaacagtcttttaaagacttagtatttaaacatgtataatatctccttaatgatttttttgtattgattacatgttgaaacaaaaataatttggatatcttaagttaaaatagattattaaaataattccatctatttctcttaacattgcaaaacaatggctgctagagtactggtctgcaaaacagagacagtaacggtaacaaggaactcctgctgcttctaacatctgtattttctcctcggttaaggcaggctggctacaggtcccattggggaaaacattttgttcccatgagctcatcacaacaggcactatatgcgctgcgtgtgtctttgttattagtatcaccacttaaacattgttactagtatcactacctaaacattcccacaggcatatggggataaattgtcgaatcagatcaggatctgcccacatgttgccaaacacaatcagtgtagagtgaccaagatggttgagcaacctgagctttctcctttgcctgaaaactgggcaaccccttgatgcctccctctgaggtttacaagatagaagagagtctgatgaaggaattcagtttattcattcaataaatattcattaaccacctgctgtatggaggacattgttctagatattaaagacacaacagagagcaagacaggtaaagagcggtctcattctcagagctcatattctagaagggagataggccaggaaactcagatggtgacaactgctatgaagaaaagaaaacagggtggtggtttgcattgtgaaatactacacagcagtgaaaaagaatgaactattgctgtgtacactcatatgggtgaatcacacagagaatattgagtgaataaaagcggacacaaaagagaatattctgtatgattccattgatctgaagttcaagaacttgcaaaactaacttgtaggaatataggtcaaataatggttacttctgaggaagaggtttgattaggagaagtcaaaggagccggtaggtgctggaaatattcatatcttgatctaggtagtagttgcacagatacatggttagggagaatgccttaagctgtactcgagatttgtgtgcagctccaggcatgtgtgctatattcattatctattgcagtgtaacaaaataccacaaaacttagcagcttaaaacataagcattattatctcccgtagtcacagtgggtcaggaatctggtactgacttcattgggtggttctggctcggtatctgtcatgaaatagcaatcaagaccccggccagagctgcagtcatctaaagaattccagaggctggaagctctccgcctccacaatcgctcatcacatttgtctaggaatttagtgctggttattgatgggaggactcagtttcttcctctgtggacctgtccgtggggctggttaactgtcctcttgaaatgtcagctagcttccccagagcaagagattcaagagacagcaagcaagaaggaagtgacaatgctttttgtgacctagtttcagaagtcacacaccatcactttcaccatattctatttgttaaaagcaaatcattaagtccaggccacactcaaggggagaggaattaagctccaccccttaaagggagtaggatcaaagaatttgcacacatatttttaaaccaccacacgttatacctcagttttaaaacaatgttatttcttattccaaaaaccaaaagggtggtgggatagaaaataatgggttttaggaagcattttcactgaggctttagaggaggtgacatttaagctgaactctgagaaaagagccatgtgaagatcagggaaaagcactgaagccagagggaaaagcaagtgcaaacactttgcctcagcagtgagtcatcgaagcttcacaaagaagaccaagatggccagaagttcatgagcaaaggaaaggaggagtagttaaagttggcaaggtagggagaggccactgaggccacagaaagaagtttggattttattctgaaggtgactagaagccatttgaggagttttctcctctgatgaacattttggacaacatgctctggctgctgtggattgaccgcatagtactcgagcaggaatagaaatgaaggatcacttcagaggccctcaccgtaagagaggtgatggcagcttggtggacaagtccctggctctgcctctggggtcccacatcatcagattcttccagggttccattaacaagtgggcctcccccaggacacacactgaacacacactcccatcaaaagcaatagagagatgcacagttgtctttgctgatggcaagaagagaaggctctttttgccctgaggaggatcaactttgaccatcaactggagctttgtgttgtccaacagggccctgctttggttggtgagacagcctggcctaggctatttttacccatctcgtggggcctgcatgccggtctttccagataagatgccttcctttcaaacaaagagtgttttaatcctggagaagtacttggtggttgccactggcatttgattttagtgtgacaaaatgaaacgacttgggttctctccagagacagaaccagccggaagcagtgagaaggatgcctgtttcacatgggggccatcctgtttcaggctggggccggggcagggaagggaggctcctcagataaaagaagacattgagcagtcttccttctcaggccatgtgcgttccctctctggatgtaccagttgtacttggtttcggctttgaactttctaggaagagaggcaacagaacatagtttaaatgactcatcagaatccaaatacattctaacttttgaggaagaaaaccttttcgaatagaatagttagaaacatttgagggctgcagtttggatatggatttctaagtgagttattggcaatttgcaatgtcctaaatcctggtcttttgttcctttccgacaaatctctggattctttcattttttgcaggggacagatctcatgcattcatttcttggcggcatgttaaagctgcaaagatttatttagtacccatttgattccagactagaaacgtatcccaggatttggggcccataaatattgagcatactaactttgttgttgtggtggtggttgttgagacagggtctcactctgtcacccaggctgaagtgcagtggcgtgatcccagctcactgcaacctccccctcccagttcaagagattctccaacctcagcctgcccagcagatgggactacaggtgcgcttcaccaggcctggctaatttttgtactttttggtagggacagatttcaccgtgtgggccaggctggtctcgagttcctgactgcagatgatctatccgccttgccctcccaaagtgctaactttgactgtcacttgataactccctgcacagacagtatttcctaatgtttctccaggtagttgaaggaacatcaggctggggattggaaggcctgtattctaggctctagcaccattgcttgtgtgaccttgggcaccacactttacttcccactttcaggggaaatgtgaggctttatgcccaatgacctctgggttttcttactgctgtgacattgggaatggcttcataccccatcagttaccaagatgaagtgaaacaggtcaaccagttgggaaaccagtggaaatggctgggctagctcagaaaggcccctgggcaagtatctgggaggtgaaaataacgacccatcaaatgaagagagatcatggtagtgttttgagaactactcacattaatgatcaattgctaattcactatgccacttgatcatatagtaggaacattaagaagtttgaggacatgtcctgatttagatatctctctaccacccctcccaatataaaacgaagtttctgtttccaggccacaagctctgcacccctctacagcaggcaggccaacgtgaatagttatgcagttatgtgctgcacaaaagtgcccagtaaggccgatatcgaaatcagtactgggctaaagattatctaaccttagagaggtgtctaggtttgactattggcgtggagagaaaatgaggcagctgtggagcaatggttaaaaccatgggttctagaaaaagctgaaatcaaatcattctactagcttatgtgacctagcataagctattcagatttgtttccccagctaatagtaacaattcatgggttgataggagaaataatatactagtgtttagtatggtacctggtaggtgatcaataaaacattagctattactgtatgttagggatgaagagggcttactcattcagttttcctctcggagttttaaccaataagacactgaagtcagacttttaaaaatatatacaacagaggcgctgctgcaccctcactctataggatgtcctggtgccttcctccttatccacgctggagtcctttgtgtagggagaaggctggctcctaggtcactgccttcttggagatttagagaacccaaaagcatgtgaccattgcagtacaactgtcccatcatggttcatgtggtccagtgggtttgaggctcttgtggatccaccaccagtcagataggactgtcttccccatgggaagtgtcctggtcccaaacccccagtgtttccctgacaagatgagagatttgacagaagtttttcttttaggagacctgatgggaatatgggcaggatggagagggctttactactcctcctaggtagaggtcctgtgtcttcctcagaggccactcctctctgcacatggctgtgtaacaggaataatgcaggcctttctgatcacatctgccctcctgtaggttgacactgaggtggacattcacaggactatacccagtcaaattgaatgccattatctgggaaaaactttcaacttcttcaacctcctgagttattcacttttgtccaggtgggatttacttctctctgtgcttcaagcagctctgaaactttttcagagagaaaagtcaagtatggaaacctggtcagcagagaccctttattgtcggtgcagaaatgtggttctgggtggggaagtgctctgcaatgcacggagctccttaccagcatttaggcttaatagggcagtggaaacatgaaccaggattgagtatctacagaagcaaggcatttttagtttgttttgctctgagtgaggcctagaggcacagggcagtgagcaagagtctccttagtagctagcgccccagggggccaacagggttatgtgtcaagcatacactgggtgggactgggagactctggcagagtgactcaggctttttgcctgtagaaatcctgcctacactttagggttcggttgaaatgctacctctttatggatctgcccttgatttcctcctggctatttctgagctttcctttttctgaactccctagtaccttgctggtttcactcatgtcccttgtattacagctgcctgtgtaaccgtgtgatcagaggcatcatgggagagagagcctaacttgggtttgagtcagattcagttacatgttaactatgtgacattgggcacatcacctaacctttctgagccttaagtccttcatttgtaaaataagaataatattcactttaccaagctgtttgaaagattgaatgtagggtatgtacaaaacttgatatatactatgcatttaataaattgtcatttattgcagactgtaagctcttaaaaaatagaatcttattcatctttttttttttttatctccagcacctggcacagtgcctgggacataattaggcactcagtaaatgtttatttgagtcaagtaatgaattacttttaaaaagatatttctcaaaatttcttatgtcctgtttagtgtttcctaaaaaactttagcccctgggttttgacttctgtagtctcttaatgaaagagctaaagaagacattcaacatgtgaaagggggacagactgccccaagagctccttggaaatcttcatgttatttcctgcttacatctgattgatgatttcaggacaggatggcttagaacatccatcaatttttttttccttccagattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggaggtaccaactatgtagaaaagcctcatgaaattccatgaagaacagtttatacttgtaatttgtgaaaaattcctcatttcccttttggagttgttttacatgggaaaacatgtgaataaagccaggcatacatgcctggtttcattgtatttttccatgttgttacaaattaactaatggtatttgggatccttctgctcagaaagaaatcccaaaaagctattactccaattgccacagattttttttcttaaaggcaggatcacactattataaaatgaattgtctggggacatttgaatgatgacaagggacttgtatgtgctgtttgttatctagtgggtaggcatacaagtatttggctgggccctcccaccaacccttgcaggactgggataaaatttagctttcttctttgtagtgacccctactggcctataggaggctgaatcgtaagtggttaaaaagtaatggttttaattaaggagcagatttattttatgctaaaataaccatcctgctcaagatttgttttaattcagtttggtagtgacaccttctggtcaaaggaggtaattctttccctgggacaaaagcaaccaggcatcaaaatgtttatactaccaagggggggcagtttttttttgtttttcaagtatcactgcttaaagcaactgcataagtctgcaaatttgtgtatgtaattgaattaccaaattaatgaactcataacagtaggaataaggaaacaaggaagaggggaaaagggcataaatcctgattttgtttaatactttattcctggtatccagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtatgtcttcgtgctctcagtactgtagtcacacagtggacttgagggccttaccaggttgtgttgctttattcaattcaggatgtttaatggctgcttttaaagtcttggaactcatttctcattgaaatcaaaaggaaatactatccctcccccctctaaaaaaaaaaaaaaaacacctcaaatcttaccctattcaattatcttaacgattgagagctttaaaattcatgactgattagaaaaacattgttttcaagagaatgtactaaaacaggctaattctctaggttcatacatttaattccagctttctacacatctctggtttatgttaccttgactccagtttttcttgaatatctaaacctttgttaagtttctctcaatcactttagccattgctcttttgtatataggcagattttcttctgcacacttctaagcaaaggaattcttgcctaagaggtatattctttgcctagtgattttctgtttatgtagcaactcaagcaattaatagaggtgcctagatccatatcacagttgagtgtttaacagtaaggtttttctatgtagagagacaactcagcagctatccctggtaccaaatgggctattgtcattctcctttccccatcagactacttactctgtctctgaagatgtttgctagccaaggaataaactctgtatttcagaaagtgcttaaaagcacagggaacttgtttgacaagcagtcttaactcgagctccttctaagaggtctcctagatgagcattctgaattcatccttgcatggaattaagagtagaagtaaacagcagataccagtgtggttgtgaatacggtatctttgatttttaaaaatgaggctgtttaacataatactatcattctgtatagatgactagactagtgatatctaatagaatttactgcaattacagaaataatctgtactgtccagttcagtagccaccagacacaagaggttctcgagcacttgaagtgtggcttatgcaactgaggcactgtttttctcattttatttaacaaatttaaatttagctacctagtgggtattgtactggacagagtgctgctaaatctagttgtcaatagtcactgcacatcgtgaactcctctgtttgtgggtaactgccatcaacctgtctttttcaagatacacttctttcatcaggaacttctctttgtaaattgttatttcctgaaactaagacatcatatttaaacgtcaccatatctcagctgcttttccacaaagtaaaaatgttttaatggtgtaaaataaggatagcctctgggaggcattgtttgcataattttctgttatcaaaaggagcaattgtatcagttattgcttgcataaaagacgaatgaagttctagcagatcataaaaagaccctctctatcaacatactatgagtctgagctggttgagaacccaatctaactaactttgcaataaactaacacatgatttttggtggatgcagttcccattccaaatacatttatctttctttgtatttatgagtgtgatagtaatcgatagatctttttcaacaaaaagccacctgatatctacatttcataattcctaagcaagaatcttaggaaacacctctgttaaaatatatgaaaattggtccctggttatctgtcatagcttaactccttatcttaaccatatttccattatctcttttgaaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaggtgtgtgggagcttttactacacctttatcttcagtaaagagacagagaacacagttccatttttaatgtttaaatttcatttcaaaaagcaggtctgtagtttgtaaccatgacaattaaaatctgtgctaatgcacggcagtctataacaattctacaagccaatcagacagtacgtgacatttcaatgagtaaaaaagagcataaaactgtatgtgtaagaacaaaatgttaaaaggcctaccacaataataaaaaaccgtcaattacatcatcacattaaaataagccagatgtacaaaagtctgagacagagaagacaaaaggacaacacaagatatttgttgaaaaatgtttgtgctctttgggcacttaattaaacattgcaaaatcaacatcatcttcttcttcatcagactctgcaaaatattttacttctttcctagcccgaccggttcgtggcagagaaggtggctcagtagggaagtctgaggggaagatgtccacatctgaatcctgatcaaaagatgtcttcttcggtttctagattttttttcaatagatttaaaagttatgaaaggaagtaaagactagtattaagaactatcactccttaaacttcgcttatgtttaggaagtattacaaataatggtgcttttaaaattagaatcataatgctaacctaagtgtaagaccagttatcttattttttggaggaaaaagattacatacagtaattcaccaccttggtggtttcatatttaccaagttctagcctgaaaaatgtaacacctttatttctgaaattatatattacccaaaaagtatgcacaatgcccagattagtaaaaattcaagctgtcctactggtaagtacatatcaagaattcatgggaggaaacaagactcctgcaccgtgtgtagtatgtgtgcactgtaagtgtttaaaaaaatgcaaagcatcaccgaggtggacctgagacatagaagatgactgaatggaagaggtcaatgtggaaatcaacataaaaagggatgcgggggagctgatgtcattcatttacctaaaagaaatagtgtacttctggaaaagggtcagactaattggaaaaatcagccacagtcaaatgaattcaattaaaaaaaaaatcaaattagccctggtcaaataaatccaagttaaaaggaaacagtctttagtctgaaaaataatattttagtctgaaagagtctaatatttaggtagcataacactactacagttcagtggatgaaatggaaggttctaagtaggttaatttatagcacagttatttaggaaatagtcctgattatataaatttatacttgaataatttcttaaccaaatacaagccccatattgatacgagatgctaggtggaaagctgttccaggactatagtcataagcaaactaagtcacttacagatctttttttaaaaagccatgcactaatatgcaatgatgttcccggttaccttgcttgttgttttggatgttttcctgccagggttataatcgccttcattttcagagccagatgctttccttttctttgcccctcggcctttaccttaaaatgatacaaaaggttttttcttccgtggttaagtgcaatataaaaagataaatgccacaacattgtagtttatttctttggcatgcccaatcagtggagcattgcagtcctgatctcttactatgagtgattataaacaatttggcagtagcatttcaattctggggttgacatgaccaaagactttttgacaaatacatttaaactagtgggaaagtcccaaagacaaattttaatgatgaatcccttcatacataaaacatttgtatttgctatttggtccttgagcctgaaaaggaaatatcttggaagagtacttcttaaattacatgggatttaaatattttttttcatttctaatttgtcatgggccaatacttttaaaaataccata

SEQ ID NO: 11881 - DNA, 5943 bp, Human
  misc_feature (1)...(5943): n = A,T,C or G
gacatgcaattagacctcctgaactacctctcccaccccctcaaaagaaatgcattgctcccagactaaagcaaggagaaaggctgccagcagctctcttcgtgcaggcaatcctgacatgtcaagaccgcacgagtttcattagtgatgtttaccaaccagacatacacagcccaagcaagcagacattgatggggccttctgtagcgaaagaagccctgtcaacaatgcaagctccttaggtaacagaaatacgattttcctaaataagtacacgaacttcttttcccatatttcagaaaccaaggtggcaaattatggctttagatcacagcaaaaaaggagtgggggaaaagctcaaaagttaaagacgacaaaaatctccttattttcttgagagggctctctcaggtatattaaactaccttgtcatgatgagtatcagagggctcctgcttccaagaccaggtagctgaaaagacactttgtaaaagaggctgctcaaactgtgtctaagatagcaactgcagaaagaactgaagattgaatgccttaatgagaacagagctgtccaagagttctggcacagcatcagtctttttaagatctctggtgggtgggaaaacagaatgaacacagtgagccaacttcagtgcctcaagaaaaaaaaaaagtcttggccgggcacggtggctcacacctgtaatcccagcactttgggaggccgaggcgggcagattacctgaggtcaggagttcgagaacagcgtggccaacgtggtgaaaccctgtctctactaaaaatacaaaattagctgggcatggtggcgcatgcctgtagtcccagctactcaggaggctgaggcaggagaactgcttgaacccagaaggcagaggttgcagtgagcagaggctgcgccactgcactccagcccgggccacaagagtaaaactctgtctcaaaaaaaaaaaaaaaaaaaaaaaagagagacttctgttggggtctggatgctgatctttacataataacttctcccttaagaccctaacacagctgaaggcaaactccaaggaaaggaagagaattaacaagtactgggagctaaaactgtgaaatgggctgtatgaggggctttagtgatgttttcttaattgagtctctcaagccttggaaacaggtaacaaacttcacctgtcatctcatcatctctagatgggattactattagccttctaaatggtctgttccannnnnnnnnnnnnnnnnnnnatggtctgttccacgcttaccctttatacccaatctattctctattcagcaatgttagttcttttttttttttttttttttttttgagatggagtcttgctctgttccccagcctggagtgcagtggtgcgatctcggttcactgcaacctccgctcccgggttcacgccattctcctgcctcagcctcccgagtagctgggactacaggcgcctgccaccatgcccggataatttttttttgtatttttagtagagatggggtttcacagtgttagccaggatggtctcaatctcctgacctcatgatccgcccgcctcggcctcccaaagtgctgggattacaggcgtaagccaccgtgcctggcccaaacggggtttcaccccatgttggccaggatggtctcgatctcttgacctcgtgttccgcccgccttggcctcccaaagtgctgggattacagacgtgagccaccgcgcccggccaattctgttaactgaaagtcagagcagcttaaatatctctaatgactttccatctaagaataaaatacaaaatcctaacatggaccccaaggccctccatgatctattactactggttctctgacctcaccttctgacctaccctgccctctcttgctgacttacttccagccaccatggtctcaccatggtttccctgcagttccttcaacgagccaaacacgctaccgctttaggactttgtccttaccattccctctgcctggaatgttcttgccccagatgtctacttatttttctagctccctcacttcattcaggtttctgcttaaatgtcacttcttaaggggagggcttctttgacctccatgtctaaaacagtatccttatttccctcatttttttcttttaaaatctatcctgagaccctgaactcaacaattcctcccacacaattaaccccaggcacgtggcccttcctgttgttaactcctctatttccctcactttttaccaccatcattaccacctgttttacgtccatctctctccaccccactaggatataaactcagtaagaacagacccttggttcgttttgttcattattatatctagaaaagcatcatctactaacacttacgaggctctccataagtaactgttgaccatataaaaggcagattgttattaattttttgaggttgtcatttaatctacatatgtcaatctattaatgatggcagagcccaggactgaaacctagatttgacttttcccaaagcctgtggctcactcttcaactccaggttctatcagtttcctttttcttcagacagcctatcagccaggctggagtgcagcagtgccatcttggctcactgcaacctccacctcccacgttcaagcgattctcctgcctcagcctcccaagcagctgggattacaggtatgcaccaccatgcccagctaatatttttttttttttttttgagacagagtcttgctctctcacccaggctggagtgcggtggcgccttctcggcggctacaatgctccgcctcctgggttcccgccattctcctgcctcagcctccagagtagctgggactacaggcgcccgccatcatgcccggctaattttttgtatttttagtagagacagggtttcactgtgttagccaggatggtcatgatctcctgaccccgtgatctgcccgcctcagcctcccaaagtgctgggattacggcgtgaaccacagtgttgggccatatcagtttccattttgaatagtacattcagaaggttctaagggtcacaatgtctatgattaagaggcaattatatatatatatgtgtgtgtgtataaatatgtgtgtgtatatatatgtgtgtgtatatatatatattttttctttttttttttttaaaggagagggtgcaatgatgctccctagctagtaagagtcccatcttggccttctaagggaaagataggtaaatgaaaagactgctaaatccaaggtcagacagcatatagaaggctttataaaagaacaggaaaactcagaacactaaataagagagtgctttcttggactctgcagttggcctcaatcatcggatctggaatattactttttacgattttggaagccgatacacacctgtaagtaataactgaggaaggtagagtatgattagtctttttacctttcagtgtgtatcaatgttaagtgaacaagagcaaaaggaaaaccatatatttagtattttgcaacatatataaaataacaacactggctgggcgtggtggctcaagcctgtaatcccagcactttgggaggccgaggcagggggatcacaaggtcaggagtttgagaccagcctggccaacatagtgaaaccccgtctctactcaaaatacaaaaaattagtcgggcgtggtgatgggcacctgtaatcctagctactcgggaggctgaggcatgatgatcgcttgaacctgggaggcagaggttgtcgtgagctgagattttgccactgcacaccagcccgggaaacagtgcgagactccgtcttaacatgaaaaacatgaacagccgctactatctgagggcaattttttgtctttatactttggcatgtatattatttctacaaataattttaaaggccaggtgcggtggctcacgcctgtaatctcagcactttgggaggccgaggtgggcggatcacgaggtcaggagatcgagactatcctggctaacacagtgaaaccctgtctctactaaaaaatacaaaaaattagccaggtgtttggtggcgggcacctgcagtcccagctactcaggagtctgaggcaggagaatggcatgaacccgggaggcggagcttgcagtgagccaagatggcgccactgagctccagcctgggcaacagagcgagactatgtctcaaaatagtaataataataattttaaaataagggggaaaaaatcactgataaaccaaaaacctcaaccttaagaaacgttcacatctgtatagctaatactctgacgatggggatacaaaaacaccttcactcagtggtcttgcagatatcatttttttcccagtattttttggaaagaaccaatctttgtctttttttctccttcttcagggaactttatgaatccagaaagagccaacgtttgaatgattactgcaatctcacatctattaaatcctgatacctgcaaccaagagatgagtaggagatgtggatcctaagaggtgacctgtaacatactgcccctcaaaccacatctttggatttcaatagaaagaacagagagaggccggtcgcggtggctcatgcctgtaatcccagcactttgggaggccgaggcgggcggatcacgaggtcaagagatcgagaccatcctggctaacacagtgaaaccccatctctactaaaaaaaaaatacaaaaaaaaaaaaaaaagaacagagagaattaaaccagctagggccacacgcggtggctcatgtctataatcccagcactttgggaggccaaggtgggcagatcacaaggtcaggagttcgagaccagcctggccaatatggtgaaaccccatctctactaaaaatagaaaaattagctgggcatggcggtgggcacctgtagtcccacctactcaggaggctgaggcagaagaatcgcttgaactggggaggcggaggctgcagtgagccgagatcgcgccactgcactccagcctcggcgacagagcgagactctgtctcaaaacaaaacaaaagaaaaaacagctaaactatggcaaagaggcattaatgaatttattgatagcaaacaaagaagtaaagataagaggtgaattcagcagactccagaaagtcaacttttggtttgggcaggaaggagtgaaccagtaagaaacagagcttgaggtcctccgtgattacagtcccaagaagaaacttccacaagtctagaatactctagagctctcactggcatgaaatgaactgctaagattacagtccataatttgtgatccttgctttaagaattctgggatccagggcaggtgcggtggctcatgcctgtaatccccagcactttgggaggccaagacgggtggattacctgaggtcaggagttcaggaccagactggccaacgtggtgaaaccccatctctactaaaaaaaaatacaaaaaattagccgggcgtggtggtgggtgcctgtaatcccagctactcgataggctgagacagaattgcttgaacctgggaggtggaggttgcaatgagcttagatcacatcattgcactccaacctgggcaataagagtgaaactctgtctcaaaaaaaaaaaaaaaaaaaaaaagaattctgggatccaatcaggcacattggctcacgcctgtaatccaagcactttgggaggccaaggtgggaggatcacattaggtcaggagtttgagaccagcctggccaacatggcaaaaccccatctctacgaaaaatacaaaattagccgggcatggtggcatgtgcttgtaatcccagctactcgagaggctgaggcaggagaatcacctgggtccagaaggcggaggttgcagtgagccgagatcatgccactccactccagcctgggcgacacagcga

SEQ ID NO: 11882 - DNA, 8405 bp, Human
tcctgggctcaagcaattctcctgcctcagcctcccaagtagctggaattacaggagcccgccaccactcctggctaacttttggtattttttagtagagacggggtttcactgtgttagccaggatggtctggatctcctgacctcgtgatctgcccacctcagcctcccaaagtgctgggattacaggcatgagcccccgcacccggcctacttctgacagttttatggtgtgtgatataggatataacatgatgtatgaagctctttgtaataatttttaattttgaaatagctgattctttggggatcatttaatacataattccataggtttcagtgaaaaaaaaaaaaaaaagagatctcagggttgggcaaggtgtctcattcttgtaatcccagcaatttaggaggccagggtgggaggattgcttgagcccagaagtttgacatcagcctaggcaacatggcaagaccccatctatacaaaaagtacaaaaaattagcttggcgtggtggtgtgtgcctgtagtcctagctacttgggaggctgaggtgggaggatcacttcagcctgggaggtcaagtctgcaatgaactgagattgctccactacactctagcctgggcaacggagtgagactgcttctcaaaaaaaaaaaaaaaaaaaaaaaagatttgatggaggtgaattattctatggatgtttgttggctagttttctaggaagagggaatggctaatgcaaaagcccccaagtaaagcctgctctggaaaagcagcagagcatcatctgggtagaaagcaagtaagtgaggaggaaaacatctgagatgatcagagtgggcgtgagggacagataggtaagggccttgtaggtactttaggttttagatttttactctgtaggaaacggaaagttttaagcagataaggagatgagctgacttaggtttttttttttttttttttttttttgagatggagtccctctctgtcacccaggctagagtgcaatggtgtgatcttagctcactgcagagctcacagctcccgggttcaagcgattcttctgcctcggcctcctgagtagctgggattacgggcatgcgccaccccacctggctaatttttgtatttttagtagagacggggttttgccatgttggccaggctagtctcgaactcctgacctcaggtgatccacccgcctcgtcctcccgaagtgctgggagtataggcgtgagccaccgcgcccggccaggttttaaaggatccctctgttttggtaggcggaaaaactagagaagacgagagaccattctgaggccgggcgcggcgggtcacgcctgtaatcccagcactttgggaggccgaggcgggcagatcacgaggtcaggagatcgagaccatcctggagaacatgatgaaaccccgtctctactaaaaatacaaaaaaaaaattagccgagcacggtggcgggcgcctgtagtcccagctactccggaggctgaggcaggagaatggcgtgaacccgggaggcggagcttgcagtcagccgagatggcgccactgcgctccagcctgggcgacagagcgacactccgtctcaaaaaaaaaaaaaaaaagagaaaccattctgtttctaagcatgtgcaattatgtctcagctccacgtcataccttttagtttgctgagctcgccaggtggcacagggaaccgggactccgaattcgcagctccagctccagctccagcccagcaggtggcagcagctcagagcaagctcctccaacgcgaggcagcgccttccttcgcgaccctacttaaaggcggctttccgttggctggagtggcagcgatattatccaatggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtataccaggtctgtctggcttctaaaagagcgcgctttatacttttttttttttaaacggagtctcgctctgttgtccaggctggagtgcagtggcttgatcttggcttactgcaacctccgcttcccaggttcaagcgattctcctgcttcagcctcccgagtagctgggattacaggggcgcgacaccacacccagctaatttttgtattttcaatagagacagggattcaccatgttggccaggatggtctcgatctcttgacttcatgatccaccttcctcggcctccctaagtgctaggattacaggtgtgagccaccgcgcccggccgcacattacagttttactccatttttgagaaggtctgaggtcaggaatgactcattgtaaggaagcaagctgttgcatatttaggacctgtcagccaagaaacttaagtgtccaatgacttttggatggcctttgaggtgggtctcccttgcccagaaatgctgactgtactgcgcttaagcaattaggcagcattgtagagcatagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaattttgtaattttttttcctttttgacacagggtctggctgttgcccaggctggagtgtggtggtgtaatcataactcactgcacccttgaactcctgggatcaagggatcctcgtatctcagcctcccaagtagctgggactacaggcacacaccatgacactcagctactaatttttaaattttttttttgtagagatattgcacaagctggtctcaaattcctggcctcaaggaatcctgcctcagcctcccaaagtgctaggattacaggcttgagccaccatgtgcctggcccttaattttgaggtttatagtgccatatgctagaaacgaaagccatggtaaaaccagagctttgtatttaggtgttgatgtttgggtatctaaatgaagctaccaatcaaacatcctatacagttttctagacacagttgtaactattacactagaattactgtttctatggctgctgcatacttggagtaggtttagtgtcagctgagataggcacctggtggatgctggggccagtcccctagagtaaagtttttcaaactgggtggtgctccaactcggtggtaaccaatttatattttcgagatagtctcaaatatatttgagactggggtgcagtggcttggacttggctcactgcaacctccgcctcctgggttcaagtgattctcctgcctcagcctcccaagtagctgcaattaccggaggctgccaccacaccgggctaatttttttgttgttgagacagtctcgtcctgtcacccagactggagtgcaatggtatggtctcagctcactgcaacctctgcctctcgggttcaagcggttctcccacctcagcctccccagtagctgggactacaggcatgtgccaccactcggctaatttttgtacttttagtagagacggggtttcactatgttggccaggctggtctggaactcctgaccttgtgatctgcccgccctgtcctcccgaagcgctggaattatacaagggtgagccaccgcacccggcctttttttttttttttttttttttttggtatttttagtagagacaaggttttgtcatgttgaccaggctggtctggaaatcctaacatcaggttgatctacccacctcagcctcccaaagtgctgggattacaggcgtgagccaccatgcctggccccagtatttaaagagaaagcagcatctgctgagaataggtgtttttgttgtgattcctgtatttcacttagagatctgtctgctggaacatgatatattcattctaactaggtctgtgtcaaaggtttgaaagccactgctaacagggctgacaactaagctgtggagaccctgttccctaaattgcagccacgtctgcacgtagcctcttgccctgtggccttcaaaactcccagcctggggcgtccagcatttccccagggcaggggcctcgttcagttctgaaccttccctgacctccgtatccagccacgtttgctaaccctgtacaagtcatccgccaactgaactacaaactgaggacaaaagactagttcaccgactcttttacctagtttttagttcctgctatctaggaagcaacacttgtttttctaaagaacttagtcatcactcaggaaaggcccacgtagggctggccctgcgggctggaagtgggtcaggggctgcaaggcgggcccatagcgttacaccgcgggctcaccacgttacaagcgctagtctcccacgaggcgcccggggctgaagagcgggccctggggaggaggccttgtggctcgggcgcgggccaactttaagcccgtgatccggctgcccgggctgcagcggccgccgtcctgcccgggggcaccaagcccggggccctgcccccgctggctcccggcctcgccctgccgcgtgggccacgctgtgacccggaagcgttccggaagcggttccggagtcag

SEQ ID NO: 11883 - DNA, 9027 bp, Human
  misc_feature (1)...(9027): n = A,T,C or G
agagacggggtttcaccatgttgtccaggctggtctcgaactcctggcctcaagtgatccatctgccttggcctcccaaagtgctggggatcctcctacctcagccttccgagtagttgggactacaggcatgagctatcaagccgggctaatttttttttatttttagttgagattaggtcttgtaatgttgcccaggctggtatcaaactcctgagctcaagaaaacctcctgccttggcctcttaaagtgctgagattacaggcatgagccaccacctggccaaattaaccatcttaatcatctttttaaaaaagagatggggtctcactatgttgcccaggctggagtcctactcctagcctcaagtgatcctcctgcctctgccttccgaatacctggaactagcggcctgagacacctggcagggctaccttaaccttttttaagtgtagagttcagtagtgttaagtacattcatactattatgaaactaagactttgaatttatcctccaggcaactgagatttatggaattactgaaagatttcaggaccctactagaggtttaggaaggttgtcttggggggtgggtgtagtgggaggtaggggatggaggctagcaggactggaagggattgtaagtttaaaagcttgcagggggccttgtaagtaagggttggttttggcttggtcacagggttttctgccagaggggaagttagagaagggaactcaacacaccactggctgagtaccaagcctgtatgggccagatgctttccgagggctgcacacttgagctagccagccacaccttgccaggatgtgctctgttaacccctacagttaaaaaaaatgggggaggcgggtttggattagttgcaaaaatggaaacatttggagatctcactttttttttttttgacgcagtttcactcttgttggccaggcaatggcgcgatctcggcttcactgcaacttccgccctcctggagctcagattctcgtgcccttcagcctcccgagtagctgggattacaggcacccacccggctaattttttgtatgtttagtagagacggggtttcactatgttggccaggctggtctcgaactcctgagctcaggcgatccgcccgcctcagcctcccaaagtgctgggattacaggcgtgagccaccgcgcccggccaacgccctgctaattttatcattttcttgtaaagacggggtctggctgtgtggcccaggctagtctccaattcctggcttcagttgattcccctgcctcagcctcttaaagtgctgggattacaggtgtgagccaacgagttcggtctcactctattttaaaaaaaccttttaatcaatatataacagacatatagaaaaggacacaaataagcgtagagcttagtgaatgttcacaaagcaacaacacctgagatgaaccagcacccacatcaacaagcagaacgttgctagcatctctggagtgatgctcatttagccctatgaaacctcatgaagccgaccgttttatcacccccatattacgcatgaggaaacaagcgtggagaggtcggtctcaagcaaagccctgttgaaaccggcatttgaatcagatccgctgactgactccaaagccaatgctctcaaaaagcaggtttgggggttagacggtgagttcagctttgaacgatgttgagtgggcgtctcgttttacagaaacttacttcccgacgtcacagccacagaaaccacaggtaaccagacgcctgcacgtcaggccaccgacgccttggtctacacagcgcagcctccagtgagcccgcggcatgccgcgcggcctccccacacacgatggcgatgtcgcaaccacagtagaaagagtggcgctctctactgtcccggaattcttgaggccggaagaataacagggcaaaggtcacgtagacggcgcgccccgcccccgtacgcctaagttctcgcgcgactcccacttccgcccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggagggtcggtgttgagtagcggcaggtcggctgcctttcccaggccttctggtccttgcgcgcgtcgcgtttgagccggcttgccggcgcgactcggctggaatgttagttttgtgggctcacgagctgcctcaattctgcgagtgtttgatggcactgcgacagcaggagttgaggaaagcacccttctatccattcaggacccgtcaatctcgcctttgcttggtcccgctggaatctgcgagctcctgctaagctttggggccatgcagtctcttagttaccagtacatgccattacgtgccagcaaagttaatgagattgcatgttactcgtgcctgtgtagtggaaggaccgatgcatgttattctaagtgcctgtgtagtggatggaccgatgagggtgggaagtggacataacctttcaaagtctgatgcatgcagtgaaacgtacagtgggaagagctagatttatgtttgttcccctcacctcactgtgagatatactttggtatcaaattgccggttagctttttaaaatattaatgggaaataccattaacagtgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccagtaagtagcttattcttggtttgtattttccttaagttggcgcttgtatattgtagcaggcatcttggtctgttgttggtcctgtggtgggagactttaaggaaatgtcagctcttggttgcagccttggcacctgtggtgatcatttttagtacagcacttggagagaagcaagatggtgctttttgaattaagaaaatgtgccatgggtagttctgagcttcaaataagtactgttgataagtcactggtgtctggatagatttgataacaaaggttaaggtctttataatttaccattaacttaatttctaccctcagtttacaggcttgactttgcttatatggttcctaaatgttaagatacttgtttttttcttttgtagaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaggtgagacccaaagttccttagagtggttgtgctatgggtgtttgaccaaggatagcatggtttgatgactggaaggagcaagttcattttatttatttattgagaccagtgaaatgtccacaaagttcattttaaatttttgttttcttgccgttgttgagtgctaactctggggttgccacaccatattttacttactatttaaatctaagatttaatagtggtgtatcatcaaagtcagattttcttgctgcatagattagtggttttttgaggaacgtttaggtgcaggtgggcggttttgcctgtcttaaggatgttttttgacctcagaattgagtgaatgttgattaactgtggcagtagagcataattgtggcagagcctctggagtgaggttaaaatctgggctccatttgcctattgtgttctcgttggaaagtaacttgttttctaagcctcggtttctttatttgtaaagtgcagataagagtgtcattttattgaattgtgaggatgaaatgaaaatatttcagatgtgtctggctaactatccagttggaatattttgtgggagttttttgtttttgggagattgagtctcttatcgtccgggctggagtgcagtggcgccatctctgctcactgcaacctcctcctcctgggttcaagggattctcatgcctcagcctcccaagtagctgggattacaggcacccgccaccacgcccagctaatttttgtatttttagtagagacagggtttcaccatattggccaggctggtctcgaactcctgacttcaagtgatctgcccgcctcagcctctcaaagtgctgggattacaggtgtgagccactgcacctggcacagttcgaatattttgtatgtgggaatgaatgatgacaaaatgtttcagtcccaaatgatacatactgattataccattatatttatcctgacattcctctaaggctttatggtttacatttctagaaatattttaaggtcccttagctgtaaattgtatttgattagtttttttttatactaaggtataaaatttacaaaatgcaaacaaggtaaatcagttttcatcactacccaagatgttttttgttttttcaatttaggcaataatatgaccactaactaggggtttttaattatattttagctctgaaattgggtatttaatcatcagcatggctttagtttggaacataaaagacgtctttcaaagtgtgcatttagagttatagcagtcacctatttacaacacagttttttgaaaaatgacataatcactgtagatgttcataccatagaataccatggatcctctcagacctattttcctctggtgtagttttacacttgagggggtatgagctgtttaaaggggtatatgtatatgcaatggatgtgggtttggatgccgtcaagatagtggtagtgttaatggagggtagaaaggaggagggagggcagttgagaggacctggttatttaattgggtaagaatttgggggtaacttggtaagttcaaggaagttaattctgtaaacttaaagagatgttacttatgttaggatactttatatttaataatgagtgtttgacaatccagctttttaaaattagaacttgagggataaatggataacgtaaaacctgttaaatctgacggtatcttttttctccagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgtaagtgtttctttgcttcctcacacaacacaaccttgagtattggattattcctgagatgagagaacgcatatgagacaaggtaaaggtctgtggaaatcctgtctgtgaatccttctagctatatctctttaagtgaaagagtgttaagtactcagtaaatatgattattattactattattatttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctgtaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgcttgcatagtagtgatgaccattatttcaagatatactaacagttttttggttttttttttttttttttttttttgccttttagtgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaacattctttttttaaaaataatctgacagcttggtggattagacagtaaatttgacagctggtaaacttttctgacccagacaaattggatataaacatactactatgcacctttactgtgaagctgaaatggggcggagaagctgttaccaagtgggcatttagtgctatccacctatagtcactcattcattcagtttctacctcttctcaagccttttcagttttctcatttcttgcttagctgataaccttgcttcctttaatcactaaaaaagtttaaagcagagaaaagaaccccacaaatttctgttacctatattctgccacctatgcatgtgttaatcatactaccttctgtcataccactggatggattgtgctaagacataagacagccttttttttttttgcccaatcagcctcatggcttcagcaattcacacctttatcaattcctcgctgtcccttccatcaccatacaaatactagtataccctcccagagcaccttactaagtccctttatagcaaagctcaaaggaattttttatatattggtatcatttaattttttttaatttttaaaacttttttacatataaaatatattttaaaggtcaagtgcgtagctcatgccagtaatcccagcactttgggaggctgaggtgggtggattgcttgaggtcagaagttcaagaccagcctggccaacatggtgagacaccgtctcacctaaaaaaaataaaattagccaggtgtggtggcggggtgcctgtaatcccagcttctcgggaggctgaggcatgaaaatcacttgaacctgggaggtggaggttgcagtgagctgcactccagtctgggctacaaaatgagactgttgaaaaaaaaattacatttgagagacatgatcttactctgtcacccaggatggagtagaatggtgtgatcatagctcgctgtaaccctaaagtcctgggctcaagcagccctccctctcaggcctcctgagtagttgggacacaggcctgtgccacaccacacccagctttttttattttaaagacagtctcactgtcacccaggctggagtgtgttagtgcgatcttgggtcactgcaacctccatctcccaggttcaagcgatgcttgtgtctcagcctccccagtagctaggattataggcacccaccaccatgctgggctaatttttgcattttttagtnnnnnnnnnnnnnnnnnnnnttcgccatgttggcaaggcttgtcttgaattcctggcctcaagtgatcctcccgccttggcctcccaaattgctgagattacaggtgtgagccactgcaccaggcctaatctgctagtttttaagttctttgtagggtcttggctgttatgtccagactggtctcaaattcctggcctcaagggatcttcctgcctcagcctccaaagtgctgggagtataggtgtgagccatggtgcccagccacattttttagtttttattttatttttcttcaatttgctgcagttaggctttcctcccaacaccactccaagacatttcattgtcaagattagcagtgattttgttgctaaattcagtggtccattcttttactagaggtcttttacttgacctctgttagtgacttgcttatcactttgtcctgttagtgactcttgacagttgatttcttcctgattttaactgtcttccagatcctcgactcaagcttttcctcctacatcattggctactcctttactagttcattttttagacttttaatcagttttagaaggccctagggctggtcgggtgcagtggctcacgcctgtaatcccagcactttgggaggctgaggcgggcggatcacgaggtcaggagttacagaccaggctggccaacacagtgaaaccctgtctctactaaaaaatacaaaaagttagccgggtgtggtggtgtgcacctgtaatcccagc

SEQ ID NO: 11884 - DNA, 4091 bp, Human
  misc_feature (1)...(4091): n = A,T,C or G
caatatcgccctgccaaggaacaagggacaggaacaacatatcctccttcttaaagttttcttttttattcttttttcttttttgagatagggtcttgctctgtcacctaggctggagtgcagtggcgtgatctcgactcactgtagcctcgacctcctgggctcaagtgatcccaagtagctgggactataggcacacaccatcatacttgactaatttttttgtatttttttgtagagacagggtcttgctatgttgcccaggctgatctcgaactcctgtgctcaagcaatcctcccatcttggcctcccaaagtgctagggatcacagcacccaacctccttcttaaagttttgtaaaagttcttccttagatttggataaaaatctgtctccaggctgggcccggtggctcatgcctataatcccagcactttgggaggccgaggtgggcggattacgaggtcagatcgagaccatcctggctaacatggtgaaatgccatctctactaaaaacacaaaaattagctgggtgtggtggtgcacatgcctgtaatcccagctactcaggaggctgaggcacgagaatcacttgaacccaggaggcggaaattgcagtgaaccgagattacaccaccgcactccagcctggcgacagagcgagactctttctcaaaaaaaaaaaagaaaagaaaagaaaattctgtctccccatgacttttagctgttttcactcattctgctccttggagcaaaaagaacaaagggactttctagtctataggacagcatttaaaatgtgtgtgtgtgtgtaaaaaaaacccactatgaccacctgttttttttttcctttaattttttattttgacataattttagatctacactaaagttgcaagaatggtataaaattccccatatactttttttttttttttaagacaaagtctcactctgttccccaggctagagtgcagtggtgcaatcttggctcactgcaacctccgcctcctctgcctcccgggttcaagcaattctcctgcctcagtctcctgagtagctggaattataggtgtgtgccatcatgcccggctaatttttgtatttttagtagagacagggtttcaccatgtaggccaggctatctcgaactcctgacctcaagtgagccacccgccccagctaaacaaaggtttgtaacccctacgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccttaaaaataatattttcttacataaccacagcatagttgtttgaatcggaaaattaacattaacacaaaatattatctaagctacagaccttattcagatttcactaattgtcctcctaaggtttgggatcatacattacattcagttatcgtggcacttcaatctcctttataacagctcctcaggttttgtttatctttcatgatattcttgatgagtatagattaggtaatgggcagcatgttcttcagtttggattagtttgatgtgtcctcatgattagattcaagtttttgtagtttttttttgagacaaggtctggctctattgcccaggctggaatacagtggcatgatctcagctcactgcaacctctgcctcccgtgctcaagcgagcacctcagccccctgagtagctgggattacaggtgcatgccaccatgcttggctaattttatatataaatataaatatatatatatatttatatataaatatatataaacataaatattatatactatttatatatttatatatgtgtgtgtatatatatatatatatttttttttttttgagacggagtctcgctcttgttgcccaggctggagtgcagtggcgtgatctcagctcacgcaacctccacctctcaggttcaagccattctctatagagacagggttgcaccatgttgtccaggatggtctcgaactcatgagctcaagtgatcctcctgtctcagcctcccaaagtgctgggattataggcatgcgccgctgccaggctggagtttgataagaacaccacagaggctgtgagctcagggcatcctattgaggatgtacgtgatgttgatttgtcccagcactcacaatgatgtctctggtcacttagttaaggtgatatctgtcaggtttttctactgtaaagttactatttttccattcacaattaatgaatgtcttgggataattgcctgaatcaattattgttatgatagttgccaaatgataattttctaattccattattccttctgcatttgtttgttggcattctactgttaggaagagtctttccagctgagcacagtggcttatgcctgtaatctcagccctttgggagccagtgggaaaattgcttgggcccaggagttcaaggttacagtgagctatgatggcactactgctctccagccagtgcactcactctgcacaacagagtgagaccctgtctcttaaaaaaaaaaaaaaaaaaaggccaggtgcagtggctcatgcctgtaattccagcactttgggaggccgaggcgggcggatcacaaggtcaggagttcaagaccagcctggccagcatggtgaaaccctgtctctactaaaaatacaaaaaattagccaggcatggtggtgtgctcctgtattcccagctacttaggaagctgaggcaggagaatcacttgaacccaggaggtggaggttgcagtgagctgagattgctgccactgtactccagcctgggcgatagagcaagactctgtctcaaaaaaaaaaaaaaaaaaaaaaaaaaaaaggtcttcctttcctatttactcttatggatacttattttattctagtcaatggttataatcctttacaatcattatttattttagccagcccctccaagttggctcctgtgttctttgggctgtacccttaattctttgagtcttgtcttgtttgcacaagatgctctgggcttatattatatttcccccatcccagccatttctccaaggaatgtttccttttagtggagaatgatatttagaaaccaaatgctgaggctgggtgtgctcattgccattgagttatacctttaccttattgactggtttctactgttctattcagagacccctggcacaagatccctgccctggacccagagaagctcaatgtcttccg

SEQ ID NO: 11885 - DNA, 5386 bp, Human
  misc_feature (1)...(5386): n = A,T,C or G
ggttcacgccattctcctgtctcagcctcccgagtagctgggactacaggcgcccgccaccgcgcccggctaattttttgtatttttagtagaggcggggtttcaccgtgctagccaggatggtctcgatctcctaacctcgtgatccacccgcctcggcctcccaaagtgctgggattacaggcgtgagccacggcgcccgggcaagaaaaaattattcaagggagtctctctcgagcctattctggctgcctataaaaaattaaaggccggacgcggtgtctcacgcctgtattctcagcactttgggagaccgaggcaggtggatcacgtgaggtctggagttcaagaccagcctggccaagatggtgaaaccccgtctctactaaaaatacaaaaattagtcgggagcagtggccggcgcctgtaatcccagctactcgggaggctgaggcaggagaattgcttgaactcgggcggcagaggttgctgtaagccaagattgcgccactgcactccagcgtgggcgacagacttaaactccatctcaaaaaaaaaaaaaaaaaggcagttttcatgtcaaagtctatgttattgaatataaggactctacctaggaagatggaagctgttgatgccagcactgcaaagagggtcaagagcaggatctggtaagagccagtgaaccgcttgaggatggcggaatcttcacagtgatctatacattggccataacaaaacaagataatagttaatagcaaccatgggcagatgctgcattttttaaatttaattttttttgagacagagttttactctcactctgtcccccaggctggagggcagtggtgcgatctcagctcactgcaacctccagcagatgctgcattttaaaacttatgactaaaaatagtaataagagtatctgccagaagtattcaaaannnnnnnnnnnnnnnnnnnntactaaaaaaacgaaaattagccgggcatggtgccgcatgcctgtaatcccagctactcgggaggctgaggcaggagaatcgcttgaacgcgggaggcggaggttgtggtgagccgagatggcgccatcacactacagcctgggcaacaagagcaaaactgtgtctaaaaaaaaaataaaaataaaaataaaaaaaaagaaggcatctttcacttatccccatcaccttccgtgtccatgcttgtcccttctcaagctaaactattcaatctctttttgtccattctctcacctctcattatctccttgagtcttccctatttcttttcactgaccaaaccatgtctcccctgtttatttatttatttaagacagagtcttgttctgtcacccaggctggagtggatctcggctcactgtacttccgcctcccaggttcatgcgattctcctgcctcagcctccagagtagctgggattacaggcacacgccaccacgcctggctaattttcgtatttttagtagagacggggtttcactatgttggccaggctggtcttgaactgctgacctcaggtgatccacccgccttggcctccctaagtgctgggattacaggcatgagccactgcgcccggcctaaactgttaaattaaaccaatagaaaaagagttaagaatataggtatttaaaaaataggacggaagtcctggatatggctccttctccctggtgttttcctcaacctttcctatttattaggctccaactgtcaaggtatggcacaaaattttaaaagtgtccatttatccctggatagtgatcaaacgctgacctcaaattagcaaggtaaccctctcaacatggtgacgcatatgtgtcacaactaacagttaaagaccttccgaaaatggcagctcccttgtctccccactgcggcggatcaaagtaagacgttccaaacatggtggcacaagatccttgcgtcatttcctgtagtgtgctctatataaggggcaggatttccgctttcgctcctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccggtgtgtgacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaagacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgatttggggctttgagtttgatttttagaaatggaaacatttcttaggatttttcggtcttaacagtgacagggatcatctataatgtaaatttttagacaagaagtgttggatttggttgttttaactagatactaccaaaagctatgtattaatctcaaagcactactgtctaaagcggggataaatgggtgataaaagggcttaagttgataggaagtaaccagtgatacaaatgcgcaggtagctaagagttgagaaaaaagatgtagctttctgtgggtggatcatcatgcatctgcttttttgggagaggtgggcagaatacctgtactgatgacagctaatctctgaatctttttcctccaggatgttccttcaggaggaagcagcactaaaagcactctgagtcaagatgagtgggaaaccatctcaataaacacattttggataaatcctgtttattgtcttgtttaagtgttaggaagttcctgtctcaagtattctggggcaaccaggaagaggagaatattagagtcatttggggcacgtaagtggccaagtactttaaaagtccctttgggggcatttttaaccacctaggctcattggataaatttgttttttttttaaactgtgatactatctcaagtgttgtgtttggtgtttttttttttttttataagagagatggaatcttgctctgttgcccaggctggagtgcagtggcacaatcttgactcattgcaacctctgcctcccaggttcaagtgattctcctgcctcagcctcctgagtagctaggattacaggtgtgtaccaccatgcctggctaatttttgtatttttagtagagacggggtttcaccatgttggtcaggctggtctcaaactcctaacctggtgatccgcctgcctaagtgctgggattacaggcgtgagccaccgcgcccggccgacagttaactctttacaatacagtctgacataccagttttaagaaacagcttaggatgctttatttatagttctcagaagccttatctggaaacttaatgtagaagttgctgttaggcttcttgtcgaggactagaaatcttcattcccctgcagttaagagaaacttgtccaagcagaggttagtgccttatactccataaccaatgttgcagccgactttgggccaatggaggttgtagactcatgaagtgagggggagaacttgtggagttaaaaaaacctagaagaagagggaaaagttgagtgaattaaacgtgtgtatctgagcttttcaaagatgaggacagaggcttttttacctggctgtggtgttcctagagttggtacatacacaactggaactgtttgtatcttgtttaggaaggcattgtatgctggaaaaaggacaggaaatgtcacaaggcatatctgaggaaggccttaaaaggcaaagtcaactctagaatgagaatattgctaaaaataattcttaaaaataagtaatagtaatggcactattacaggaagtttttatcccaatttaacccattttagagttactttcagcttttggctgaaagggggaaaatggccgggcacggtggctcacgcctgtaatcgcagcattttgggaggctgaggtgggcggatcacgaggtcaggagattgagaccatcctggctaacacagtgaaaccccgtctctactaaaaatataaaaaattagctgggcgtgttggcgggtgcctgtagtcccagctactcaggaggctgaggcaggagaatggtgtgaacctgggaggcggagcttgtagtgagctgagatcgtgccactgcactccagcctgggcgatagagccagactctgtctcagaaaaaaaaaaaaaagtggggaaatggagtagacaatagtgttgtgttaatttttttttttttaggctgtgtgtggtggctcacgcctgtaatcccagcactttgggaggcctaggtgggcagaccacctgaggtcaggcattcaagaccagcctggccaacatgccactaaaaataaaaaattagacaggtgtggtggcgggtgtctgtaattccagctactcgagaggctgaggcaggagaatcgcttgaaactgggcgatggaggttgcagtgagccaagattgcaccacttcacaccagcctgggtgacaatgggactccatctcaaaaaaatttttttttagacacacagtatcactggagtacagtggcacaatcatggcttactgccaccttgaattccctgtctcaagcaatcctgcctcagcttccctagtagctgggactagatgtgtgccaccaccacacccagctaattttaaagtttttttgtagagatggagtctctgtgttgcccaggctggtcttaaattcctagactcaagccatcctcccactttggcctcccaaagtgctag

SEQ ID NO: 11886 - DNA, 47883 bp, Human
  misc_feature (1)...(47883): n = A,T,C or G
cccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccactgctggctttgactctcattgtgttctctgtgctgtggcatgatgggataaagagacaatctttcctttgcccagggaaaatgaaacttgaatgcacatacccagaagctctgtgggcagggttaccagataaatgcaggatgaccagttaaatgtgaatttcagataaacagtttttaaagtataattttctctcatgcagtatctgggacacatttttatttgctaaattgggaaaccctatgtctgggtaaacttgaccctatctatcctataacttcacttacgacttttaaaaaacatatctatttaatttttctttctttttttttgttttttttgagacggcgtctcactctcttgcctaggctagggtgcaatggcgcgatcttggctcactgcaacctctgcctccagcgttcaagcgattcttctgcctcagcctcctgagtagctgggattacaggcgcgtgctaccatgcctggctactttttgtatttttagcagcgggggggtttcaccacgttggttaggctggtctcgaactcctgacctcgtgatctgcccgccttggcctcccatagtgctgggattacaggagtgaagcaccgcgctggcctaatttttctattttttgtagaaatggggtctcactatgttgcccaggcttatctcaacacctggcctcacatgatgctcccgccttagcctcccaaaatgctgcaattacaggctcacttacgactttccatgatttttgaaattacttcacagggagcctgggcagcttctggagggcagtgagaaaccaacgaaaaggcttcagggaaaagatgccacagatgaaatttcataaagatcgctttgggtgtagcccaaatcagaagcttctacaccagccttacatattacggttctcatctattcttattctccactctaagtcaccaagtccatcctacctccacaaggcaaataccctgtctctgccaccatccactgaagaaccctaaaagcaaatgggtactgaccctgccctgcttaaaattctctcagggctctgatttgcgtcaggataaaatccaaacgccatcggccttgcgcggttttcttccagttccagagtgtcagtcctctggccgatctaaaagccctggggctccaagctgcccacggctgtggagcctgggctggagcccacagcggacggcagtgttaggattattataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtgagggggggacgaggtgggcgagaaggaaggtgaggggatgcgggctgccgccgccggagctgatgcccagcccgcccgcccgccttcgctgcttcccgcctttcccgcatttcccgccgcggccttccgccctgtcagcccgctcggccttctgtcttcagtcagcctgccccgaacctccttcgggccttcaggctgcgccccctcggctttgtcatcctgccgcctttcaaaaggataacacttaccccgtatcgagtagtgactgcgtacgccgagcacttgccaggcactattttattcctccctgcaagcctctgagagatgattagcttattacagatgaggaaactgacgctcagagcgaggtgtcgccactgacccaaagtcacccataggtgacaatacagtttgatttgaaaaccgtggggttggtgagctgtcttaggcacagggtcggggggcagctaggaaagaaggagggggcctctctaccctccgtaggcacttgtcagtttactgatctcttttgtggggtgaggataggagtgtggcgtggaaaaaacagatcccagacagacagcaccctcgagttcctttcccttcatgggaagagatgctgaatcagagaagggtggctgagacatcttctgacaagatggggactgggaagagtcaggaactcgtattctttctcaacagttctttttcattagacttgccaagtgcccgctttgtgcccagccctttgcttggctttgtgagattgtaggaggagacagtccctgccttgggaacaggcttcatcgggttggaaaaacaagagcaacatacttttaacaaccgcatgagatacgtatgaacaagttttgagttgaacctacttgcctttgttaaagcaatacaatgatttcaaaattgtaggcacttagtaaatactggttaatcgactggttgtttctattttgtcctctaggctgtgaacatttcaaagatggagacttgtttgagacagagtcttgctctgtcacccaggatggaatgcagtggtgtaatcatagcttactgtaaccttgaagtcctgggctcaagcgatgctcttgcctcagcctctcaagtagctgggactataggcatgcaccaccatgagtggctaatttttaaaaatttctggtagtaaaggagtcttgctgtgtttcccagtctggccttgaattcctggcctcaaaccatcctcccttccttggcttcccaaagtgctgggaatacaagcaagatggagacttttctgttcacgtttagcacaggacctgacatgaacagattcttaaagaatgaatgaaaatagttgtatcaaaatgtaggacacgatgaatgctgtgaataagcaggtagttgatttggtttaactacagccaatgtccagattggtttaactacagacaagagttggaaaggtggacagtagtggcctttcttgtttttggtatcttgagaacatcattctgtgaattttcctagctcacattttagctgaccaaagagcaaaataacatagtgcacttttattgatccattcataagagtgagagctgagcatctatttttgtatttttatttttttacattattatttatttgtatttttttagagaaggagtctcgctatgttgcccaggcttgtcttgaactcctgggctcaagcattcttcccacttcagcctcccaaagtgcttggattacagtgctgggagccaccgcacctggcttgagcatctattttttaaatctttagatatgggagagatgtttaggatggtctatgataagtcagtaacaaagatgaattgaaaatgtatggacttagatgaccagaatgggtaaaattcaaccctgtgttgaattttgaacttttagagtctacttctaaatactttcgtttaaaaagtgctaccttggcctggcgtggcagggcatggtggctcacgcctgtaatcccagcactttgggaggctgaggtgggtggatcatttgaggtgtggagtttgagaccagctgggccaacatggtggaaccccgtctctactaaaaacacaaaagttagccggacggtagtggtttgcacctgtaatcccagctactcaggaggctgaggcaggagaatcgcttgagcctgggaggcagaggttgctgaaatcgtgccattgcactccagtctaggcgacagagtgacactctgtctcaaaaaaaaaaaaaaaaaaaaaaaccccaattgctagctataactagctctaaaaagcagagcttattttctcattccttcatagagcacaatttgatccagatggttcatgctgtagattctgccattgtagcattcagcaagacttaatatacaacatgtacttagatttgtttgtttctttttttttttatatttctatgtttctatattttaatgttttttaatatgcatagggtttttggttttctggactttttttgtacccccttatttttggcatgtcagtggaatagcagactaactcctacagtttttgttaattttctttgagatggggtcttgctctgtcatccaggctggagtgcagtggtgtgatctcagctcactgcagtgtctgcctcctgggttcaagagattctcctgcctcagcctcctcagtagctgggactacagatgtgtgccaccacgcctggctagtttttgttatttttaataacaagggcaactggaagttgactttgaagtacctactgaatatgctaatgtcttgctaaacactgtgagggcagtaatggagaaggcagctctatcttcaaagaacttaaaattgttagggatttaggaacaatccatatgaaaattattagatagaagagaatagtagatgagtttttttcatctgctatcttgagctatttttcctaatgggagagtatcattcctcaaggagattatggttaaaaaaataaacattgagaaccattgcagtaaatgacaaagtagctaactgagttgtaaactgttttggaatttagtgtagtattttcaaaactttggattgtaactcacagtaaaaaacaaaacattttacagacatgtgtatatatgtggatacacataaaatgatacaaaagtttacgaaataatgtctttgaaagcatccatttgcactctaatctttcttttattccagattctttccctatccctgcctccctccctcccttccttcctccctttcttcctccctcccttccttccctccctccttgcttccttccttcctttctccctcccttctttcctgccctcctccctccctcccctccctctccccctccctccgtcccttcctccttccttccttccttccttcctattccattcacagcctgctatattattttacaactctgtggataccgtgctgttcaccgggattgcagtgatgagtaggcagacatggttccagcttccaaagatcctacaatcaattgagaaagatagacaaataaagaagtaatatgataaaatatgataaatactctgataggtaaagtataggcagtagaggccattcattcagttattcataaagcatttattcagcacctctttgtgctaggaaccgttgtaggcattagagattctgcagtgaacaaagctaaattacatttctcattgagttgacatcttggtgtgggtgggagtggtaagtgtatataagaaataagaagtaaacataataatcagttaatttcagatactgattaatgagatgatagtaaaacaggatcatgtgataaagatgaatgagaaaataaccttggattgggtagccaggaaaggcttctctgagaagccaacatttgagctgaaccctaaatagtattaagagctagtaatgtgagatctgtggcctgaacattctcggcagagggaattagaaagtttgtatcctgtggaaaaggcacgcatccttggtcttacaggattagggaagtcttcctgaagagagaagaatgaaagacagtttatagccaagaggaaatcacactagtatgctagaggattttttaattttattttttattttttgagacggagtcttgctctgttgcccaggctggagtgcagtggtgtgatcttggcttactgcaacctctgcttcccaggttcaggcaattctgcctcagcctcccgagtagctgggattacagcatacccagctaatttttttttttttttttttgtatttttagtagagatggggtttcaccatattggctagactggtctcgaactcctgacctcaggtgatccgcctgctttggcctcccaaagtgctaggaatacaggctgagccaccatgccctgctggctagaggattttaaaagaggaaaaggtcagtgtgagttaaaagtggttgaggcaggttttatggaggtgtgagatttggagggtgagtaggagttagatgtatggaaaggtggaagaggaacctttaggcagagtaaggtataagcaatgatgtggatatgggaatgggaagccctcttgggacttatatttcacagggaacagttgaagagatctggggccaaactaagaaaggctttgcttgagagaagaggataatgtaggcagtgagaagcagggattagtgatgtgataaaatcaacatctggcttgaaaaactaaccaagtggaatgacagaatagagaactgtgtgtcattggacctttagatctttagtctgcctcctattttcaagtgtgagttaagataattaccaatgcacttttttttttttgtcagtttcctgattgacttcagaacttctggcagttgtagaattttctttttgctaagttgctttcccccccccactgcatgtataattgcagaacgctaatgttgctttgcagttacctgcctgcttagttatccaattgctagagcactgaggtttcagtcccagtgccagccagttaatttaccccatttcagagttaaatgctgcagatgtgagcctgatgagaaaattatcacaatggtgatcagaaagagaggggctaacatatcagtgtagaagaaaaagcaacttgttctagtgataatgggttaatagtgatgtcttattgttcatttattcttcatcaaatgtttgagaacttgccttgttctaggcactaaatttgagaatacagatgtgaatcagagggccaaataaatgtaaacatatttagcatgtttcttattggttacttcaggttgagtatcccttattcaaaatgcttgggcccagaagtgtttcggattttggatttgtttcagattttggaatattcgcattatacttactggttgggcatccctaatcagaaaatccaaaatctgaaatggtccaaggaacattttctttgaacattgtgttggcattgaaaaagttttggattttggagtgttttggattttggaattttggattaaggatactcagcctatagttacaatggattgtaggtgcacaaaagagacaaaaactaaatcagtgtgagacactaacatttattgagtgcctattgtgtatcacatactgtgattttttttcccccataggagcagctttattttataacgaggtatagttgtaactatgccaaagttgttacaacaaaagcactttttaccttatctaattttattgtcacagtaaactgattaggcaagtaaaatagatataataattaacccctttctacaaatgaagatctgtgaaatgactgattgtgttttgtggcttgtctaaggttaaggctgtttggtggttggatatattcactattcctggtaagaataaataaaggtcggatgagctactatttgaggttaaactaagagtagtaagacttttttgtctagaaggacaaagatataatctaagtccaaaatcatgaaaaatattaggtaaaatatatagtatgtcagatggggtaagtgcaatggagaaaaagcacagaaggggaagggggataagaagagcaagggtcctatttggggcattgcaatttaaaatggaatcatcagggaaagccacattgagaaggtgatgacattgagcaaaagacctaaaggagatatatagcaagaaggccaagttgtcaaggtacaataggaaggaaggtgggagagttggaggtgaaattgggaagtgggtgcacaggacaagtggtataggattctgtggatttttttttttttttagttggagtttcattcttgttgtccaggctggaatgcaatggcgtgatctcagctcactgcaacctccgcctcctgggttcaaacaattctcctgccttagcctcccgaatagctgggattataggcccctgccaccatgcccagctaattttttgtatttttagtagagacggggtttcaccatattgatcaggctgatctcgaactcctgacctccagtgatccacccccccaccccgctcccttggcctcccaaagtgctgggattacaggtgtgagccactaggcctggcctgtggattgttataacaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggggcctcaatcttttctgtgaaatagcacttcatgttggtcaatttacatgttaattacatttgattctttgacattgtagtcttaataattgctaacatgaatttaataattgctaacatgatttgattctttagatggccgccaagaacgagtcatgtttgacaaaattacatctcgaatccagaagctttgttatggactcaatatggattttgttgatcctgtaagtaaatatggtttttatcttgggttccttctttcatgtgtttctttccatttgtctcttatccctggaccttcattcacctgatatactttggtattctggctatgcccttcgatataaaatttgaattcattgcttaaaacatttttttttccttaattttggttctgtcctgtgagttctcacttttcagagaactatgaatgtgagtaaagaggaaaatttgatattaacatttaatatcagatatttccttgagtaaattgttttattcattagtggaaaagcctaggccaggcgccgtggctcacgcctgtaatcccagcactttgggaggctgaggtgggcagatcacctgaggtcaggagttcaagaccagcctggccaacatggtgaaaccccgtctctactaaaaatgcaaaaattagccgggcctggtggtgggcgcctgtaatcccagctacttgggaggcaggagaatcacttgaacctgggaggcagaggttgcagtgagccgagatcgtgccactgcactccagcctgggcgacagagcgagactccctctcaaaaaaaaaaaaaaaagggaagcctagagtaaagcttgttttggaattgtggttatttaggtagggactggtttaaaatttgttttttgttatttatgtaaaaagatttaagtaatataaagtagatttcatggacaatatttaagtcaagaacaaactattcataaaccagttgctctgcttttctccttatcctttataacttctgtattctagactctcatcatcagctatctggactgttttctgtggtctctgcagtgtcctggacttcctctaatcttaccctcttcaaactcgtcttccacctgacttctaaaatgatcttccttaaatgagaatctctaagaactctttttttcaaatccacccatatttccgtctccttatttaggtatcttatccgcactgctaaggtatcttaggtatcttatccgtaaaacctgtgctcatctcatagctttaatcatatagtatggaaattaattatggatctttgtcctcccctagaattgaggatgggctgtgtatcttattcttgtgatatcctcagtgcttgacatgtatctaattagccacttgaccaaagtaagtttggtcaagagaaaatgattttatgtatcttgaaaatatgtttattgtaaattctcttttatattgaggacttaggcaataattagaatagtagaatgttagagttggaatgaacttaagagtccatcccatttcatctttggtttatagataagaaagttccaaagagagaggggagtgacttaagttagtgggagtgtagggagaagcacctaggtctcttgactcctacatgttctattgcctcatgcagtagtacattttagagcgcaagaatgttgcagcatcctcaaacttcctagggtagattctgttgaaaaactgtcggtgcacatctgtaatcccagcactttgggagactgaggtaggcagattgcttgggctcaggagtttgagaccagcctgggcaacatggtgaaactgcccaggtgcagtggctcaatcttggcccactgcagcctccacccctggggatcaaatgattcttgtgcctcagcctccctcagctgggattacaggcatgtgccaccacgctatttttttttttttttttttgtatttttagtagagacagggttttgctatgttggccaggctcgtcttgaactcctgacctcaagttatctgtccgccttggcctcccaaagtgctgggattacaggtgtgagccacactgtgcctgccctcaaccctgtttctacaaaaaaaaaaaaaaaaaaaattggttgggtgtggtggcgcataccagtagtcccagctacttggtggtgggaggatcgcttgagccctggaggttgaggttgctgtgagctgagattgtgccactgtactccagcacaggccacagaatgagaccctgtctcaaaaagaaaaaaagaaaaactgtgtgctgttagatctggcacagttagcacacagatggtattttattctgagttctaattgtttgccttattgctctagaaactatttagaagacttcactgctcttatactgaacacaccttatctgctggatctgggaagaaagtgatcaggagcaacttgggcttagctatattataattagaatagattgcagactgttaaaatagttacacacgtatgtgtctttttttgaggggagtatgcattgttcagctgggaaacacatttattttctgttggattaagcggtttcttaaagattcaataaataaaccactcacaacttagaatttgtttttcttaaaaatgtatgctaataccctgtgcattacctgtcttaaaaactggaacttataatgtggccttgaaaacagtgaaatgcagtgaggtttaatgggattggggccagaagacttgtataataatataaccttgggcaagtctcagtaacctgagcctcaggttcttcatgtaaaataggtatagtaataatcatctcacaaagtgattgtgaaatgtcagagattatcaaagttgataattacttatcaactttggttgagaatcatttgaacctcgggggcggaggttgcactttgtaatttgtgaagtgctaaagaaagttgtcattaaattatcataattcagccccagacctaatttatacttctgtctcctttaattggcctgattaaagtttgattcatttgcttttctgtacttaccttatgtggaatttgggaaaagtaagtatggagctggagccctgatcacttagggagaatctgaatgaaaaatggggaaacccttatatagaatcagtctgttgggagaatttgaatgaaaaatagggaaatatagaatcattagtatgttttcagctatttccctgtgagactaatcgatttaaaggctatacttagattttttttaatgacactttcattttatatgtagtatacattttctgatagttctgctggattatgcattctcattactaagtttcccactgcccaccattctgaaagataagttttcagagaagtaagttgtcttgttctttgtttgagacagggtctcattgtgtcgcccaggctggagtgcagtgccatgatcatagatagctcagtgcagtcttgacttcctcagcacaagcaatcctcccacctcagcttaccctgtagctgcaaccacagtcacttaccaccatgactggctaatttttttatttttagtagggatggggtctcattatattgctcaggtttgtcccaaactcctgggctcaagcgagcctcctaccttggcgtcccaaagtgttgggattacaggtgtgagccactgtgcccaacctgtcgtttttattgtgatgtgaatttgattgttttcttttttctttcctttttttttttttttttttttgagacagggtctcactctgccacccaggctggagtgcagtggcataatcacagctcattgcagcctcagcttcccgagtagctgggatcacaggtgtgtaccaccacacccagctaattttttttattatctgtggagattgggggcggggcagggtggtcttcctagcttgcccaggctggtctcgaactcctggactcaagccattctcccacattggcttcccaaagtgctgtgattatgggtgtgagccacaacgcctggcttttttttttaatagtgtcgtgaactgctaagcttaagtgatctcctcacctcagccactgagtagctgggactataggcatgtactaccacacctggccatgatggttttcttaattactcttttaaggaagctattgtttcttgggaaagctcaagtaattcttggttttatttttgtaggctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtggtaagtctggggtgaaaaagtaaaaatttagtactctcagaaaagtaataagggtactagaaataaatcttgactgtttaaagaagcaaatatggctagatggggtggcttacacctcgaatcccagcaatttgggaggccaaggcaggcaaatcgcttgagtccaggagtttgagaccagcctgggcaatgtggcgaaaccccatctctacgttttaagaaaaatctaaaattataaaatagactaggtgcagtggctcacgcctgtaatcccagtgctttgggaggctgaggcaggtggatcgctgaggtcaggagtttgagaccagcctggccaacatggcgaaaccctttctctactaaaaatacaaaaaattagctgggcgtggtggtgggggcctgtaatcccagctactggggaggctgaggcaggagaattgcttgaacccgggaggcggaggttgcagtgagctgagactgtgccactgcactcctgcctgggcaacagagtgagactccgtctcataaataaataaataaataaataaatagcaaatatgtaaattagtgggaaagagcagactacaatttcgtatttctccatgctgcctatctgctgcataaaaaggttgatggatnnnnnnnnnnnnnnnnnnnncaggctcccatcaccacgcccggctaatttttttgtatttttagtagagacgggtttcaccgtgttagccaggatggtctcaatctcctgacctcgtgatccacccgcctcggcctcccaaagtcctgggattacaggcgtgagcccccccggcgccggcccaggaatctattttaaactacaagaacttataatcactttaactctagaagattgtttccttaagtgaggcattacatatttcttcaacatatatgtgtttattgagcactttatatgctaggcattgaggtgggttgagatgacaaaaagggttgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctggtggaaattttttgagagtcttttttaataatgcacacattttagaaaatttaaacactacaaaagatacaggtaaatactaattctgtttcctaccctgattcctgattttcctctctagaaacaactttatcattttaaaatgtatttttccagagctattttgtacatacgtgtgtgcatacatgtgtatgtgtgtacatacatatttttcttctcagtggtactgtactgtgcatacagttttcattgatactttcttcacttgtaagtatatcttgtttgttctatatcagcctttatgaatttacccttttttataacagttgtataacgttccattttgtagatatattgtcattgtatgtatgtgtaagaattcctttagtgatcaatatttgtttttcatcttttcactgcagtgaatattcttgtatggtaggtgttttgctcatagatgaatatatctgtaagataaatcccttcagtagaattgctgagccaatgtgtatatgaattcaaaattttgataggcattgccaaactgactcccaaaaaggttgctcaggtaaaattttacaagctcatgctcagcaacttaaaaattatccacttgtgtttgaacctgtttcttaactagatgccagaggacagaagggaaaagatgtagcctagccagcccttttacacacaggatttatttaccgtgtatatctggacagattagagaccagttttaactttaggtaatataatgattaggccgggcgcggtagctcacgcctgtaatcccagcactttgagaggctgaggcgggtggatcacggggtcaggagatccagaccatcctggctaacacggtgaaaccccgtctctactaaaaatacaaaaaattagccaggtgtgggagctggtgcctgtagtcccagctactcaggaggctgaggctagagaatggcgtgaacccgggaggcggagcttgcagtgagccgagattgggccactgcactccagcctgggcaacagagtgagactcagtctcaaaaaaaaaaaaaaaaaaaaagaatgattaattgactatctctctaaacatgtatctgatgttaaagagactaggagaaaactgagttgtttgtgtgttgttaatttgtgtaatctcgaagacaagttgaagacaaaaatacagcagcagcaacagcaaaacctgtgtctaaaaatatacctattgatagtcaagtatttcagttctctaatattcacactgggcccatacctgcctttggcaacaaagatgaccttaaaattttaagagaaaaggaaagcaagctttcgtataggtttttctagtccttagatatggatcattatgtagaaacactgtcagtattttgaaaacctggctccttttttttctctccaaaatgattatttgtacgttattgcttttattttcctctgaatgactttgtagcctacaaaaactctgtaacaaggaccagttatgctctaaaatcttactgttacaatagttctttgttggaaacttgttaaaggactatagattttgaagagcctcagaattaacataagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgctcatgttttttccctctttcaaaacatactataaacataatagtaaaagtttggaaaatcacatttaatctcacaacatatatttatgtattatcttctagtgttttcatatacatgtttttaaacctaattaggatacttaatttatatgtattgtttcttttttttagaatgttagatggacttctattctacagtaataatgcttagtgttatctcattgtatcctgtgttgattttagttctggagtcagggccgagagataagagattttgtgaaaataagtaattattttaatttaattatgggttctttttcacccctatcagcgcctgaattctgctattatctatgaccgagatttctcttacaattacttcggctttaaggtaaataatgggtttcaagtatgtgggaatttatacttaaatcatgaaataaaggattttgtttatgttttggtgacagttatcaaggccataagttgtttggagttgagatggacctggggaattagtggggttaaggtagcagtggtggtttgaattaaggcaaaggtagcttatctatttgcagtttttgaattttccacatattacttctggattacctgaggagttatgcagataaattaccataagtatttcataacattctaagtatttttgcgttgataggcagtatagtatagtgtagtgactgagaacatgaatgtcagtgtccacctgaattccagtctctgctctatttcttattagcaagttatttaatctctctgtgcttgtttcctccattttagaatggggagaatataaaatttcaacaacaaatttaattaaaaaaaaattttttttttgagtctgtgtctcactgtgttgactaggctggagtgcagtggcgcgatcttggctcacttcaacctctgtctcctgagtataagcagttctcctgcctcagcctcctgagtgactgggactacaggcacacaccaccatgcccagctaatgtttgtattttagtagagacggagtttcacnnnnnnnnnnnnnnnnnnnnctccagcctgggtgacagagtgagactctgtctcaaaaaaaaaaaaaaaaaaaagtgcctgtaacagaccaggcactgctctaaacaacatatacactcatttaatccgctgaggaatccctgatgtatatgttgctcatttaatccccatgaggagtcttcaggggattaaatgagtgtaacgagtgtatatgttgcttagatccgtgcctagtctgttacaggcgctttttaagtgttagctgttgtgaagttgatgatgatgatgaatactacaacttctgttaatgtgtgtagagctggctttttccagaaattttcatgcagtctctgccgaaacaaaagtgccagtgaggaggctgagatgggaggattccttgagcttaggagtttgacaccagcctgggcaacacagggagaccatgtctctacaaaacgttttaaaaagttttttttaaaaaaagtgccaatgataattctggctaacatgacgaaaccctgtctctactaaaaatagaaaaaaaaaattagctgggcctggtggtgggcgcctgtagtcccagctactcggtagcctgaggcaggagaatggcatgaacccgggaggcagagcttgcagtgagctgagattgcgccactgcaccccagcctgggcgacagagcgagactctgtctcaaaaaaaaaaaaaaaagtgccaatgataatgttccagatgaagctaggaagagtaaatgtgctattcttttcatttgaaattttatagaaacggcgaagatttaaagagattgccttattgtggatgatatatccactgcgtctttaaaaacggtgctctgaaaattttttgttgtttctctctttctagacgctagagcggtcttatttgttgaagatcaatggaaaaggtgagaaatgaacatgtttgtctgttacattttctactcattatattgaatgtatagctttgagctataagtcttaatattcttgcttagactctagataacattttggactttaggtttagtttgtggataattgtcctgtttattagtataaagtttttctagtttccttttggtgtccttttctgaaattcaaatacgtatctcaacctactttttctgacgtctcatcatgtgaaaactcctcttttgtctatagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctaggtaggtgttttgagtagggaaatacgccttgacctgaagaaactgggcagttagttcatcacataaaaaataatttaatgaccttttagtagctgcctgctctgattaaatgagatttagattctggaaagatctctgactgtaatgtggtaaatgaattggagaaaaggcaaatgcttataacaaaaatgttctaaaattgattggattgtggtgatggttacacaagtctatgagtatattaaaagccattgagtagtacactttaaatggggaattatattatttgtgaattatattcctttttttttttgttgttgagacaaagtctcactctgtcacccaggctggagcgcagtgttgcgatcttggctcactgcaacctgtgcctccttggtacaagcaattctcttgcctcagcctcctgagtagctgggattacaggtgcccgccaccacacccagccaatttttgtatttttagtagagatggggtttcaccatgttggtcaggctggtcttaaactcctgacctcaggtgatccacccgccttggcctcccaaagtgctgggattgtaggcatgagccaccacgcttggtgtgaattatatttcaataaggttgttttaaaaagaaggtaagtgccaagaactagttaggggactcttatagcagtttatataagaaattgtggtagtctagattagggaggtgaaagtagaaattgacagaagcagatagatcaaaagatatttagggccaggcatggtggctcacatctgtaattccaacactttggaaggctgaggtgggaagatcacttgaggtcagaagttcaaggctgccgtgagccatgattatgccactgcactgtagcctgggcaacacagtgataccttgattaagataaaaatatatataaaagatatttaggctgtcaaattgacagaatatgggtcaagaatggttcttgcatttatggatacagtaagtaacaggattaatgatgatgccatttgttgagaaaaggaacactaacggtctggtaatacattaaaaaaaaaaatatgccattatcaagttggtttgtttcaggaattcaagaacatggtaacatcaaaaaatacattaatgtaattcattgcattaacattttatgcagtttaatgctctttcataataaacactttagcaaaattgatatagaaaataacttccttaatttggcaaaagatacccaataaaaacctagatgtatcgtctcttttttcagcatggtagtggaggcctgagccagcattgtaaaataagaaaaagaaaagattggaaatcagggaacaaaactgtaatgatttgaagaaatgatttttacataggaaactcaagagcatctgcagacacattattagaaataaaagatttcagcaaaatatctggatataggttcaatatacatcaatcagttatgtttctgtactttagctgttagaaaattaagtcttaacctacagccatgcattacttaacgatggggatatattctgagaaatgtgttgtaaggtgatttccttgtgcaaacattatacagtatacttaggtaagcctagattgtatagcctactacacacataggatatatggcatggcctgttgctgctcataggttacaaacctgtgtagcatgttactgtactgaatactgtaggcctttgtattaccatggtaagtatttgtgtatccaaacatatcacagtaaaagtaccctataaaagataaaaaatgggccaggcgtggtggctcacgcctgtaatcctagcatgttgggaggccgaggcgggcggattgcctgagctcaggagttcgaaaccagcctgggcaacatggtgaaaccctgtctgtactaaaaatatagatataaaaaaactagccaggcatagcagtgtgcacctgtagtcccagcgactcaggaggctgagacaggagaattgcttgaacctgggaggcagaggttgcagtgagccaagatcgcgccactgcactccagcctgggcaacagaacgagactccgtctccaaaaaagaaagaaaagataaaaaaaaagatacaaaatgatacatctgtataggacagttatcatgaatagagcttgtaggactgaaaattgctatgggtgagttagtgagtgagtggtgaatgaatatgaaggcctggctgggcgtggtgggtcatgcctgtaatctcagcactttgggaggctgaggcaggtggatcacgaggtcaggagttcaagaccaacagggccaacatggtgaaaccctgtctctactaaaaatacaaaaattagctgggtatggtggcaggcgcctgtaatccactacttgggaggctgaggcaggagaattgcttgaacctggaaggcggaggttgcagtgagccaacatcgcaccactacactccagcctgggcaacaggagcgaaactctatcttaaaaaaaaaaaaaaaaggaatatgaaggcctagtacattactgacgactgtagactgtacaaacattgtgcacactaaatttattttaaaaatattttcttcaataataaattaaccttcgattactggatgaccactgtcgtatgtgtagtccatcgttgnnnnnnnnnnnnnnnnnnnntgatggagggctgaagatcagaggagacttcagggggggtgagagattgttcacaactttgtcatttagtagaagcttcgtatcaaaggaggggtgaaccagtaacgctagagaagaggttatgagatttccaggggctggaaattgtgatggaggccagggaagggtcaacctttagccgtgaaaccagcaggggaaatagacctgcccagagtgtcggaatgatgggcaagaagctcattgtacgaggcctagcgaatccaaattttatctccagagagaacaggtcgcaaagctcttgtcccagtttgaaacgggtactccggggtgtcattagtctgcgttgtttttgagacagagtgtcactctatttgcccacgctggagagcagtggcaggatatgaggcttactgcagcctgcacctcccaggtccaagtgattctcctgcctcagctttacaaatagttgggattacaggcgtgcaccaccacacccagctaatttttgtatttttaatacagacggggtttcaccatgttggccaggctgatctcaaactcctgaccttgagtgatccgtcttccttggcctcccgaagtgctgggattacaggcatgagctaccatgcccggttttttaagttttttagaaatttctctaaaacatgattaaaggacattaaataataaataaatggaatagattcaattttataaaaatgtcagtttttcccaagttaaaatatagattcaaagtaattctaggcaaaatctcaacatactgattctaaaattcatgtgaaagagcaaaagactgcccaaaaatgtcaggtcgaaattcctggaacctgtaaatgttacctgataaggaaagtggtctttgtagagatgataaggattttgacatggagagattatcttgaattatgtgggtgggcccttaatccaatcaaaagtatccttgtaagagagaggctgagggagataacgactcacagaaggggagaaagtgatgtaaagatggagggagaaattggagtcatgtggccacaaaggagagcaattagccactaaaagctggacaaagcaaggaacagattctccctcaaaacctctggagggagcactccaaaaaaaaaaaaaaaagtgagttgcagacattgtgactcttgatacctccacttacctttttttttgagatggagtttcgctcttgtcaccgaggctggagtgcagtggcacgattttggcttactgcaacctctgcctcccgggttcaagcaattctcctgcctcagcctcctgagtagctgggattacaggcacgcgccaccacacccagctaatttttgtatttttagtacagatggggtttgtccatgttggccaggctggtctcgaactcctgacctcaggtgatccacctgcctgggcctcccaaagtgctgggattagaggtgtgagccactgcgcctggccctacttccacttatatctcgataggagaatatataatatgacctcagagcaaaacaccatagagcaaaacattggaaaaattgactacaattaaaaacttctgtgtgaaaggcaatggaagggcaccgtggatcaataaggccgagaggcgagacaaagagggcaaaaatcttctttattgagctctcgggcgaggttcactggtccgcagggggagggccagggaagtctcgctgtgccaaaggtgcagcgcgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtgaaccaaaaacgaagtcaaataacaagtttcacactttgggaggccaaggtgggtggattacctgaggtcaggagttcgagaccagcctggccaacatggcgaaaccctgtctttactaaaaatacaactattagccaggcgtggtggcgtatgcccataatcccagctactcaggaagctgaggcatgagaatcatttgaacctgggagacggagcttgcagtgagccaagatcatgccactgtactgcagcctgggcaaaagagtgagactctgtctcaaaaacaacaacaacaaaaacacccaaaaaaacaagtttcagactgggagaagatatttgcaacatgttaactattgagagattataagaaaaacaaggccaggtgcagtggcttctgcctgtaattccaacactctgggaggccaaagcaaaggctggcttgagggcagaatttgaaaccagcctgggcaacataatgagagcctgtctctacaaaagtagaaaattagccaggcgtggtggtgcacacctgtagatttagctacttgaaaggctgaggtgggaggatcgctcgagcccaggaggtcaaagctgctgtgagctatgatcatgccactgcactccagcctgggtaacagagttaaaccctgtctcaaaaaaaaagaaaagaaaagaaaagaaaaacagaaagccaaatagaaacatgggcaagggctataaacaaataatgcatggaagaagaaacttgattggctaataaacgtctgagatgttaaactgtgcaataggaaaatgaaaattatgtatatatatatttgataaaaatgaaaaggctgacaattccaagcactgataagaatgtggagcacaaggaaatctcatacattgctagaaatagatttgtccatccactttggagaatctttagtaaagtgaaacgtgtatatcttttgacccagcagttcctctcctaggttcatattctacagaaatgcttagagataaacacaaggtgttgtgttcaagaatttttatagcagcattgtttggaattgcaaatgaattggaaataatccagatgttcatcaacaggcacatgggacaaatgttttggtatatttatacaatagaataccttatagcaatgaaaataaagtttgtttacatatatcaaaaggattaatttctgtaaagcaatattgaattaaaacaagttgcagaatgataaacagatatgcaaccagaaaaattctaagtgtataacatgtaaaaatgtcataaaggaaatgcttgaaaatgttagaggattgcaatgagggtatatttgtggtgtctaattttttgaggtaggtggcaagtacagagtatttgttacatcattctctatatttttctgaatgtctgaatatttatataaacacctagtcaatagatagaatccatttgcatgattgaatattcaaggcagtgaagagattattgatagagtaaggttcctgaggtggggagcaggatgagatccaaagtgaggtaaaggggttgtctttaaaaagactgtaaaggagctatgattttggtagacatatcaaagaattggttgacaattggagagattattttcataaatgtttgtttttcttggcttactaacaacctgaaaagacggtgatgtatgtttatgaatatgcatgagaaaatgtgaaaatagcacgtttgcagtctggtgaaaatgtaagccaatattttagacttatctataagacttcctactaggcttatttacttactatctaggggaggcagcaagatgattttaaaatgatatttcgatatgttttattgtgtcatgtacagtaaagtgggttttcttctttgaaaatcatttaggaactttctaaacttcaactctttttttttttttgccttagtgtctttgtgttgagtaatcatttttgtgactctgcttcatttccttgctctaagttgagacattttttcccccgtagctgttttcttctgagtatgaaagatgacagcattgaaggcatttatgacactctaaagcaatgtgcattgatttctaagtctgctggaggaattggtgttgctgtgagttgtattcgggctactggcagctacattgctggggtaggtttctgccatttgacttttaaagggggattcaagtctaaaagcaaacagattcatggttgagagggcatatgctattttttgggagtcctgggtctctgttaaattactaaatggctatgtgacttggagtgagtcattttacttctggcttcattttcatctatgatattagatatttagatttgactagataatctctagaatcctttttagctcaggttttagaattctggcttattttagcagtaataagagcagttatcattgattgattgcttactgtatgttaagtttgttataaatgttttacatgaggtactcatttgacccttactacaacgctatgaggtaactatgattatagactcatgccaggaattttattccttaaaataaccttgtgaataaaggtaccattgtctaattttacaagtgaggaaattgagacttagaaagttgttactttctgagatcaatcacttaatatgtggtagagccaggattcaagatttatgcattgacactttatgacgtaaactttagccctttgttagtttactgttcaatgggagtcaagataatagttttggatttaaatcctagctccactacttaactagtaatgtggcctagagttagttattttgtgtctgagtttgtttccttttctgtaaggtgaagaaaatatctaactctgtagaataaagttccagaaggaaattattccattatgttgtgttttggaggtgctgtgatatatacagcactttacacagtggtagagtgagctattgctcacttatctttctagactgtttaaaggcttgtgttgggatcagaagggttaaagaatttgatgaagtatcttctagtcgtaggagtctctattttcttaacatcattctagagtccacttattgctgagaatctccttttaccttatttattgccctgatatagctatcgcatataattcttattgtaaattgccttgatttcttttgggaaaaaggcattgtagtagtgtttatattcttttttactctacccaaagtgtatctttatataacgacctttagaagatgtagagtttaaatttagctaccttgattttggatccctttggcctgtaattgttacatctcattataaattagaaatgccatgaggtaacttagtacataattgtaatttattcaacattttgttgattttatttgggcatttttccaaagcagaagtagagatggagagcaggtaaaacttcatagattgctacctagaaattaggcatcttttttgataaaagaatggggccatttttttcttttctttgctgagtgccctctgtcatttctatcatggtctctcttttagactaatggcaattccaatggccttgtaccgatgctgagagtatataacaacacagctagatatgtggatcaaggtgggaacaaggtatgctccatgaattgaaagtactggaaatcagaactaaaggtgatttagtcatatacacttaagatggttcatttatgtgtagtttctaattaccttttttttacttgtaaaatcaatttgaggaggtataattattttaatatgcatatactttaaatgtacagtttgatgggttttgacaaatgtatacacttgtgtaatcaccacattgataaagaggtagaacatttccattaccccaaaatcttttctccctcatatacctttacattcagtcacccctgtcacccctacccacacatactttatccctggctctagacagccactgatctattcagctttcttacatgatagttcgtttgcaaagaatttctcaagttgtaattcatataaatttgttacttgaaatggggttgtaacatgtgctctaggtttttctttcgtttttttttttatctctctcttatcacccaggctggagtgcaatggtgcgatcttggctcaccgtagccttgacctcctggacttaagtgattcttctgcctcagccctcccatgtagctcagactataggcctgtgccaccacacccagctaatttttatattttttgtagaggcgggggtctcactttcttgcctaggctgatctcaaactcctaggctcaagcaatctacctgccttggcctcccaaagtgttgggattatgggtgttagccactgcacctcgcctaggttgttcttaaaacaaaaacaaaaactacctggaataacaaaactctccctaattggctggatgcagtggctcctgccagtaatcccagcactttgggaggctgaggtgggctgatcgtgtaagctcacaagttcaagaccacgagttcaagctcacgagttcaacatgacgcaaccccatctccacaaaaaatacaaaaattaaccgggtgtggtggcgaacgcctgtagtttcagcttctctggaggctgaggtgggaggatggcttgagctcggtaggcaggaggttgcagtgagccgagattataccactgcactccagcctgggcggtagagctagaacttgtctcaaacaaaacagaacaaacaaacaaaaactctccctaattgatagaagaaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcactttagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttatttaccactagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggtgagagataggtacttgttggtaatagcaacttgattcacatgagctttctcttttttagtcatcttaagtcatgcttaggaagagcccatatgtgtgtgatgccacagaaggcattctgaacaagttaagagatgccgtgcttgtcttcttatatttctattctctaaagtagatgctttgtgacctaaatgcttaaaaggtcatgtataaacaggcagacctagatgtttgggcctgaacctgaaaatgattatttctacagcaaatttccaagagagcttgtaaaagtcaccttatgcttgcagtgtttctaatggattatggttggctatttgaagtttcttatgagtgattttgtcctttcctttttaggactggtctttgatgtgtccaaatgagtgtcctggtctggatgaggtttggggagaggaatttgagaaactatatgcaaggtatgggaaaaatatgaaagaaaacaataatgttttaatcatggtttctcttatttcaggggtccaaatatcaaaagtacttgtcaagaatcttttgaagcatctaagagaaaaagtgactaataattttggtcagatttgcttcctgactcttcaccaaaattgagttgtgtcttcttctttcttaaaactttggaatgtataaataggttcttgggatttttaattgatccttttaaaaattaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcatttgaggtcaggagttcaagaccagcctggccaacatggtgaaaccctgtctctagtaaaaatacaaaaattagctgggcgtggtggtgcacacctgtagtcccagctacttgggaggctgaggtaggagaattgcttgaacctgggaggtggaggttgcagtgagctgagattgtgccactgcactccagcctgggtgatagaacgaaactccgtctcaaaaaaaaaaaaaggaaaaaaatttagcacagtcttaagagatttggcttccttagtttttactcctttttattatgaaagatattattggtttagtgggattgcgatcatctgaaggcacctaaaactgcctcattttcccctatggctttagctagagtaaaataaatatcatattcctttttttctttagcaaaacttagagaaaatttaagagttttcataactttatattttaatgtcttcaagttgtctacaataaagtttttttagggaatatatattaaataatattatctgtgcctttcagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggtaggtagaaaaaattcttcctagagtactaagaagagaaccttaggcagttattatttgtgaattcctcacttgatttcacttgagataagtgaagggagtttgcatagttgtaagcagaagaacactgttaaaggcagagagcaaaggaaggaaagggtatgatctgtgcctataaatgttttttagtctaagccgtgtgggaaagacacagttttttcttatacgcacatcactgtaataacatttactcaagaaaaatagaaatatacagttatgttagtttaggacacacacaaaaatgtgttaggatgtacattcaatttaaactatgtaagccttgagcctggaaagtggaggctgcagtgggctgagattgtgccactgtactccatcctgggcgacaaagtgagaccctgtctcaaaacaaacaaacaaaaaaccaaaaacaacaacaacaaaagtatgtaagcttataaagagagtcctttcagtgaatggtgagatcaaattctaatctcaagtctgtaaagagacttcacagaagaatcaaggctagaaatgggacatggatttggtgttttaaaaaaaagtttgagagaggagctttccatttggaaagagtggtctgtatgatacaccagagacagggctgggttttatgcagtgtggcaagtaagtctgttttgatggtgcaagtagattaattattggaatatggagagatggctatggctgggggaagggagatagaaggtagaagctgacacgtcacggataggtagcccttgtaggtttctgagaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatatactgctaaggttacagtttaattcaaaatttattgtgcagtagctatatgtaaaacacaatgttaagtgctctgagaatataaataaatatgctgccctctggaaacttctaatttagttggaagacatcgacatatattgaggtaactattatgcaagacagattatattatagaggctagagtgacatttttaaaataaaaatcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttatttttttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagtacatttttatcactgtagataatgaaaccctttatccattagcagtcactccctgttcccttcttccctcagcccttgacaaccactaatatattttctgtctctagatttgtggacattgtggacattccataggaatggagtcatataatatgtggccttttgtgtcaggcttctttcacttaacatgttcttttattcatgttgtagcatgtatcagtacttcattcctttccatccagagttcttacagtgccctacaaggtcctacacaactggataacccacctcatctgcggttactttcccctttgttcactttgctccaaccctattaattttcttgctttttctcaaacatgtcaaccatgctcctacctcaggatttttgctccttcttccctcttgaatgttaaaatgcaccccctcttcccatagccacatgatttgctttctaacctgttcagttctttgttcatatgtaacattttcaatgaggtccttcttgacaattctgtttaaaaattatacccccttcatctttatccccagtactctctgtcttcttttcctgcctatttttcttcctggcatttattagacttctgtgattcaagctatatttaaaaaaatgggtatttggcaacatgtgtagaatggagtagatgtgaagggcatcaagagttcaactgggaaactttcagtagtccatgtgagagaagttaagactttggcttgggatagtcataatcaaaatggaaaagaaagtgtattcattcaacattatcaagacttactgtgtgccagatgtgttgctagtgctaaacatataaatataaataagatgatccttgtgtgaagaagctcactgcctcgtgtagtggagaaatcactggaagagctttttcagaaatcacaaattgagatccattgttgctaagggcttgtcagaatatcagtgaaggtgaggtggacgtgtgtgttttgaagaactctgcagtgatggaaatgttctgtatctgatggctattgagcacttgaaatatgactagtgcaactgagaaactcaaattttatttcattttaaatagatatatgtagccagtggctaccatattgcagggcactcatctactgaataatgagataggtatatgtaaaaagctaattataacatagtgtgatatatgtctggtaatagagctgtgtactgtggaacatagggttctctctctctcttacctattttgctgatgcatgttataactaacacatatgactaggtattgaagaaatagaatcagtgggatttagaaatggactgatgaatgatgaagagggagaagtcaaatataaaaatttaaaattttaatgtctgagtattagaggctcacatggtggtgtaattgacacaggaagtagaaataaaaattgtgtgattcttgacctgttttttgcattccaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgagaaaaagaggtagtctgtctcatttggtacagaatgttgcttttcctgttcagtaatgttttctccttttctttaaaatctgttgacacaaaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggagtaagtatatggatggaattgtttttgcctgtgagtacctgtagtgggctgaatggtgaccccacaaaaggatatgtccacatcctaattcctggaacctgtgaatttaatttcatttggttcaaaaaaaggtattttgcagatgtaattaagaaccttgagataaggagatttacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcagaactatgagagaataaatttttgttaagttaccaagtttttagtaatttgttgcaccagccataggaaacttaaatacctttgtcctctggagtaaaaaggatactctgttttaatctcttatttagaactagtcattgctaaaataatgtaagagggatgctgccaatgttagttttctgtgggttaaaacatggcattcgttatctcacagtttccacaggtcaggagtccagacttagcttagctgggccttcttttctgggtctgtgttcaagatgttggtaagggctgtgatctcgtctgagacacagagttctcttccaagcttacctggttgttggcagaatatatttcaaggactcatggcatcttgcttctttaaggccagtgggagagaccatctctcgtttcaaaaggggcacagtctagtctcttttgagggttttcacctgataagttaggtccacataggataatgtcctcaccacccccctgtcccgcttttttttttttttttttgagacagagtctcactttgttacccaggctggagtgtgtggtgtgatcttagatcactgcaacctctgcttctcaggttgaagcagttctgctgcctcaagtctcccgagttagtagagatggggttttgccatgttggccaggctggtcttgaacttgtgacctcaagtgatccgcctgccttggcctcccaaagtgctgggattacaggcatgaatcactgcacctggcgtaatcttccttttatttaactcagaatcggctgatttgcaaccttaattacatctgcagaaacctttcacctttgccataatcgctggagtgacatgcatcctattctcaagtcatgtccatactcaagtggagattataaatagcctgtgcaccaaggtgtgggaatctgggaagctgtcttagaattctgcctttcccactgcctttattatcagtactatgattctttactatataaaatgttaatttcatttctgacattcctgctgatattagaaaatctaatgtgtggttattagaaaataggtgtttttagctaagtaaacagatcaagggacagatgaaggcactgaagaaagtaacatttttagtgttaaaaaaagagaatgtgtcagccacacccttttatgaatgttagagttttctggtttgtagatatgacatgggataatcagttttcttagcctgcttctgatcaatatgactacatggaattttgtccaggaaaatctctggagcttgtattcctcatagaggttgattagaagacagcatttgttgggatgtggggacatggcagctagtcatttgtgggttttttttttttttggtcatagttttaacttgctgtagaataaatttgagttgtgtattccttagattcttcagtatgatatgtggaatgttactcctacagacctatgggactggaaggttctcaaggagaagattgcaaagtaagtgaaaagatgtaaagtagctttgaaggcagaagggtttaggttcaccttctggatcttcagaagttagatatgtcattttaacttcttaaactcatttattacaaatggggctaaaatggcctatctcacaaaactattttgggaaaaaacttcgtaagataatatatatagtaacctggaagttgcttggcacaatgaaagcatttcagtacctggtaggaattactattattagttgatcttattttagggacttaacacacctagattaggtaattttctttctcattaaggcttttttccaactatgatttttttttttaaatgtttttcattcttatttatttcccaatttagttacatcgggcatataaatggcttttgtttgaattgattgtcataggaataatggattttggaagagtttttggagggtaatgtgtttagactatatgaaaaaaaatttttaaattgagtttttgtaggcctttcaaactaataagcataagggattcgaaggcagacagaatgttttgcagagtgaataacaaagcaaattgtttttgttttctatcgtgatgactttgtcatttatgggttaatgcatatgcaaagtgattaatatttggagaatgaagcagtagctttaaaatgctctttaaaaaaaataaccgtttgccttaaaattgttaaattaaaattgttttcctactcaaataatacatgttagaaaatttaggaaaacatagatttggaaagagaaaatgaaaattatactaatactgcctcccccagaaaacctgtgtgcatcttagtgtctgtcatcctttaggttttcttccaagagtacacatacatgtgtatttacatggaaattcaacttttaagaaaatggacctgtactgtatttatatatatatatatatatatttttttttttttttttttcccctcaaaatactatggcttagttttttatatacatgactttttttctaatttcaaaattagtatatgaacacaaatttattattaataaagctcaaatacagaaataaaatagaaagtaaaagcccttcttcatacttctgccaaccatttgtctcagaaaacaaaccaaaaaagtaacttattctttttcccagagataagacttgttaatggtgtgtatttttctagatctttttcagtacatttgcagataggtacacatacacggttttgtcatataaatgtgatcaaacttgatgtattctgggctgggcaccatgactcacgtctgtaatcccagcactttgagaggctgaggtgggtggatcacttgaggtcaggagttcaagaccagcttgggcaacatggcgaaacttagtctctactaaaaatacaaaaattagctgggcgtggtggtgcatgcctgtaatcccagctacttgggaggctgagacatgagaatcacttgaacctaggaggtggagattacagggagccgagatcatgccactgtactccagcctaggtaactgtgactctgtctcaaaaaaaagacttgatgtattctgagacttgttatttagtgatttattttggagctctttctcttttagtacctgtaggtctacctaatgtttttaattattatagacaattccatagtttgaatatatcatatatgtaggacttttcacaacatttacctgtctgtagacagatgatgttgctattttacagatgaggaagtaaagacatgaagatagttggtggtttgcttgatacctcactacaaagtgacagagtaaggtggagaaccaccccccaaaaaaagtaaataaaaaaataataataactaaaaagtagagaacccagttgtattagtcgattctcacacagttataaagaactgcctgagactgggtaatttaaaaaggaaagaggtttaattgactcacagttccgcagggttggggaggcctcaggaaacttacaatcatagcagaaggggaggcaaacaggtccttctttaatacggtggcaagcaaagtgctgagtaaagggagaaaagccccttataaaaccagatcttgtgagaactcactatctcatgagaacagcatgagggtaacctcctctgtgattaaattacctcccgccaggtccctcccgtaacgtggggattatgggaactacagttcaagatgagatttgggtggggacacagccaaactatatccagttgtacagactccgtcaggatatgaggctgtatgctaagcactgtatgaatccataggtatagaatgtaggaaagacaggctctttgtgttttaaaaacttgagactaagaaaacaagtagttaaggtatacggaaaggtacaggtcagagaaaatgtttgcagagtagatatttgtatttgacatttgtatttgtgcctgcctgatgaggaaagatgttttaaaattgctatcaattaggctgagctttgaaggtgagccaggggcagttgggagatttctcagtgtgtcagatagtatattttctcttattagtcaaaagatgttaaccttcttgcaggaacttataattgaagaatatactttgagcataatttcttcctctttacaggataatggagaattgtggtgatatttctctgattctgaacactttctcatcattatttttccagaaggggcctagcacaatgattttataggcacttggaaaagagtgagggttggatgagtgtaacctaatacaggtggggagcgcttcaacagtgatttgaatatttccctacgcaagatagtgtatcaagtgttatgattcctgagtgccacagtccaagcggcataaatcatggtatgataaggatagccaacaataaaaattgtactaattcagtttaggagtcaggcatttaagaggagagtgggctataatagcacccatactgtggaattgcctccctgtaggagtttaatttgaaagtcaacgtgtgagttcaatgcatgtacgatgttatgtttacatttactacatttatctacatttactacagtgacttaaagtagctgctttcctggcagattgtagctttgggactagtacctgataatctccttttctttaggtatggtataagaaacagtttacttattgccccgatgcctacagcttccactgctcagatcctggggaataatgagtccattgaaccttacaccagcaacatctatactcgcagagtcttgtcaggagaatttcaggtgagcagttcacaaccagccttacagggagatctttcaaaagcctgatgttgggagtaaatgctcactcatgtttaatttgcccattttcttagtttgggtgcaaactttgatagagacagtcatcttcatctctaatattattatttgttattaatatttcagcacaataggcatttaataaataatctgttgaaagaatgagtgaatgagggtcgagtatgaaagtaagttgttgatagttaaacatgatgtttaaccattatgtaatcatagtgatatattctataacttctcccagatgcttaagttaggatactcaaaatgtataaagaagtatcatttaaggcagtggttctcagacttggttaccaattagaatttatggtgggtgagaccagtggttttttctttgtttttaaggttcccaggtaattcttatgtgtagctagggttgagaacctcaatttaaaagactatttgtgaatttccagatatcttgaagtaaagttctgtaaagttcgagaaggatacgtttccaatttttttaacctaagtatttatagatttacccatcttaggcgctattcttttcacttttgcaaacgccatatgtttcttttttaatgaaaatattttttcagctttattaaggtataattgacaataaaaattgtgtataaatccaaggtatacagtgtaatgattagatatgtgtatatattatataacgattaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggctgagttggacattgtggtacctcctcactcatgctagacaatggagagaatgacttcattgtgttcatctaggttttgcttgtgtagctctgttcacctctgcattgttgtgctaggattgtacacatctttacataacccttaccatcttgtttttatgcaataatataaaaaagtagttctcaatttttctgcatcttagaatcaattggggagcttttaaaatcctgaagcttaggttgcattccttaccaattaaatgtctaggaacaggaaccagacatcaattttttttttttttttttttttttgagacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatgagccaccgtgcctggcctcagacatcaataatttttaaagattcttttggtgattccaaagtatatcaaaatttgggggatcatagatagaaagactgaaattaagagagtcaagcttaattaaaaatcatggttgacgactgatagtccaaaagacagagtcacaaatcgtgtaaatatttgcaactaagagtcaagaggcatttatttgcagatagaggtgtctggctaaatgttggtctgcttagcaacacagatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcaggttggtagagaatatcaaggagtacttaattgccagcttgagatattttggcattggaatgattttatgttttagccacctattaaatattatcacctagaagttctttaagttcaaatccagaacgttaaaaccaacccatggtttttgtaccagaacaaggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttattgcttctaggatctctgctcccagccattttgtgtgcattaccaccattcctcagataaaactttgcacacgtcaacccgctattcaaaaacatccattgttttctcactttataaagtgaaagccagcttacttagctagtcgttgccagctgtaaagtctggtgattttggattatgttcttattccctgataatgtattgggtatttaagtagaattataaatttgttttttaatttaacatttattgaacatctagtatgtgccaggactgaggatactgaatagaagatgatgatctttatctttgaagtcttatagtctgttgttacacagagacacagtctagctctctaaacagttataacctaaggcagacatattgtcttgggcaaacctggaagtcatatgcataaaaacaaagacaaaagaataaaaatgtttgacctttccaaagagataagcctgttttaggagtgaaaagaacaggatatttctgtctgactcacaaagcatttttgagagtactcctagaggagatagaattccaagtttaaaaaaagtttgatctggttcatgggaatgtattttattttatgtatgtatgtatgtattttgagacagagactcactctgttgccccggctggagtacagcggcgtgatcttggctcactgcaacctctgtcctgggttcaagtgattctcatgtcttagcctcctgagtagctaggatcacaggtgtgtgccaacacacctggctaatttttgtatttttattagagatggggttttgccatgttggccaggctggtctcaaactcctggcctcaagcaattcacctgcctcggcctcccaaagtgctcgaattacaggtgtgagccactgtgcctggccaggaatgtattttattttattttaatattattgttttattttattttatacttttttagacggagtctcgctctgttgcccaggctggagtgcaatgatacagtcttggctcactgcaacctcagcctcctgagtagctgaaatttataggcatgtactacccctcttgggggattacaggcatgagccacagcgcccagccaggaatgtatttttttgtttgtttgtttgttttttctttttatttatttatttatttatttttattgatcattcttgggtgtttctcacagagggggatttggcagggtcataggacaatagtagagggagggtcagcagataaacaagtgaacaaaggtctctggttttcctatgcagaggaccctgcagccttctgcagtgtttgtgtccctgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcactgatcaacaggctcacaaggcagaagaatttttcttagtacagaacaaaatgaaaagtctcccgtgtctacttctttctacacagacacggcaaccatccgatttctcaatcttttccccacctttcccgcccttctattccacaaagccgccattgtcatcttggcccgttctcaatgagctgttgggcacacctcccagacggggtggtggccaggcagaggtgctcctcacatcccagacggggcggcggggcagaggcgcccctcacctcccagacggggcggctggccaggcggggggctgaccccccacctccctcccggacggggcggctggccgggcggggggctcacacccccacctccctcccggacggggcggctggccgggccgggggctgaaccccccacctccctcccggacggggcggctggccgggcagaggggctcctcacttcccagtaggggcggccgggcagaggggcccctcacctcccggacggggcggctggccgggctgggggctgactccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggctgggggctgactccccaacctccctcccggacggggcggctggccgggctgggggctgactccccaacctccctcccggacggggcggctggccgggcggggggctcacacccccacctccctcccggatggggcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacaagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgattgtatgagattaattttgtcatttactttcatataaaagtcaaatttgaaaaacacattttctgttctttgagaattcagggaggaaattatatgcctttttcttttcttttcctttctgtagtaaaatatacctaatatacaatttaccattttacccatgtttaaacataaaattcagtggcttaagcacattcatagtgttatactaccatcaccactatttgtttccagaacttcatcatcccaaacagaaactctgtatcaataagaacattaactccccctttcccctccaagtccctggtaacctctattctactttctgtctctatgaatatgcctcttctaggtacctcgtataaatggaatacatgtctggcttatttcatttagcataatgttttcacagtttatccatgttatagcatgtatccaaatttcattctttatgtataccacacttttttttttttttttttgagacagagtcttgctctgtcacccaggctgtacgatcttggcttggctcaccacaacgtctacctcctgggttcaagtgataagtgattcttgtgtctcagctttccaagtagctgggactataggtgcgcgccaccatgcctggctaatttttgtatttttggtagagaccagatttcaccatgttggccaggctggtctcaaacttgtggcctcaagggatctgtttgcctcggcctcctaaagtgctgggattaaatgcctgagcctccacacctggactaccacactttgttaatccacttatcttttgatggacatttgggttctttcctccttttaaggaattttgactaatgctcttgtgaacattggcttaaaagtatctattgagttcctgctttcaatttgtttgggtatgtatacaggggtgaagttgctggaaattatggtgattctatctttaactttttgaggaactaccaaacttttccacagcagctacattattttacatttccaccagcaatacaataggctaccattttctccacatcttcatcaacacttatttttcatatttttgttttgttttgttttttgagagacggtcttgctctgttgcccaggctggagtgcagtggtaccatcatagctcactgcagccttgatctcctgggctcaaacaatcctcccatctcagcttctcaaagtcttggggttacaggtgtaagccaccacacccagctcatattttttataatagccatcttaatgacttgacaatttcattataatgtgtcttggtgtgggtctctgagtttatcctacttgggacttactgggcttattggatttgtagattcacatcttttgttaaatttgggttgtttttggccattatttagataatttttcttcccctttctctttccttatagggacttccatagtgcatctattggtcgacttgacggtgttccataggtctgttaggcgttgtttacttttctttattttttctttctattccaagacttgataatttcagtgtcctatcttccagttttctgattctctcttcttcctgctcaaatctattgttgtgctcctctagtgaatttttcatttcagttattcttttcaactccagaatttttattcttctttgtaatttttgtctctgttgatattctgattttgttaatcattgtttttctgatttcctttacttatttgttcatcttttcctttagctctttgagtatatttaatacagttgttttaatgtctttgttgagtaaatccaatgtcttggctttctcagggatggtgtctatcattttttcttgttactttgaatgggccatgttttctttctttccttttttttttttttttgtatgccttgtgatttttgttgttgaaaaatgggcatttgactgttataatgaggtaactccagtaatcagattctcctactccagagcttactgttttttgtttcattgctatg

SEQ ID NO: 11887 - DNA, 11820 bp, Human
  misc_feature (1)...(11820): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggatggcgacttcacccggcctttaacaacacgtacgcatctttcggcgtcttctacaatggctatgttaattacgtggccaggaactaaactatcaatgaagccacctctgactacttcagttacagtgagtttaacaggagcaaaaaagcacgtggcgccctagggcaaccgaaacgagggttttagacgctgattatgggaaattgaaatctgagttgagtatgagatgacaccaataaattataattttgttagataatagctttatcagccataaagtaatcaataaaaataccagtttcctggagatggatgctttagtgtgtttggggtgaaaatggcgatgaatggcgagttgctttaaacaaatcatggtacaccaaagttttagttgtggctttgtgtaaggaatgtgatgggcacttattcctgcaacacgagaatactatgatttacaagtccgtagtacttttaagaaatgagagaaacagacctaggtggggagggtacctgtcccaccccaccctctttaaagtatcttatctagaaaaggctttgtgaaaaaaaaagtcccgggtctctctcaataacagccctgagcgcagctgttgaagctttctcaggttaatgatttctttcttggatcttaaagtttctttctcttcctttatttttggcattttgcccgttgcagggcctggcaaatcagaaagccacatagaaaattaaatgaaagctattgctaagttccagtctctacaccagtggagttttcaaactcctcttcagcatatttgacgcccaatgagtagtacattaattcctagtcctaaaatcattctgtgaactttctcccaggaatttttgctcagtttgcaattaaaacaactttttttcttctctttttaatggcagaggcggggtctcactatgttgcccaggatggtctccagctcctggcctcaaacaatcctcctgccttggcctcccaaagtgctgggattacaggcgtgagccaccgcgcccagccacagtttgcaattcttaaggcaagggtgacaataggggtcaggggtctgacaggagacaggatttctgtggaaaactgcaccaagggccttctcgccatgtcccgtagtttgaaggtttacaaaggactgcacattttacatgagtcatctcaacgaacgctctcctcaccgcattaacagtccacgcggttacgagtcccattttactcacggggacaccgaatctgtaagaagcctggtcgcttgtcccagcaaaacgagccacggggctcagcggccctaacttttaggctgtagggtcctcgccgaccaccccgccaaaatgtcaggcctcggggcccttgcacccccaccgcagggacacggatcgaaagggtcgcagcaacgcctcccccgcacccaggagcgttttccaggcctttgcaccaacctcgttggctaagccccctgcccggcggcggcccggctgggaggaggtgctttcgggaggcggggccgcggcccggggatcctctcgcgcccgcgggctccaatcgctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacggtgagcccgcggggagggcgctgcgggcaggggagggaggcagggaaagcgaagccgctcctcactcacacgcgtctccccgcagccgccggccctgagcgggacccgcgtcctggccagcaagaccgcgaggaggatcttccaggagcccacggagccggtgagtggcgggcgtggggcagaggggccagggacggccttgggcgtcttggcgccaaagccgcattgtttcctcagctgttcacactcccgccccggctcctttcccgcctaggcggcccctccccagggctgcctcccgcgcccctcggcccatttcccggttcgggcgtgcgctcctctgctgcgacccacggagtgcgacgggacagccacgttttcacatcgggccccgtgaaattgccgccaatggaaaggacttggtccagaaaaacgttagtttcatatggttcgcccggtacttaaatgttttattttctcccccaacagaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtaatcggaggaccccagaagacccctgcaggggtgaccgtcacgcctcagacataaatgcacttggaggttcccgttggcaaggggggctaactgtggggcatagtaagtggtgccagcatacttaaagtttgagtgctcagtgtgagtcctgtaggctttactctcttccttttatgctaaaattgtgacttccgaacctcaggtggacctctccaaggacattcagcactgggaatccctgaaacccgaggagagatattttatatcccatgttctggctttctttgcagcaagcgatggcatagtaaatgaaaacttggtgagtttccaaaacatctttcattcatttgacgttgacgatctgaggtcgaactagttcgctttcctcgtcttgtacgtttttccatgctgagtgcatctgtgtgtgtaagctgggttttatattacatggcatttcctgttttgtaacactttgcagttctttcttatggtattttcccgactctagagaagctgagacaatattaagtggtagcaatgtgatgactctttgtggccaccacatctgccccctcttttttttttttttttgagacagagtctcactctggcccaggctggagtgcagtggcgtgatcttggctcactgcaacctccgcctcctgggttcaagcgattccccaacctcagcctcatgagtacctgggattacagacgtgcgccaccatgcctagctaatatctgtatttttagtagagacagggttttaccatgttggccaggctggtctcgaactgctgacctcaggtgatccacccaccttggcctcccaaagtgttgggattacaggcgtgagccaccacgcccggctctgctccctcctttttgtggctttgctgttttaataataatttggttgtatctcttattgcgaatggatctttcttgacataaattaattaggaaatcgagcgctcacaaatcctattttatatgtatctatttcctgatatgtaagttgagcatatgacataaaatatcaaagaactgtgacaaattggatgaaatatatatagaaataaaccttataatggtacaaagagtgcgatgctgccagtatccgttgacagttgctgctgttggttttttctcaagcttaactttgatgtgttttgccactaggtggagcgatttagccaagaagttcagattacagaagcccgctgtttctatggcttccaaattgccatggaaaacatacattctgaaatgtatagtcttcttattgacacttacataaaagatcccaaagaaaggtgagtattcaagtggtatgccaagatttttaggactcactaattgttgatttattacacatttttagttcacctagggataaaaatgactccagaatgactaagacagtcataggcattcccagcacccgtggtcatgtctgctcttagcaaggggcctaaatgcactttattattcacttagagttgtgaaggtactccttttaaagttggatgtctaccaatgtaaaaccttcttttgaaaaaattcctagatgttgggtaagacaaactaaaacctatgtctgaccatctttgctcatttggtaaagttgttgagaagctagaatgtggggctgcagtgggatggacggggaggacttgcctcctaagaagcctgcagtatagtataggcaaataagacttagtaggagttacataaggcagaggcagcagtgaaccctgagactgatttaggcatgcaggagtttggctgaataaaggtagcttaaggtctgttttgttttggagattggaggtggggggattagaaatgggctgctggagtagtctagatacaaaggtcagctttagggtggcgcgcggtggttctcgcctgtaatcccagcactttgggaggctgaagcgggcggacaatgaggtcaggagatcgagaccatcctggctaacacggtgaaaccccgtctctactaaaaataaaaaaagtggtggcgggcgcctgtagtcccagctgcttgggaggctgagacaggagaatggcgtgaacccgggaggcggagcttgcgctccagcctgggtgacagagcaagactccgtctcaaaaagcaaaaccaagcaaaaaaaacaaaggtcagctttggggaccagaaccttgtatggagtggaagtggtgaagctgcaacctaaagtagccgttgtagactttgaagtacatgaagaggaaaagtggtaacttgaaaggactgaggaaacattgggagtaaagagatttgaacatgtttataggtggaaattgagaaaagaaggcaaagattaggggtacgatcgggggcaaatgcccagaaggggaacaggaaggtctgctggggaagcctcaaaaacaagggagaggcagacccaggtctcagagagagggacagtgagatggaaagaatgaacgacagctgggcatggtagtctgagctagtagtcccagctacttggcaggctgaggcagaaggatggcttgagccctggagtttggttttaccgtgagctgtgatcatctcgctgcactctagcctgggcaacagagtgagaccctcatctctttaaaaaaaaaaaaaaaaaaaaaaaaaaaaaagctgcccaatgtctggtgcccttggcttcagaacacaaagtcatctgggtaggaacagtctgggaaatgagtagcctctcaaggtgggcaccagaataaagggaggcagaggagggtggtaagggagatccagttaactgtagtacccatggatttgctttcctgacctgggatcgacagtgtagcacagagtcctagtaggaagcaatcttagtttattggtttaattattttatgatatagatgtggcaactgaggccaaataatgcacctaatcatagtctgataatagcacagcagttaggattttatggttcttcaaatttaaattctatgattcttcaaattgaacaatgatctggacttgaaataattttaaaggcaacaaatgtccctgctgtactggactatgttttactgtctgtagaccctgaagctcaatatgaactacagaatacccaaacttgtattaatgtaaatcaagtgttgaggtttttaaaagaacactggagggaaaaactgaccagtaaaaataaaacatttcggtgtgagttcttcctttaggaagaggattggcaaatacttgaatttggcctttgtcccagagctcttatctagcagttggtaatcggaggtcttttactgtaatgcttcaattgctgataccgtatgtgcctactagggaatttctcttcaatgccattgaaacgatgccttgtgtcaagaagaaggcagactgggccttgcgctggattggggacaaagaggctacctatggtaaggagacccttgcccctacttaaacctgagcttcattttccaagtaatgttactggatttttggcccttgaataccaactcactagaatcatgttggtgttaactcctaaataggtgaacgtgttgtagcctttgctgcagtggaaggcattttcttttccggttcttttgcgtcgatattctggctcaagaaacgaggactgatgcctggcctcacattttctaatgaacttattagcagagatgaggtgagtctaagtcaaataatagggtgacctaaaccccaaacacaactcgggcatgctcttgtgttcactgacggggacctgagatgctagatggcatatatccacatttaatgtgtgagttcaaccatacacatacttgacaaaagaaggaaatactttcatttactgaaactgttttacttgcattctcaatatattgtaatacatttgtacatatgtattcccctataggctttgaatgcataaaactacaagttctttgttttttgaggtgacggaatcttgctctgtcgttccaggctggagtgcaatggcgtgatcttggctcactgcaacctctgcctcctaggttcaagtgattctcccgcctcagcctcccaagtagctgggattgtaggtgcctgccaccatgcccagctaattttcgtctttttatacagacggggtttcaccatgtttgccagactggggttgaactcctgacctcagggatcaggtgatccacccgcctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaaaaagaatgttcatagtagccattatgttttctcctgtttgatctagaaaattgcccctctacttcaatattaataagcatttcaatgaaatgagtatacattttggtctagtgtatgtctttgattaagtcacatttgaaaagccaggagcatgaactccatcttacttggagcccagtgggcaaatcaaatatggttaccttgtaggagggccttccttactggattgggagataagctgtgaagcttgatgtttaatgcagtaacttgcaaacttgatttacttgaaattgcatacaaatttcctgagcatctaaaaactagccttattactgagctttgcctttcctgctgggagtagtggcaaaattagcactcatggctgtagaaagatcactgagtgaagctctgactcctcctttgccaacacacagcagagcaagaaatacaccttgcctgtcttcatctaggtggcaactttgagggtcttgaatgggactgagcttgccttggtagtgacatcagcagagaagtcagtagttgaagtcatcttccctttgagagttcaagtgctctcagtatggctgagcatgttggataaggagaatgcagaaaaggacaaagtaatttcatattccatgttaatgacagaagtcttctggctttagtgatcttgaacttttttttctagggtttacactgtgattttgcttgcctgatgttcaaacacctggtacacaaaccatcggaggagagagtaagagaaataattatcaatgctgttcggatagaacaggtaaagtgggtgatgaaatgggtcactcaagcttgctagaaaatgcctgtgctttagttgtattcagaagctgtattttggttcctaggagttcctcactgaggccttgcctgtgaagctcattgggatgaattgcactctaatgaagcaatacattgagtttgtggcagacagacttatgctggaactgggttttagcaaggtaaagtattgtttacatagccttttgcttgttttgaagctggtgctctgtatttatatcttgatgtgaaccttttcaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagtttcttgattggtaaaatttgcattttaattcaggaagagaaatattttttggccaggcatggctgtaatcccagcactttgggagaccaaggtaggcagatcacctgagctcaggagttcgagatcagcctggccaacatggtgacaccccatctctactaaaaatacaaaaattagcctggcatggtggcacacgcctgtaatcccagctactcgtgaggctgaggcaggagaatcacttgaacccgggaggcagaggttgcagtgagctgagattgcaccgctgcactccagcctgggcagcagagtgagactgtctgaaaaaaaaaggtgttttttgtaaaggctaacgaattcatttgctttccactggttctgggcaagagacttgccttgtgcctattggcacaaggtgtataggagacaggtacacccgaaaggtggtgcccaaaaatactaactgccatactgcacgtggggtttgtgaagccggggctgagttaacttctcaaccgtgggggagccactcctggggctcttttcccgtttgcaaaacaggtggggctagaggtcttcccagctggagttttgctctgctgtcccacatctgacctgtgtggactccagcacaggtttggattggtccctgtgtctataaaggccctttcctgactcggaatcccacccactttgataaagccttttagaattcatgacacccatccccaaacgaaccaatcattccttgtacctcacgccactgccattcagttcattgaacaaacagcagctctcttgtcaggtgacgttttctacctgcattttaattcaggaagatggggcgctaagccagaggggaggcccctccctctggagcttgggtttactcctagagaggaaaactgatagatgagtagatctgaattgttgggcagtggtgggggcagcagagaattctaaggtggatgggagtgattgggagaggtctcatggggggagatgatgtttccttagtggaggggactgggactagtgtctgaggttgtgctgcttccgactcctgtgttctcatgaagatt

SEQ ID NO: 11888 - DNA, 56968 bp, Human
tgcctccccagtagctgggactacaggtgtgggccaccatgcctggctaattttttttttcaaagtcagggttttgccatgtggcccaggctggtctcaaactcctggcctcaagagatcctccttcctcggcctcccagagtgctgggattacaagcgtgagccctcactcctggcctgtgtatttttaatatacctgaacatccattctctctgtgtgttttatttaacagcctcccttagtcacctgcaaagtcttttccttgggagactgtttcctcaaccctgctgctctggggccaagccctggctcactcctttttattgaaacctgtgccatggagataataggggtagagagatcccttctgtggcagccactgacacactacagcttcgaggtggcacatccccctctcctgaagtcccctcacctccctggcgatgaagtcccacccctgatgggaggtggtgtcaggaggccttcaggtggtcaggccaggagggctccaccctgaggaatgggaccagtgccctcataaaacagaccccggagagctctccccagcccctagcgtggggagatacagggagagaactgtctgcaaccccgaagcggccctcaccagacacagagtcggccaggccttggcctcgggacaccggaaccgttagaactgaaggcttctgtgtgagcccccaggctgtggagttttttgtcatggcagccccagggggtcactaggctcccacttgattccaactcagcgtgaagtcacagccctgagtgccttctgcctgggtgccagccccggagccggggagcgggggagcggggggcggggaggggagtggtggtgtgcggggagtgcggggcgggcgcagggggtggggcaccgcgctgcgggcgggtactgcggagtcaggcaccaagggtccctgcctccctcactgctgagcgcgggctgcaggctggaatggctggagagccccagggctcgcctggacgcccagggcagggtgctcacgggagcatcgagggtacacggggaggaacgccggggttcgggcgaccctaggggcgacgcacagagctgggcgcggccactcacctcggtgccttctaaggacctggacatcctgggccttggcggcctgggggctccattcctccgcgcgctgaatggaagaaatcccgcccgggcatctcggaaggaaagcctcggagtccattcggccctggagccggataccaaccgccagggctttccaggcccgtcccgggaaatggttttcttaggcgagtgcgaggcgggcccctcggttccgatgcaggcgcactagatgccggcaaggcggggactaggcctaggggacctcggtcgcctcgaggtcgcggagaccccaaggccacggaaggacccgcgtctccgcagcccgcacgccgggaagcgtgcagagtcctcggcggggtcccgagcccgctggtcagagcgtggagcggcggggtgggagggacgtggtccccagagcgcggggccaccgtaggggcccctgatggggagggagggaagggtcggcccgacggggtcccagcagttccccgcgcgcagccgctcggctccctccccgtccagctgggagccgccagccctgggcgtccgaagatagcgggtgcccggggcagcccccaggggtgcgggcgagggcgcagggcggcccagacagttcccgcgtggaaggcgcccgtctagatccgcgacgtctcggacccccaggcccccgcaccccgtgtccgaggctccgggacgcgcaggacagtggagccgtggccgccgcttgctcccagccatctgcgtccgggaggcgggggcgggggcgcggcccggggaggtgaggaggaggagccaggacgcgagggcgaccccgacggcgggagggcggggcggggcggaccctgtctactggataagagcccgaggccgaggctgagaccgcccagcgctgcggagcgggaggggaggcttcgcggaacgctctcggcgccaggactcgcgtgcaaagcccaggcccgggcggccaggtgaggccagcgtcgctcgcggcatcggggcgccccgctccttccgcagaccccgaagtggggcgcaggggcgggggccgggggccgggcacagtctggggtccccgcgtcccgcagaccgcgccgtctccaaagtcgccaacagtcgcgggtgccgagcgccccccgatagcgccacatgggaccctgaggccgtccgaggcgcgaggagggtgcagggctgcccctggccccgctccaggctcagaaccgggtgggcacctggtgcagtcaccggcttaggggacgcgtgggtgtctatggctgtgactcgggggtcctggtttcttctcgtggaacttaaccctactaggggtgcggcgcatcccagatccgatcggagtgggttttgtacaccgccgctccatctcgcgggggctttgtctgtgttgggggtggtggcgggcgcgggctgcgcgctggtgctctgggcagggcggggaggccgggcgaggactcgccaggcagcgccgcttcttgttctgggcgcggtgaggaaggacgctttctaacgggccacattttgctgtgtagacccaaaactcgcctctgaggccccgcgttcaggagcggggtcaggtggccccagggcggcggcggcttgccggagactcgcgagctccgcacccgacgccctctcccaacgcggcctcctgctcgcgccgcggaaccccttcgtcgggtgttttacccaccggaggggtcgtgccggttgaggttgtcaccgggtgcgtggcatagctcgtgatagctcatgggtgaggttttgtgcaaacttggatgcagggaaagttgcctgttagagcctccacctgcgacctgcttcagtcgttgtgtgtgtgtgcgcacctgtgtgagtgtgagtgtgtatgtgtgtaagtgtatgtgctcgcctgtgtgtgtgtgagtgtgtatgtgtgtttgtgagtctgtgtgtgtctgtgtgtctgtgtgtgcgtgcgctcgactgaaacacgctgctgctggatccaaatgacagaagtcgccctggctggggcggtgtagacgctcctgctctcctgctcagcgttgcaggggggtttatgtagccgtttggacaggatttcccgggttaccctgctggcccaggagctagttcccgcgatgaagccctgtccatcctccgcccagctctctcacgcggggtggtgccacctgccctaggtggatgtggcttgtacagacactttttgaggaagcagttgtgatggttatgtctaaactctctttacagtggctgattttgcttatataaattttgctctttattactgagtataaacaatacaagcccaggcttggtggctcatgcctgtcatctcagcactttgggaggctgaggcaggaggatcgcttgagaccaggagttcaaaaccagccttggcaacaatagtcagaccctgtctctacaaaaaaacaacaacaacaacaaaaaaacacacacaaaaataacttagccggtgctgtggtgcacacctgtagtctcagctgctcaggaggctgaggtgcaaggatcacttgaacctaggaggttgaggcagtgagttgtaatcacaactgtattccatcctgggtgacagagcgagacctcatgttaaaaaagaaaaaaaaaagaaaaaagaatacagatgaacagtcatgaagacattattgaatgctcttagaagattgtaaaattgctctctggaagtgtgggggaaggtggaagtgatatccatgcattgttagtagaaagccacgctagagctcacacagccttgcactttgataggagtggggaggggtgcaggggaaggaggagcaaaccagagtgtctgtcttgaggcctccatgggccagtgccccagccctgtggtgagggctggcacttcccagctcccgtgccccagctgtaccatctcaggcgctgagaacgcacccatcccttcccagaggaatgcccgtgaatgcctcggggctctgccctccgcaccaggtatgtccctagccctggctgctgaattgttgcgttcctgttgtgtgtttatttttcatattggctgaagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtaagtcccatctcagcctccctgagcatgctggccgggcgggggtcgtaggggcagccggggccaaggcacgtacggaaacgagatgaagctgttcccatgcgtgaagacggagctccctgtgagagctcacggccggtgcagatcctcccagaggatgtcacaaaaccattgagcaggactcggagctgccttgtcccacgcctgcatttcagagtttaggaaagggaggcccgcgaagaagctggggggtggggggcggcagacggggcagcttggctctgcctcctgtttccagaggctatcttcgctttggaaagaaaattctcaaaggtccaaagaacagcctgcggctgactttggcagcctttgcaaagcatgtggaggccctggagcctggagtggcagaggaggcccctggaaagtgactgtgtcccctgcaccctccagaacccagccacagagccagaaagcgaagatcgaggcagggccaccggggacgtccaagaacattggtgatcccttcccaggagcctctttgggcctcccagcctccctgcctggcctccctcattggcctctatgctaggtctgggaagggaggcctggggaagaatctggggggaagcctcacaggatgcctgcgaggaggctggcatttttatgcccatcttgaagaggggaagacagaggcctcagcaggtacaggaagttgcccaaagacagagctgaggggccccatgcctccccctccccttccccaggagagagagtggcaaagctctccctcactccagtcagaccaggggagcagagggaatttaggaggttgagaccagggttccctgggctttgtgctgggggtgggggaggtgcaggtttcagaggaactaggccttaccctggaggggctcccagcacctggggcagcaaagaccctcagccacagtcaataggggcagcctctgagggccccagaagctggggacaggacggcagggcccactcagctcaggggcagagttggggggtcacagattcacaactcaagaggcaaagaggatcagggcaaagtggggggacgcaggccagggaagggcaccccgaaccaccacggggaaggatagtacctagagcaccgctgagcatgggcagggcctccctgtgctgctcttgggtttgacttcatggctcgaggtgcgcaatgacaaggggatccaggagggacgtgtcaggcactgacagcagtggagggcgggcttcgggactcatctaccctagcctgggacttcccgttggagagtggggtgaaacggtcgggccaggacatggatggttgactggggtagccgcccaagctcccacgaggagagatgggcccttccgaggccccaaactaaaggtgcttttctgccccacaggtgccttcctggtcccctacctgctcttcatggtcattgctgggatgccacttttctacatggagctggccctcggccagttcaacagggaaggggccgctggtgtctggaagatctgccccatactgaaaggtaatatgcgggtgcctcccttcaccctggcgcagcgcggatcatggtggtgacgctggagctttcaaagcaagccagccgcatcatgggcatccagccctgctttgctaagacacaggcatggcacacgccacttgaacttgggtcccaccttaaagatctgcagtgacaaggactggatagttcattcccttgctctaggtgagggtcctgcaattcatttgtggtgttactttgtcaagatgctaaaatgtagttaagataaaacacatgtctatctatggatctgccatctacctatcatccatcggtccatccgtcaatcatctgttatctatctatccattatctatctttattattggtctttatatcaatcattcacccatctatctacctatctacctaatccatccatctatcatcatcatctatctgtatctgtttcctgtggctgctgtaacaaatgacacaaactgggaggcttaaaaggcacacgtttattgtctcacagctctggaggctggaagtccaagatcaaggtgtctgtagggttgatttcttctgaggctgtgaggaagcatctgttctagcctctctccttgtctcagagattgtcttctccctgtgcctctttatacttcttgcttctatgcatatctctgtaaccaaattccccgtttttatgaggccagaagtcctgttggattagggacaccctaatgacctcactttaacttgatcacctctgtaaagaccttgtctctaaataaagtcacattctgaggtttgcggggttagaacttcaacagatgaacttgggggagggacacatcccacaattctatctatctattatctgtcaatcatctattcacccgtctgtatctacccattcatcatctattttcttttgatccatccacctatcaatccagttcagtccagcccagtccagtgcagtccagtccagtgtcagtctattctaatggaatcgtagtcagtccagtccatgccagtccagtccagtccagttagtcgtattggagtccagtccagtcgtacgcgtatcgagtccattcgtatcgtagtccagtccagtccatgtcagttcagtccagtgtcaatctatctatggatctatccatccatccatcttctatctattcatctatccattcatccatctgttatccattgttccatccatccatccattcatctatgtatggattaatccatccatccacctatcgacctatccacctatctactagctattgatccatctagttgtcactgaacctttccggctgctgatgtcctgctctggcaccatgaaatggacacacctcgtgttgagtgcaggtggcctgcccagcaccaagccctctcccagcatttctgactccatcttcatgagaccctgggaagggcacacactaggtctctgtgttggagatgcagatgctgaggaccagagggccggggtcgttccccctggtgtccccatcagagcagagtgggatttgatcccagacgtttctgactccccaatccctgcacgcaggtcacacttgcccagtgggccaaagccacctctcaggggctggtggttcagggaggattcaggcatttactcagaggcaccactcagaaaattggcattaagaaaatgactactagaaggtcagcctctggatactcatagaagttctggaaaagctgtgtgtttagaagacagccgagcccagcacggccccaggacgcattaccaatgggtcaggggtgggccttcagaggcgagccgctgacctcccttaggagagggaacagatggcatttcacagctgctgaggtcaggctccaggaggagaagtcagtctcgcagccgtggaaatgctgagactggacaggtgtgatggttcttcccaggcacgagactcattcgttcttaatgggctgcttagtgaatcttatgacttcagtaatttcttcctgggctccacattcactggactgcactgaaatggagctacaaaaagaggcctccctccccacccccacccccacccccaccccacacacatcttcagagtgagagacagatgctttgggcatgcactggtgccagacgaccccttggcgggatctgcaggtagaagtcaaaccgtacaagaattgctcagaacatgcctccgtccccgtcgtcaggtccctgatatcaggtccccaatggaagaatgcagcagccaacggaagacccaggcctgttgttacagacagacaggggcgcgtgtcaaatccggcgttgcagtgaacccaggctaacagttcaagacacacgcgttacctgtgtcctgcctggccctggccagcggcacggacgtgtttcagagaggagtgctgcctctgagcctgcagtcgtaagcgatgctgagcttgcaccgtggtccgtgttggagagtatctgagggctcagagccttgggatgctgagtcagagatgaagccggcccactggggtaggggaaactgaggaaagatgacattgtgctctggcacaggctgcagcgacatccaactgtgctttgctggattttcaagagccaccctggagtctgtcacaagtgtcttacaaggcacagccctgtgccccactcccgccagtgagcctggtgttggagcaagttaaatcacctcttcacgtgcaggattcaggtgaggagggcaggagaaaaagggacctgtaggtccgcagataagagctcatttccttccgtctgtcacacagaaaggatgttcaccaacaaagctgccgttgtgggtcttcatggtgtagtccataaaatgtcaagaagcaatttctaagaatttcagagcaccaactcaacttgggctagtagagaacctctgacttccatcagcgtgagcagtggcacctcgttctgaagaaatgcagccggcggatgtgggcatatcatcgtgttctccacaatgcgcagccggggtaagctgggcagtcgtctcctctgtgtcacagaccctgtgcccacaatcccgcattccatgccgccagcttcgttctgaagactagtcccagaggagggctgcaaagtgtggccgcaggaaggaaggctcgtggccctgcgggcggatcttgggaagagcttgttcacactcacctagtcctggtgaggaaggaaaattgcaaatcacagaaagtgaactgttcgacccacgaagggatagatgaatcagtgcaagaaagctggacttctttttagagacgagacaccttgagttgttgaatctcagtaacgctgcaggttccggtgccagcgtcccgtttgttctgcctacctgtcaagcgcaggatgccagtttagaggagactgacattgcttatgaaatcagatgtacaccatgcacccccggcaccctgatacatgtgcctttgtcctttttaaaaatctggttaataaaaatgcatacgttttcatgtctcattgaatagaagtgccacgtggtaaattaagacatcagctaaagtgcccacaacaatcattgtggagctaaaaggccatccagccctgagcaggtggcaattccatgggggaatgaagccagctctccaggaagcctggttgttcctggcccttcccctcctgcagacctgcgagctgctccctgctcctaactgggagccaagatccacccttgaaagccagagggcggagttcatggtgaggcccagctgctcagcagccatgactcacgtgcatttcccgtagtctcaccagagcagcttgggatgggcaccacagccagaggggcctctggggccttcagccccgcagtgcaccccagggtcctgagaggtgggtctttaaaactctccgtctcctcccttcccctcgctctctttccctctccctgtgtctctttctgtctctctccctcctttcctctctgtgtctctcctgttctgtctcttctcctctctgtctctctcctgttctgtctcttctcctctctgtctctcgggtacatgcacacacagcaagcacatactaaagacacccagactgacacagagaggcgtcctctcccctctttcttttcttttcttttctttttttttttttttgtgagacggaatctcgctctgtcaccaggctggagtgcaaaggcgcgatcttggctcactgtcacctgcgcgtcccgggttcaagcgattctcctgccccagcctcccgagtagctggggctacaggtgcgtgccaccacgccccgctaattttttgtatttttagtagagacggggtttcatcgtgttagccaggatggtctcgattgcctgacctcatgatccgcctgccttggcctcccaaagtgctgggattacaggagtgagccaccgtgcccggccctctcccgtctttcttccaaagacctgcttgatgcctcctgtgaggtatggaggggctgctccaccagaggcttcctccagcgggatccgtgcatgcgttgacaacaccctctcctgaagccagctctcgtgggtgccctggggtgtactggtgttcaggggtggggcagggtggccgtgctctggtgggcgaagcaccatttgcaggcacgaccctcagccagcttctgtttgtcaggtttcggtttcattgccaagggcaaccccattttacagacgccctggaaaccccaccattcgattgtattgaatataaaatattttatagtcagtcatattttagtgtgatttctcaaacacaaaacaaactacacacaaggttaatataaagaaaaagatactaagcaaaaataaatttaaggaaatgggccttaaaagctatgcttgaaattcacacttagcgccgagcttcctgggagtcagacaggagggaagggaagcgccatgttctcatgaatgttttccctggaaacgcgagcagggactttgcctgccacctccttggggagacagtctcccgtgtcactaaatggtgtttaagaaatgtgtcaggtgaagcttcatctggagcccacagtgatgtcatgagcagagatcactagaaggttctgtagccaacagggtagtgggtttcctgcgtctgggccttcggtgagcttgaggagctcgtggtgaagttggctggttggtgaggggctacacgtcagtggcccaggtcacgggctctgccttcctgaagggcagggcttggagcaaccgaatgcctggccagtgctgacagtggccactaccgttcaagggagccatttcctcacccaggtgcccagggaagcatccaggaggggactggccaccaccgttcaagggagccatttcctcacccaggtgcccagggaagcatccaggaggggactggccaccactgttcaagggagccatttcctcaccgaggtgcccagggaagcatccaggaggggactggccaccaccgttcaaggctgtttcctcacccaggtgcccagggaagcatccaggaggggactggccaccactgttcaagggagccatttcctcacccaggtgcccagggaagcatccaggaggggactggccaccactgttcaagggagccatttcctcacccaggtgcccagggaagcatcctcaaccaggaggggtcctcttggtaagggggactctggtgtgggggctgcactgtcccatggatcagagcaggcccatttgctctgggagccgcatcagccagtgtggccagtggtgatgtcatgcacagtggccatggtgatgtcatgctcccatggtggccctgccaatctgtggtgcagggcaggaaacaaaagcagtggctctggaaggacccagggtacactcagcccttccttcggactctggattgggatccactctggtgttgtttgatcaaggacttcccagggtttcaagctaaggacttgatacagaaagttttaaccttgaaaaattttcaaattgggcatccattgtcagttaccaccatggaaaaccctccacagtgctctctggaaacaatgtggctcaccgacagtgtggctcccaacctggctgcctgggtgagttcactgtggatcacaacccagcctctctcctaagggactccggacagacggtaatatagaattatttaatatggaccagatccacgtgggagaaggccttccaaaggcaatccgtgacagactgcaatacagaattatttaatatggaccagatccatatgggagaaggcttttcaaaggcaatccatgacagactgcaatacagaattatttaatatggaccagatccacataggagaagaccttccaaaggcagcagcttggctttcatcgtcaccactactgagcatgctttccaagggggattacccgcactcctgatcttagatttgtttaaaacaaagttttgagtcttctttttgctttcaaggtaggaagagaactttactgaggtgccctgagcatgagaacagcttctcctaaggattgagactataaaaagcaacccaggccaccccctgcaaaagtcaccttgaaggtatgctcctaccccggccatgaacaggcaagacggcatggtgcctactgggttttaataaagtaaatcaaagttgtacccaaactaatcatgtcagtaaactgagaagaaatgtggaaatgaaaaaaattcttcctggagcttagtaaagtgaaccccagtagcaagaacgtgatggtgcccatccagcagtgaacaaggaggaagtcatctgaccaccaggcccatctgcccaccagtcaggctgacaccactccaaagactgctgaccactgagttctgttccagtttaccaggagaccccataaatgatggatcccaaattccaggtctgtgatcctggaaaggacactctaaaagaccgtggatggcattgcatggccatggatggccctggctggtccttgatggtcttgcatggccctggaaggcctcggaaggtcaaacatggctctgagtagtccttcatagtcatgcaaggctctgggtggcccaaggaagccctggatgatcttacctgccctgggtggaccctggtggtcttacgtggccctgggtgattctaggaaaccctggatggtcatgcatgggtagtgtgaccttggatggctccacatggctgtaaatgagctcagatgactcttctgagtagtcttgcaggagaggcatgagcagctatagatggccacagatggccatagatggctatggatggctctggatggccatgggtggctgtggatggccatgggtggccgtagatagttatgggcaaatgcagatggctgtggatggctgtggatgtctgtagatggctgtggatggttttgaatggcaatggattgttgtggatggccgggtggatgtgggaggttgtggacagccatggatgactatggatggctgtggatggatgtggatggttgtggttgggtgtggatggttgtggatggttgtggatggatggatggttgtggatggccgtggatggatgtgggtggccatgaatggttgtggatggctatggatgaccatggatagttgtggatgtctgtagatggctgtggatggttgtgaatgacagtggattgttgtggatggccaggggtggatgtggatggccatggatgactgtggatggctgtggatggatggatggttgtggatggctgcggatggatgtggatggccgtggatggccatgaatggttgaggatggctatagctgaccgtggatagttgtggatgaatggagatggctgtggatggccatggatggccctttgcgactcaaagtggccctggattagcctgggtggccatatgtggtcctgggtgccctccatagtcctgaatgagcctggtggctgtggatggctgtcaaggaccccaggtgtcccttagtgactattggcagtcttgatggctctgggagacactgggtgttcctgggtaaccctagacgacctttgatggccctatttgcatgggctccctaggtagccctgggtgcttctgggtggccgtggatgattctgatggtttcacatgggcctgatagccctggttaaccatgagttgggttgccctgggtcacccagagtaccccctagatggcctcaatgatcctggatgactcttatggatcctgagtggctgtggtggggatggatgaccatatgtggctgggggtgaccttggtgtccctgggggtctctgggtgcataagggtggccctggatactcgccatagctctgggtgaccttgctggctctggatgtctctcagagacaccctgaaagtccttgtgtaggagtgcatggttttggggagtgggcagcttcttctctgtggtcacagtgtgaaatctggtctcaggcctttcacgggccttccctgcatgtttgaagatgctgtctggcatcagggctgtccaggagttgtgggctcagggtaatgtctcccgtgaggggaggtggaagggacacgttgctgatggtggctctgtgctccacctgcgtgggctccatggcctcccccttcccgctaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgagtaagtgggagtcgggtcctcgggaacgggagagatggcgcagccaggtcccccatggtagccccttggttggacaccagcccttgctgactcccagggtgcggggagggggaatctgttcctgcactccatccctttagtgctctggaggggcacatttctgaatcactgtggtggtctccaggagctcagcaaagctcctgtagggcgagccctcagcaaggatggggcactgagcagctcccttggctgctcccagcggcagctcagggtgggagggggctgatggggaacacagcagaccctgtgcagaaggtgggcaagctccagtctctgggagctgcagtggcgcctctggagtgagtcagccccatgtctgggctcccttcctccctacccttcctctgtgcatagcatggggccgaactgcctcactccggcccttgccctctccagaaaagataactttctgggtgtcactgcgcaagaagtctctggcttcagtaggcagcccctgtctccagggtgacccagccgtccgcttttcacaagactttgttttgttgtttacctgcatggctttatttctgtctctgggcctctttccacctcccatgccagcgtatcccatgtccagcagcctcctgggtctctgtctccttctccctttgccctggccaggcctgacctgcacagtcctccccagccaggccagttcctcactgcccaccccagccaggcccaaccctcactgtccaccccagccaggcacaaaccacaaagtccaccccagccaggcccctcgctcactgtccacctcggccaggcccaccccacaccgtccaccccggccaggcccgcccctcatggtccaccccggccaggcccacccctcaccgtccaccccggccagacccaacccacactgtctaccctggtcaggcccatccctcactatccaccccggccaggcctgatcctcactgtccatcccagccaggcccaacccatacagtccaccccgaccagccccaacccgcacagtccaccccatccaggcccgtccctcactgtccacccaggccaggcccgcccctcaccatccacctgcagcacctgctttcctggaccccgatgtctccgatgaagtccttttgggccccgtgccagctcctgctggccctccctcgtcaccaatggcctggcccagcctggaagggtcgttactgacacccaggggttccctgtttcccctggacccctcccggaatctggatctggcgggtgccatccacatcttcctgccctcgccagccgggcctggggcctcgtgccgggtcgccgttctgacaggcggactcttcgactcagccgtcattttggagaggaggagaggacgtttgcgcgattctccccagatccagtgtttcccgtcagccagggcgctcctgtttggggggctcgcttgcctggttagacgcatcttattcacgtttatatgccaaaatgagtccacttcaaggtaggaaaaggaactttgaccagtaagactaattccagttttaacagccagtaggtgcctttgcaaaatttgttttgagtcagaaaacagggagcttgaaagcaaatgaagcatctcatgttaagtttgtacaagtcacggtgataggaacagccaggcgggaggtgagcagagaagcccccacctcgcctctgctgggggaggatcatccccgagaactttggtcttggtctgcaagggcaccttcggggcgcacagcctcccagagagatgctttctatatctgaaaaccgtatcaacagacatcactgaggtcttttcctgcaaggaagggaccttcgccctctcctgggggtcttgtcagagatggctgagatggagccttcgggcaggccggagggtgtggcttggagaaagtagggctgatgctgccggaaagggaccagttctcatggtgggcaggcgttcggtctctcaaactgctctgcactcagatattcagaacccaagtgcttggttctagaattcctcctcgggcatggaagcatattgccgggactggccttggaggtgaggagccggggcggaggcaggttttggggggccacccggcgtttttcttagagcatgaggaagaccatgggtcgcgtggggtgagcgttgtgtgggcctttcttgtggtttgggagtggacaagagtgacgaactctgaggaggacggtgccacgatgggagagagtggcccaccaagtacccagcaggaggagagagagtccaggctggggcgccaggaagacgctcatgggaggagggctggtttcagaaggtggggcaggtgggagagaagatgcacccgggatgagtcctggttgtttgcctgaagacacttggacgagcatcgccataggaagcgcagctgcaggcaaggtcgtgggagagtctgggcaggactctcgtgggtgacaggcaagcgggaaatgataaaatcgtccaaataatgcacagtcacaccatttgtccaagtagattttaacattctcgagggagaaaactcccattgcgtgtggatggcctgttcacacctacatttccctaattaaacaccctatgagcaccccaggcctgggctgcatgtgctcttgctgtgtgcccagctctcagggttagcatgtgatcaaagagaggggacagcaggagaaagtggggggcacacagagccaggggcagtggccgcagaggtgccaccagggcaagagcctgagagttcccggtacccaacgccctgttaaagctgccaagtgctgccatgtggggactgccttccttttgtttgggcagtgtgggaaatgttgactcattgaagtgatgttcagataacagaattggagaggaaaacttagtgtagtgattagtccagtgattcgttgttaagaatgctagaaggaaagaacacgtgttattattttaaacgatcagactagcgaagtctatttggaagttctcagtctggaaggaaggaaggaaacagaaaggtgcccagcccttcactcagaagccctgtccgcactggcacgtggtacactttagctggcggcagctcaagagcagacgtggggagttggagaaggtttaagatcaattcacaaatgattaatgacccaaggcactgaggtgcttggcactcctcccacaccttctgaaggtgattttcccaccagtgggactgaggttcccctgaaacaggccccagtgactcttggggagcagggaggacagtcataacgtactcaggtctgccaggggtgttctggatttcaaacctgctttataaagcagatcactggacaaaggatgtcgggttcctgccagcgcatgtaatcagggagtggatgtctcactgtgaaaggccataaaggccagagtggctgtgatgtgtgacagtgcagctctttgtcctagataatgggcatgcctgactttgtcagtaaacacaaaagggattgagtttcctacacaatgtacgaaacatgacgtgtcataaatttgacaactaagatgttagcaagagtagatctgaaagggctttatcgtgcgtttttactacaggtcctcaggaagtaaccgtgaggcctgggtgagacgctggccatgtcttctgggccctaagtcagaaaagactgctgagctgccccactaatggtgcttcctccatgtgccatgaatgccgtgtgcagtgctggctcctacacccagtgttcctcagggttggcaaatgaaacgtatcctgtgggagttgctggcacccctggcccccaggggtcccagccagccttcctgcattgccacttccttcttgggcagcagcccacccaccagagggaggtggcagaaatggttcctggagagaaataaaaggaacccttccttgtaggaacctggagattattgattggctgcatcccacacatttgatatgctgtgttttcatttcaaaaccccaacacaggaccacataactgtgaccagtttacagtttccccacttccataaatacttatcgacactgcctaatataaattataaagttataaattaaagctattaatttgcctcaaatggactgcattagctgcatcccacaaagtttgatatgctgtgttttcatttcattcagttcaaagtattccctaatctttcttttgatttctatttgactaacagggcatttttagaagtttgttgtttaatttgaaatatttggaagtttgctaggtatttttgttattgatttctaatttaattctgttttggcaagatgatatgcttatacatctttaatattttaaaatatattgagacttgtttatgacctactagatggtttacactggtgaatgttccacatgcacctagaaagaatatgtattctgctgtctttggttggaaagttgcataaatgtcagagaggttatgttaggtcactgtgtttttcaggttttctacatccttactggttttctgtccacttgctctatcagttactgagaaaggggtactgaaatctcaactataactgtagatttgtctatttcttttcacttctatcagtatttgcttcattcacatattttgaaactctgctatgaagtgcatacatgtttattattattagtctttgaattgaccgctttaccatttgaactatccttctgggttagatttctcattctgaagtctactttgtctgatagtaatatggccaccccaactttcgtatgattactgtttgtgtggtattatcttttccagccttttatttttaaactatatgtgtcattatatataaaatggatttattgtagacaccatcgagttggttgtgctttttatccaatatggcaatctctgttttttaattagagtttccattcaataattgtcagcatggctggctttaagtctttcattgtgctaattttttgccccctctcttctttgtttcttgtttcctctatttattccctgttttgaattaattttttaggctttcattttatcaacactattagctaataaactatagctttctgttttcatttcttcgtggattttatagggtttacaacactgaccttcaagtgacatgataccgtttcacagagcagaagggcctacaacagtagacttctgttttcctcacatcctttgtgcaattgttgtcatagattttttctacaatatgtatcaactccatgataccttgctgttatttctgctttaagcatttacattttaaataaatctaacaaagaaatgttttatatttacctgcataggcaccatctctagtgctgtccggtcctgtatgtagattggggtttccatttaagaccatcttccttccatctaaagaatttcctttaacatttctcatagcgtagacttgctggcagtgattcagcttgggctttacacaaaagtattttgccttcttggggggctattgtggtaagctatacatagcattgcttttaccaccttagccatttttcagtgcacagttcagtggcattaggtacaatcacatgttgtgcaaccatcaccatcatccattggaactttctcctcctccaaagctgaaattttgtccccattaaatactaagtccccatcctccctcactgcagcccctggcagctaccattctactttctgtctctgtgaatttgtctactctaggtccctcctctgagtagaatcacttatttttttgtgactgccttattttccttagcatatgtcttcaaggtttattgaagaatttcagaaccagaatttcattcctttttaaggccaaataatatttcaattccattgtatggatatatcatgttttgtttatccatttatctttttcctttttagagacaggatctcactctgttgtccaggctggagtgtgcagtggtatgatcacggctcactgcaggcttgaccttctgggctcaagcaatcctcctgcctcagactcccaagtagctgggactacaggtatgtgacaccacatccagctaattttttaaaattttttgtaaagtggggtcttgccatgttgcccaggcctgtcttaaactcctgggctcaagtaatcctcccgcctcagcttcccagagcactgcaattacaaatgtaagccaccacacctggccagatctatttatcttttgatggacatttgggttgcttccacattttggctactgtaaaaacatgctgctatgaacctcaatattgagtacctacttttgagtagatacccagaagttgaattgctggagctatgtgataattctgtgtttaattttttgaggaaccaccacactgtttcccacagtggatgcaaatcggaacaagggttctgatttccccacatccttgacaacacttactttctgcttgtttgttttgatcatagccatcctaatgggtgtgaagtggtctgtcattgtatttttgatttgtatttccttaatgattagtgactgttgggcatctcttcatgtgtttattggccatttgtataccatctttggagcaatgtctattcaagtcctttgcccatttttgaattgggctgtcagtttttttgttgttgagttttaggagttctttacatattttagatattattctcttttcagattaataggtgatttgcgaatattttctctcattctgtagttttcctttttactctgttgatagcatccttcagtgcacaaaagttttaaattttgatgaagtctaattcatcttttgtgtcatatctaagaaaccattgccaagtccaagattgtgaaaatttaccctatgttctcttccaagagttttatggttttagcccttatatttggctcttttatccattttgggttaatttttctatatcatgtgaagtagctgttcactgattttcctctggttgtagatcacatttcttgcttcttgtcatgtctagtaattttttattagatgctagacttggtgagttttatactaatgggtatttagctcttgtcgtctttgtttagagagtgttagatttgttctaataggaagttaacgtgctttggcacaattttatcctttggaagcttgtttcaccacctcactgccttggctccctcttggtaaaacggggtgagagggctgctgtgaggtcatcacaatgatgcatgggaggcctgagcatgcctggatcaccaccagtggctccactgtcacccaattgaatcatggccaggaattcaccaggaaaaagagcccagtagaaattgggaggtgctgtgtcttttccacgcctggtgaacatcctgggccaacacttttctggtcctcccaactattatggcttatgaaacacctgcacgtaggcctgcacttatgccccttcccggatgtcctttgatggtctcgcctgccctgccctcagaagcatggacatgctgggagacgcacagctttcccctgctcctggcatggctggttcccatgctgtggtcagctctggggacccctcttctcaggttgacagcactcaggagtgtccggttctctaaattgtctgtgggttttcaaataacctcaaagcacagtgactttctaatctcgagaaggggctcgacccagtgtgtcaaggtgctgcgtctgaagttgctttcatgtttaatgctgagccagctgtgtgtgctgtggacgcaaccttgtgagaaggccctgagtggggcagcgcactttccctgggcctccccctctggtccaggagggcctgtgccatgtatgggcattgactgagtttgccttttctccaggcacctgggcaaggggagagggtgtgctgtctggtctgggtgtataattcatgcacgtgtgtgtgtgaggcactgaggctgccaaggcgtgggcgggtggcatgctggggtcagtgacaccatgggcagtgagggaggagtggtccgggctgcacaaagttgctgggaggcctcagaagctctcagtgatgagaccttgctgggggagcagaacgacggggactggccagcaggggcagagcctggtgtgtggcaggaggagtgagaagaaggccctgggagtccccactgccccaggaagggcaggcgtgacctccaccagctcagacaactttccctgcacagtgcgggtgacggatagcctcttgactgagcggcttgcccttggagaagagcagagaatggtggcgatggtttcagtggtgcagccatctgcccacccggccaacctggggcctgtgccaacctggggcctctgcctgggcgccctccaggataggacggaggcactgtccagcgctttcagggctcgtggggccttccctgttggcaacagccagggtgtctggagtttgaagagccgaattcctgggacatggccctggaatgccttgcagctggtggaaagctccccaaggctgcattcggccgggctccaccatgggtgtcaggttttatctcctggggacctcagtggacccacaacagaagcaaacctgggcagtgggagctcctttcataacgcggcttctgtctgtcacagctcctgactctacggtggcagcggcacggctgttacagttgtcttggccccaagtcacagtctgcagtggtgacgcagctgactgcatgtagcctggtgcatgttctcccacagagagtgtcaccaggatggaatgagttcccacagacagggggcccaggacctgtgcctggggcaaggagcacagccgatggtcagctccatccctcaccctctgttctgccctttctgagggatccttcaaaaaacagtggaactgcgagtgattcctgctggagcagagtcatccactgaatctgttccttgtggaatcctcatagcagcaggggctgtgagcaggtgtcgtgagccatcccctcagaaaacagtgctggctggtgcctgtgtgcctggcattattgctagagtttgctcggcctcatccctggagagggaccctggggctgtcttgtgggcagcagtgggtacccagcagcatgggcagcactgtgggcagcggtgggtacccagcaccatgggcagcactgggcagcggtgggtacccagcactgtgggcagcagtgggtacccagcactgtgggcagcacctgtgggcagcagtgggtacccagcactgtgggcagcagtgggtacccagcactgtgggcagcacctgtgggcagcggtgggtacccagcaccatgggcagcactgtgggcagtggtgggcacctagcaccgtgggcagcactgggcagcagtgggtacccagcagcgtgggcagcactgtgggcagcggtgggcacctagcaccttgggcagcactgtgggcagcggtgggcacccagcagcgtgggcagcactgtgggcagcggtgggcacccagcagcgtgggcagcactgtgggcagcggtgggcacccagcagcgtgggcagcactgtgggcagcggtgggcacccagcagcgtgggcagcactgggcagcggtgggtacccagcagcgtgggcagcactgtgggcagcggtgggcacccagcagcgtgggcagcactgtgggcagcggtgggcacccagcagcgtgggcagcactgtgggcagcggtgggcacccagcaccgtgggcagcactgtgggcagcggtgggtacccagcagcgtgagcagcactgtgggcagcggtggttacccagcaccttgggcagtactgtgggcagcggtgggcacccagcagcgtgggcagcactgtgggcagcggtgggcacccagcagcgtgggcagcactgtgggcatcggtgggcacccagcagcgtgggcagcactgggcagcggtgggtacccagcagcgtgggcagcactgtgggcagcggtgggcacccagcaccgtgggcagcggtgggcacccagcaccgtgggcagcactgggcagcggtgggtacccagcagcgtgggcagcactgggcagcggtgggcacccagcagcgtgggcagcactgtgggcagcggtgggcacccagcaccgtgggcagcactgtgggcagcggtgggcacccagcagcgtgggcagcactgtgggcagcggtgggtacccagcagcgtgggcagcaccgtgggcagcggtgggcacccagcaccttgggcagcactgggcagtggtgggcacccagcattgctcagcaacttccttttggtttctgtggctccttttcttcaaagacccaaggtgccctccgcctccgcagctccagtgagcaggggtgccaagggcagatggtgaggcagggcttcctgggcctcccacgtgctccacgggtttcaagggcggccctgacacctctgccagggcctgtgggccagacctccctggaaggcatctcttgtccatcagactggatgctttctgccctgctgagatggggagggcaggtccccggacaagctcagccgtccagttccaggtgggttgacagccacccacagagtcccccgctgactcccctctgcagacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtgaggctcgggggtcaccaattgggcctgtagacatggggccaccaagtggacatgtggccgtggctggacaggaggtgcacgtgtggcctcagttgggttttgtgctaccaatgtggccatggccaggttggggtggacacatggccatggttgagtttgggagactcatatggccataatcaggttgggagtgtacacgtggccatgattgagggtacacctgtggctgtgccgggttggcttgggtagacgcgcggccatgggtgggtggggggacacgtggccgtggctgggctgggcggacacacggcacagttgggttttgggtccacgtgtggctgtgtttggggaagggcctcaggagggaagcactcacagcagtgtttctggcaggaaggcacacacaagatgatttttttgttgataaaaatactttgggaggctgagacgggcagatcacctgaggtcaggggttcaagaacagcctggccaacatgatgaaaccccatctctactaaaaatacgaaattagccaggcacggtggcacgtgcctataatcccagctacgtgggaggctgaggcaggagaattgcttgaacccaggaggcggaggttgcagtgagccaagatcatgccactgcactccagcctgggcaaaaagagcaaaactccatctcaaaaaaaaaaaaaaaactttggttgttatatgggccaaaaccagttttgaccaagatacgactcctcccttggaaaagtgcgtgtagtatggcaccagccacgggagcctcccgcagggacacagcccagagcagcccttcatcgtgccacagtgccgttcaccagtgtgaatccactcacgtcccacgcatcagaaaacccccatcagccactcccagctactctggcggaccgaatgcagaaaaggaatgtgctttccctgccaagttgttcttccctttccatccctggggagggtgtgcaggacagaaagtgtctgaccttctcactccaaggagcatttgctgagctggcgtcccaggaaatgtttgggaattgggcctcccaatcagaggacaagccgtcagggcaacccggtgcccttgtgccagtgtctgctcccaccaagggccctgcctgtgcagcctggtgacactgtcctctcctgcaggtggtatggatcacagccaccatgccatacgtggtcctcactgccctgctcctgcgtggggtcaccctccctggagccatagacggcatcagagcatacctgagcgttgacttctaccggctctgcgaggcgtctgtgagtacagtctgctcactgcttcacagtccacaggggctctggcattcccaggtttccatatgcattgcctgccagggctgagaggtgtcagagttgcagacaccagggttctttcctcgggaagccaaatcccaagtacctgtgatacagcacgagtcatctaaatcaaattacatcagaaactccatctagactcaggctgcagctttggtcagcaaaagaagacataattcagggttaaaatatttggagaaagcctcccggagagaggagactcagctgggccatgggggatgggacccttgtccagaaagggaggagaaagggctgcacccttcctggcaaacaggcccagaaacagaagcagctgttggcggaaggctggcatgacaaaaatggcagctcccttggggcatcgttggaaatcaggtggactaagtgggggaggtggcaggccccaaagccgcccaggggcatccatgttgctgtgggaggacaatgcagcaagaggggaagggccatctcagctggggtatgaggcaggaggccgttgagaggtgctgccctgtgtgggtgggccggtggagccaggtctgggggtcatgaggcaagtgtaaacccaaggcagaagtgggaaggaaggggagaagggatgggcgggcatggctgcaagcctcccaggaagccccagggaggcagcagctgacaggtgcagtgagagagggcacctggacatggcacctatgaggctgcaaagcagttgggtgggggtgggggtggaagtgtgcctgcagcactgaaggggaagccctgtggagacaggagccatgggtgcagcaggcgtgtggcccacgggagccaaggaagagagaggaggacaaccagggcagcaaaatcagctgtggccgggggcccacaagtgcagagctggagccagacaaaccatgaagtcagcagggcgtctggaccccagaaaggccaaaatgaagccaaggggtgtgtttgcaggaccatggcatgttacagaatcaaagaaaaataccacaaggacaacgtagagcctagtgctccagctaggaagaataggcagccccaggaggaggcaaaacaaacaccagtgcatgtgaaaagatgctcactggagaacaaattacaaagatgagatgtcagaaattaggtggagacagtgaatagattggatggatggatggatggatggatggatggatggatggatggatggatggatgaatgctaggtaagtaggtggataggatggatggatgataggtgggtagatagaatggatagataggatgggtggatggaaggctggctggctggatgtatggataatggatgggtggatggaggaatggatgataggtaggtagctggatagtatggatggatggatgatggatggatggatggatggatgaatggatgatgcatgggtgaatgggtggatgaatgatagttagctagataggatggacagatggataatggatggatgatggatgggatggatgggtggatggatgatgggtggattgctggatgatggatggctgggtggatggatgaatgataggtaggtagctggatagcatggatggatggatggatggatgatgaatggatgatggatgggtgaatgggtggatgaatgataggtaggtagctagataggatggatggatggatggataatggatggatgacgggtgggtggatggatgatgggtggattgctggatgatggatgtttgggtggatggatgaatgataggtaggtagctggacagcatggatggatggatggatgatggatgggtgggtggatggatggatggatggatgatgggtggattggtggatgatggacagatgggtggatggatgaatgataggtagctggatagcatggatggatggatcgatgatggatgggtggatggatggatgatggatgggtggatggatggatgataggtaggtagataggatggatatacaataggatggatggagatagatacatacacacacatgtacttcatatattcatagatgatagacagttgatagattatagagatgacagatagatgatagattggtgatggattgatagatgacagtgatagatgatagatagatagatgattgattgatagataatagatgatggattgatgtatagtgaagagaaatcaggaaagaaatggaaggaaaggacaattgcaggtcctggagtgaaagtgcatgaggtgaggcccagggaggcagccatgggcactggctctggtgtggcactgggcagaggcctgagctgcacacacagatcagggtgaggaggaggcaggcgctcccctgtgacacctgatccagcctgcagctacctggccaggcaggtggctgatgaccagcatgggagccacatcagggtatgagcctctccacccactgcccacccagccactctcggcttggctcctcccctcatgctgaaacactggccacctgcagagtcctgactgcggggcctggccatctgcctccaaacacactgtcccaggaactggggttgccttgaggctctgacatgctgcccaaaggacagagggccccgccccctctgcagcacccagttcccttgctcagtcaagctcaggcaagcttgacctgggacctgggatgccctgagacccacctggcctccccagcaggagcatctggtgtctctgcctcagcatcctggcccacaggcctgtaccatgggctccagggacttgcaggaacagccctaactgaccagtccctcaaatgcctccaagggggggttggctgctccttctcccccatccaaggcccagggaagggcaaggtgggcatctgagtcactgaatggtctccgcagtgccctcaccttagcaggttgtggctgactttttaaaataccacaatggtccaatcgtggacccacccacctttcctttcacgtccagagttgtgggtgccatccaccgagttgggcaggcacagcaccagtgtctaagctgcaggtgggctcctggccatgcccaggtgccactgtgcacctgtactgctcatgttttgggaaggatacaaagcaggcattgctggtgtgcgtccaatcaggacaccatcatcatgtagcatgtggatgggtccatgcctttctgagggttatcagggtgctgccatcatgcagcatgtggatgatccatgctgttctgagggttgtcagggcgccaccatcatgtagcctcaggatgagtttatgttgttctgagggttatcagggtgccgccatcatgcagcttgtggatgatccatgatgttctgagggttatcaggaagccgccatcatgtagcctgtggttgagtctgtgctgttctgagggtttcagggcactgccatcatgcagcagggcgcacatgggatggggggacacactcagggggttgtgaagctggaccctgatcaagggaggatggagaccccgctagggctggtgtgagtgtggataagtccatgctgttctgagggttatcagggcgccgcggtcatgttgtgtgtggatgagttcatgactttctgagggttatcagggtgccaccattatgcagcatgtggatgaatctgtgctgttccgagggttgttaggacgctgcggtcatgtcatgtgtggatgaggccgtgctgttccgagggctattaggacgctgcggtcatgttgtgtgtggatgagtccgtgctcttctgagggctattaggacgctgcggtcatgttgtgtgtggatgagtccgtgctgttccgagggctattaggacgctgcggtcatgccgtgtgtggatgagtccgtgctgttctgagggctattaggacgctgaggtcatgctgtgtgtgggtgagtccgtgctgttctaagggttattaggacactgtggtcatgttttgtgtagatgaggccgtgctgttccgagggttattaggatgctgtggtcatgccgtgtgtggatgagtccatgctgttctgagggctatggagcagggcacctctggttctgtggaatcgctgccttgatactccatggggaatcccagatcaatgaacacagacagccccctgcttctcaggctcttccaggccgctggcccgggagggttcacttcctgaggctgcatcttccaccagtcgtctgctgccatttacttcttgaggatggtgttgagtttagaggcctcagtgtggggctgggacaggaagggtgctcaggtcctttgcctgtggcctgcgttctcctgggacagcctctcaccgccctctggctctgcaggtttggattgacgcggccacccaggtgtgcttctccctgggcgtggggttcggggtgctgatcgccttctccagctacaacaagttcaccaacaactgctacaggtgagcccctagcagggccaggcaggggcctcatcaatactagggagaggtcgctgacttccagaaatagtgtgtccctggatgagaacagggcggatccactgaacccgcaaacctgtgagctgcgtggcctttcagacagaagcgacagcgaggcagctcccaacacgattttgatttcaactttaaagaaggcactgaagccagtgggtgtgtcgcctcctgggagggacctgcctaggtttgacctgcggccagattccccactgagggccccaagtggcaaggccagcccctccctccacaaggacacaccctcttccctcacaccagccccggggggtctctgtcctccctcgctcagggtccagcttcacaaccccctgagtgtgtccccccatcccatatgcaccccgtgttacttactggcaggcacctgaagccccgtgccggaccccaaatccttctaaaaacagaaacagaattttatccgggatctgcttgctttgacctttatggacttgtgcttactttctttcacatcatgaggctagaaacacggtaaaaatacaaggacagtgtgtgcagcagaatggccaggcagaccacaagcaggcttcactgagagtgggcgctggaaggcaggtcctgaggcagcgcctgcccgcagcccacctgcgtccacctgggtccaggtgctctgcagatgaagtgtgtggtccttccaccccagtgacaggccacacaggaacccaggaggaggacgctggtgccctgaccgaccccaggaccctccctcttcgtccttcgcttgcctccagctctctggtttctcagccctcagagtggggcccccaggcccgcagcaccagcgcccttgggagttcatgggaaacacagcccccgagaccccatgagacccgcccagtcaggatctgcatcttagcgaggtccccgggaggtgtgtgctcctagagcttctggaagatctgccctgggtgaggtgtccacagcaagactcgcggggcacaggggtggccgtctgttctgcccaccctgagccttgatggctgagccttgagcagctcagctaggggaccaaggtggcccaaggacagctctgccaggctgctaaggagctggccgtgctcactgggaaaagtagcccctccgaagacctcccgcccccttccccagacacagtaaattaagaataatgactggaaaattgcagctgctgcagctcagctggttcctgagacggcgtgtcttgttcttacagggacgcgattgtcaccacctccatcaactccctgacgagcttctcctccggcttcgtcgtcttctccttcctggggtacatggcacagaagcacagtgtgcccatcggggacgtggccaaggacggtgagcccctcctgctgcacctgggcctgctccgtgtagcaccagcgccgagctctcagcaaagcctttttccttgtgaaagaggaaggagacgcatgggccctgagcgacttcagtgagagttgctgcctcactcttgaaggatggtggtacacatcccagtacagacctgcccccacccagcgccttccccgccctgcccctcccggccccccacccagtgccttccccgccctgcccctcccggccccccacccagcgccttccccgccctgcccctcccggccccccacccagcgccttccccgccctgcccctccaggccccccacccagtgccttccccgccctgcccctccaggcccccccacccagcgccttccccgccctgcccctcccggccccccacccagtgccttccccgccctgcccctcccggccccccacccagcgccttccccgccctgcccctccaggccccccacccagtgccttccccgccctgcccctcccggccccccacccagtgccttctctgccctgcccctcccggcccccccacccagtgccttctccgccctgcccctccaggcccccccacccagtgcctttcctgccttgtgcctctcggggcctccaccctgggctggggaacctcaagcccaaatgcagctgagcagcatagttggtgcctcagtccctcgactgctccctgcagatgccacatgaggctgccccaccagggtctggcgtagatgctgtcactgagggccctctagatgtttgcttgccacgcggtgtgggaacatgcagctcagggaaggggaggaatgagctgttccagcaacacctggaggcaggctgggatgccgcaaacatcagcttggccacagagcagccgggagatccctggggcctccagcacagggtgtccctgcccgctccccaggccgacgcatgacgctgagtgtccctgcacgcctggagttgtctccgagagggtggggaggggtccaggtctcgggcaggcacaggtgagtggtggggggaggccttggccacagcaagaagtgtgccaggcaggatggagccggcaggacgggcacagatgcaggggctgagagtgggcccaggcacttggggccacgtgcctggctccggtgcttgcagtggaaagctgtggcgttggcagccctaacttgggccaaccgagagctccagggagtcccaaggcttctcggtctctgtcagccagcagagcccccgcctgcctcccggcctgctctgccacatggatgtggaggaggccctttcgctccagacacgggcctgggttgggtgggctcccatgctgcgtccccatccttgcttcctctggactgtcttctccgggggtggggtgggggcactacatttgtgaggaatgattgtgctcagaaaagcccctgtcccgtgtgggtgttgttgctgactgatctctgcctgggtgttgaggctcagtgaaggcggggagcgacaagcaccaagcgggggcagccttgaccgcacctgagtctcacagagtggggcactaggaccctcgcaccgcaggtaggaacacgctcagagacctgaaagggcccactccatgcttgcaacagaaagccagggtcggggctggagccacagctcagaggtgggcctcctaagcccatgttctttccactaggaaaaaaaattcagtcaaagcgggagaaagggaacatctgcaaataaatgcagagcagtgaaatttactcggtgccgcatttatgccttttcttcattctttttgccctttattatgataacgagcatagtttgcaaaaacctctattaacccctgaaaataaagttgaatgttcttctgtgcatttcatgacaagcaaagtaaatgtcatttacagccttaattctcaagaaaatagggtgaaatgttaacttaggtacagaaacgaaggcacgggtgttgacattacattccctgagctgatgaatatcttcccaggctcctggctggtaccatctaagccccggaacatctcaggcgagcctgcctcccccaccccacgcggaggctgtccccatccaccagggtatctgggagctgcgagagcccaggtctgaccccgctgcttggctgatagtgaggcccctgaaagacctttaggaacggcccctggctctggcctttgattatttaaaaggccaggcgcaggcctattcctgcaggctagggccagacacgtgcctgctgaggacaggggactctgttgcaggcagattgggcttgggagatggtgccagccagtggaggatgcaaggcttctgaaatggtcaaaggtcaattgcctatgggactggtttttactttggggtcatcagagaccaaactgcgttgacttttggtcgcctgcctgccacactctcgtcccctccacctccatccaagtctgcctgctggtagcaggaagcacgtgtcgtttcccgagagagctgtgggggaacacctcctccgcctttgccatgccgccctcagcctggcgtgcccctcgcttgcagggatagcaaggtagcaggtttgtctcttatctccgaagccaccatctgggcccctgtatccatcaggatgtgctgctcctctgagccctcagggccccagctgacaggagcctgtctcaatatggcctgcgggaccccgtggcaggggaggtggtgaaggagccacacactcctctaccaagcttcactcgcagggacccgctcactgtgggttcacagcacattggccaagtgcagccacgtctaacctcacgggagggtgggaggacctcagcttcctcatgtgcctggaaggcggaggtcaggaatgtatccctaaatgttttgctaattttagaaattaggctactaaatagtgtggacgtgtgtgatttgtgtgtgtttgtgtgtgtatgtttgtgcatgcacgtgcatgtttctgtttgtgtgcgtgcatgtggatgtgttcttgcatgtatgagtttgaatgcacaaatgagtgttcgtgcatgtgcgcgcatgtgtctgtgtgtgtatattgcatggtatgtgtgtctgagtgtgtatgttgcatggtatgtgtgtctgagtgtgtatgttgcatggtatgtgtgtctgagtgtgtatgttgcatggtatgtgtgtctgagtgtgtatgttgcatggtatgtgtgtctgagtgtgtatgttgcatggtatgtgcaggaaaaactaactcgaaggacattagcagatgtccctgggatgaagggcaggaccagcctggaagcccctcctgctcctccttgtttctgccccttccttccccaagcacccccatagcccaaaaggacccaggtaatttggaggagccccattgctgggtggtgggcatgaaccaaagccctctgatcagttctgggtttccgctttcctgagtcccaggcctggtctgctggacatatagaagggggcttttcagcagagccgcaccagccctagtctctacaggcctgtggcaggccatgcttctcggggcggggtggggcaggatgggcgggagagcacagcgtgggctctgtggcaagcagggcgggttctgtttcagggccagggctgatcttcatcatctacccggaagccatcgccacgctccctctgtcctcagcctgggccgtggtcttcttcatcatgctgctcaccctgggtatcgacagcgccgtgagtaacccgcaccgcccggccctgtcctcggcagttgggttccttccacccgagggggccctgccctcccagggctaggcaagatccctgggctcacgtacggcccccagacctcctgtccttgacttgggcgagccccgtgattatttgggagacctttctcggggctggagtgagtggtgactggagtttacctttccctttatccccctactctggggtacctgtgtgccctgccctgagccacctacagatcctggaaatgtgcacacacatgcacacacacacatacacgcacacacatacacacatacacgaacacacacattcacaccaccatgcacatgcatgcacacacatacacacatgcacacacgcacacatacatgaacacacacgaacacacacatgcacacacgcatgcacacacacatacacacagacatgcatgcacgtgtagcagggccccagccaccaaagacttggctccggacaccagagtggtggggccttggagggcacacagcaggtccttcatatctcgtggctttccctggaagcctcagctaccccatgaggaatgaggagggcaacagaagttcctggcacctaccaatcccaggcctggccctgaatgctttgtgtgtggcccctgcacctccagctgctgggggtggcgggtccagcccttgatcggccctgggcctgctggactttctcaggctccttcttccctgtcagctgcttgggaccaaagaacccagaatcccttgccttataaacgctggtcatgcacccggccccccactcatatcctatccacctcgtccacggctcctgggttgaccacaggcctcatgttcctgacatgagagcatgaagaggggtctggaccgagcaaggtgaagaaggtcactaagcaggagtcaggtgcctggacggtgtcccacaggaggatgccaggagtcaggaggctccgtcgggaaggcgtagccaatgacaaggccaggtgcagctgaaagctttgtgtgggggacgcatcttgctcaggaaaatctggccaagctgagcccgtgcagcagcagtggacagggtggcattgttttagccatgccgcatcttacccacccagagacatcgaagaggctgcaaaccccctaccgtggatacagtggtccctctgggtcctctctcctgcggtcgtgccgccatagaagccctcgccaacagctgtcctcactaccaggcatcctgcaccctggacggccatgtggcccctgttccgtgtccatccccgggtgtgcgtccactgggtgacaagtaggtcttggcccaggctgcggtcaggagcgccgccagcctgcagcccgaccctgtgctctgtgtgcagatgggtggtatggagtcagtgatcaccgggctcatcgatgagttccagctgctgcacagacaccgtgagctcttcacgctcttcatcgtcctggcgaccttcctcctgtccctgttctgcgtcaccaacgtacgtaccatcgccggcttcgccttctcctggtcatgtctccttagcacgtggcacggggcgccctggctgggactgtcaggccagacagaaccgcagcacttccagggagctgcgaacccacccaccccagaaaatgactcgtagcagtgcacagggtaactgcacatccagagcttggtcccagagtcacttcagcacctggacagctcccccagaagcaccccaggctgaagctgcctccttctagggtttggggactgggggacgctgggggtgtggtggcagagcctatctatgtgggagggggagcccaggccactccctctccaagggaggcactgccaagttccgcattcggttgcttccatttctaattgcacatgaagccctaggaagggaaaggagaggtcatttttatttttattttttgtaatacacgtggccctaagaagctgcatgtgggttgaattttagggactcaaaccagagttttgcagtgagtgaaacaatttgtgtgcacagtgaatccccaggctgggtttacctctggggaaagcccttctgtaggtccacaggctcccctctcttccagggtggcatctacgtcttcacgctcctggaccattttgcagccggcacgtccatcctctttggagtgctcatcgaagccatcggagtggcctggttctatggtgagtccggggggaggcagccaagccggcaccctcttgtttggtggctgtgccactccccttctgaaaaaggctccgtgaggaaacacctttcagctgcaggaagcctgggttgtggtcatcacagctccgcagaggggagaggcttggcactggtccctttgatgggatcagtgaggtgcttagcttggatggcagccagaagaggcacactgtggtcagaggtgttcacagcggctgggcgtcttctgcctcctccacgctagaggcaccggtgagcccatcccacccaggggaacacaatcagatccatgctggggtttcagcagggatgtgacatggtgcctttcaaaggtgccgtcatcgccttccctgctgaccagagctccagagcagtcgggacctgatgatcagcgggcggcgctcgaacggggtgcagctcctggcccattgtgctgccccagctgtgtcctgggacttccaccagtggtttaaacagcaacagaaaacccagcctggagccagggctgccctttccccacatgctgacctggccaagtcacctcgactccccttagttctctcttctgtaaaatgggcaggagtgccagctccgcttacctggccagctcacttccagggaagtggcgaggccgagccagggcatctcgccatgaatgtgtggtccgggcgcggtgactcacgcctgtaatcccagcactttgggaggccgaggtgggcagatcacgagatcaagagatcaagaccatcctggccaacatggtaaaaccccatctttactaaaaaaaaaaaaaaaaaaaattagccgggtgtggtggcacaaggctataatcccagctagtcaggaggctgtagattttctgaagacactgatggtatacttacgatggaatatgattcagcttgaacccggaaggcggaggttgcagtcacccgagattgcaccactgcactccagcctgggcaacagagtgagactccgtctcaaaaaagaaaaaaaaaaatgtgtggatccggctgaaagctgaatgtctgtggtgctgcgtgagccccggttttggaggacgcccagctcacctgcaaacaagggggtcattttctctgcctcagagccatggaatttatagccagataaacgccctgactttgagacaaataggacaaatagctcctattctgagaacattgttttcagtgttgctctacagaaaacggaaatatcaacctcgtactttcacgggtgtctggaatcaatactttgtctatcactttcattgtcatcttccctgaacaaaacatagaccttcacagaggaagggagaaagtgccttgaattgccatggcctccggaaccacgggagatggggagaagccggccctggcgacctgcacctcagaagaccgagatctgtgttatttttccaaagagaaatccacgcccctctcatctaaatgaaacaaaacctgtgctctaataagatgtgccggaatacgccgggcttccagcacgctgcggtcctgtaggtcttggagctgatgactcctgctccggcaggggccctgggacctgctggtgggaggcagggtctgggggccgaggggccttggggacgcccctcttggcttcttccggcctcacctctctgcatccccgctgcctcccacgtccatctctcatgttcagagctcggatgccgggtgggtgtgaagaggggattctgtgtggaggcttctttctgatgggacacgggacaaccgcaagacttgccccaaatctcagcagatcagccgcggtcacacgagtcacagaccaggccagatgtggggggagaaaccactcttaaggtcttagggtcagttcctagaagaagttagataataccagtgaaagaaaaatatgcatttctaaagtggactgctggtacttgcttttggggagaaaaaatgtttattatgtttctagaaatagcttttctgaagacacagtgacggtatactcatgacggaatatgattcggccttaaaacaaaagggaatgctgatgtgggccgcagcttaggtggcctcagggacactctacagggagtaaaccagttgcagaggccccgtgccacgtgactccactgacgggaggttcccacaggagtcacattcattgagacaaaaagcagatggtgctggggcctggcgggggttgggggtcgggaggagttggcgtttcatgagggcagaatttcattttggaggatggagttctgaagatggacggtggtgacggttacacagtatgtgaatgtattgatacattatgaactctacacgtaaaaatggctaaaatggtaagttttatgttatgtgtattttaccataatctttttaagtgaacaagaagtaccagcagcagagggagacagggagagccatgggatggggaggaggacccgaggggctgttgccggggcgcggggagcacccaccggggcacggctcttcctggtgcatctccagggtggagcaggcacgtgggctcccacccgtcagcgaggcacccagtgggctggggtgtggcctggcctcctctgcaggaggctgggtgcagccgaagcctggggccggtaggtggggcccttgggagtcagcgaggacccccacacgtgtccagcatcgggggaatgcgctgccctgatggacactgatgccacctcttctccctcaggtgttgggcagttcagcgacgacatccagcagatgaccgggcagcggcccagcctgtactggcggctgtgctggaagctggtcagcccctgctttctcctggtaagggacctcgggccacctgcccttcccccgtctgcccactgcccccactctggcacctgccccgaggtccagcgcccgcatgtgggttgtcactgtggctggagtcaggggcctcaagactcggcccagaaggacaggctgatccctgaactcatctatagtctccttaaggtggcttccaccctcccctctagacccaccgaaaaaacctcacatggtcttggacccctgtcacagtccgttgtgagtcctgcacttgggccgcgcctctgtgttgggaggggaagctggaggtgagtcgggctgtccactcacctctgcctgtgaggatcaaggtcgaagttagagcttccggggcagtggggacaaaggatgccgagtgctggatgagagcagcaggggcctcggccctgtcccgttgctcacgcaagcctccctctggctcagcagcatcactgtgtccagtaggcacttgcttctgtcatccgccaccgagtcagggcccaccgggcaaggccgtcggacgctggtgtttgtaaatagagttttgttggaaggtggccgcacactttcattagggattgcctgcagtgcttcccccactgaaccacagaggcctggaggctcacaaagcaaagctgtgctgcctgatctgggcaggcaacctaagagctgtccaagtctaagcagagtgtcccgtgagctgctcacgtagagaagcacctcccgagtccagcaggcacgaggtggggactggaacagggcaggggactcaggccgcaccctctcatggaccaagggctggtcccggagtcagcagggcccgcgtgcgtggagacccctcgtcacctgcacacagcaggtgggacagccccgtagttgccagcagaggggttccggggtacaggaaagagatgagagacaggccctatcccggaggagctcaacatagtgtgagagaacctgcccggcatcttgtagaaattccaccgtgtctgagctccaggccgcgtggtgtggctgcacgtaagtgttccaagtccagttaactgcgcttgtgaaggctcccgttgaaggttcctggattcatggggcgggcttttaatagcacacagactacatggctgttcagaggggaaagtgaggaagccctcccagaaagtcagcctcctgcccacctcccgctctcccccgccattagttgaaactgagctgttttgcatgaggacgttggctccccttgagggggtgtctcctcttaacacccagagggctgacctcgatcttaggagataaaatgttctactgatcttagactaaatcttcgaacttcatacagaaacacacttcgtagacttttagataaaactacaaactatacgaaacaggacttcattttgccaagttgagagaaacatgacaatttcattgctctatgtcattttgtatttaatatgacagcacaattcctatgaagttctgatttcagcagaaacataacgtctgtgttatcatctgtttcttcaggctgcggcatagtcccctgccctctggcgtgtgctaacctctggtcgtaaggggtgtacacgccccagtctcgttcagatgactctgtggcagatgatgccacagcactgctaaagggaaattatgccggagcaaaggcaacttacatgggcagactgtggcctggggaggcatagttctttctaagaaaggtggtatctagcaagaagttgaacaataacagagagcacattacagcaatacctccatgtcagataggcaagcccgacatgtccagggatgcacgcgtggctctttaaagcatgctcagggctctctgtgcagccaaggcagccgcccctgatcccagatgctgcaggccactggctttgctcgccaaagtgctgctcaccctggctctggtcacgtgacagacacaaccccagcccccatcccagtcctccgctagccggctccaaacctacaagtggcccgaagtagcgcatgaagaagatgctgagactggcatgagacacgcgtccaacatgcttttcaggtggaaggcttggatgttttaacttttctgaaattgaggaaaagtggacaattgggaaaaaattgcattttaagctacatcataaaccatatctatcagagcttcacttgtgtccttgggaaggacccaggtacacagaacacatatgtaggcgtgcagtacacatgtgggtgcacagaacacattcaggtgtgaggtgcatatgtaggcacatggaggatctttttagatggtggtgcatgtttgtggagtggatgaacaaatgcatgagctgcctcaggagaagcctctggagagtgggaagcttcccctccaagtggcatccaccccaccctctgttacctttgtggtggtggttctgagacaggtctgtgactttatcagatttgcttctagaatgagtagagatacggagctcagatggccctagggtggtcccgcatgggtcacagttgtgtcttcaggccatggatgatcatagattcagtgtactgggtggtggtcagttttgtttttgttgtgatttcaagcaaggaatagaacaaggtgggatacagcaggaagggatgggatgggatgagatgggatgggatagagccggatgtgatgtaatagaacaggatgggatggaatagaacatgatgggatgggatgggaggggaggggagagaacaggataggacaggacaggctagatcatgcttcaggaggacatggcttgcccgggatgcccagctgccatgtctgcaggcctggccggggtctgcacctgcacagctgtgggggctgagagacgctctgccatgaagtgcctgcccgctccctgctttgtcctggcaccgccggctgagagctgcctgacctccgtatctgctggttgcagttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagaggtgggtatttggacggggcgccttcacccgagtgtgaggccaccagaaaggctccgtgggtgtccatggccccagtcctcacctgcctgggtcatctgtgaccaagaggaggagactggaggtggccaccacaacactgtgtgtgtgtgtgcgtgtgtgtgtccacctgcacgcccgggcccatgggtgtgcgtccatatgtgtattcatgtgtgtgtctttaagtatgtccacatgtctgtgtgtgtctgtgtgtgcatgtgtctgtgtgtgcttgtgcctgtgtgtacatccactgtatctctgtgtctgtatgtgctgtctccgtgtgcacgtgtgtgtgggcctgggtctgtgctcacattcgtgtccaagtgtttgtgtgtactgagtgcatgcatgcctacacactatggtatgtggtgtggtggacacagaagccatctgagggcggtagaatcaggggtgatctaggtccccccagggccgagcccaactttggctgaacaggggcagctggagccccaggcagtggaggaagctttgcggagtcactgatatgcatctcctttcttctgcttggttttgccgcctttgtgtagaagaaaggcaggtggaccagtcacagggccctgtttaacaccctggctctgtggttccaggaagagacaaggacactccctccttggaagagggtcgccctcacctgagatcccaccactgggaactcccggaagctgcttcctcaaatcccagcctttctcagaaagaagtcgcttggccctgggcatcaaaaccccagagcagcaccagctgtgttcaaggattccaccttagggccacacggtgtcccctgggctcagacatgtggcagatgctctcaggctggcactgagccagtctctccagcagcctggccaggccaaggcccagtgcaggcaaagcacagtgtgtggctgggggcttctgtggagtgggaggagctctggggctgccatggccccaggaaagctgatggcaccctgctgtggacagtccctctcagacccccacgggctgacctgccaggacccagcacaggggaagagcaggcagccgggcagtctctgcagggagagagctcctctgggaggctggatggacgtgggaggcggggcccaggtcagcgcagagctggaggatgcctacagcccggcggacctgaacagccagcgcccttacccctcgcatggccaaactctgaacgtaagccaagtaaaacctcagcagctgagccaggtacaagtggaattgtggtgatgacgtggggtggggccacgcacaggggtccctgtgagaggtcacctggcctcagagatccagatacaggcatccaggcccgagagggtgagctcctgaagatgctgcctgctctgggaggacttggtgctgtccaggccccaggagctgccgcagcgggcagtggaaggaaggcacgttcagcgttcactctcccaagagctgcaggtgacaaaaagcaagtgctcccggaatatgtcagctgcaggtggccccgaggcagcccacctgggtgtgggcactttcttactcagagcccagcacacgtggtagcttagactcaagagccatctccaggaccacgttttattttcaagcgagtgctcaaatgctgatgttctgctctgcgctagactttaaggggaccgtcaggatgttggcttcgggcctgactggctgtctggtcggcatgggcactggcagtgtaagtcagtggtgggcgctggtgatatggatgccagcgggtgggcattggcaggtgaggagggctggtggtgagggtgctggtaggtgagggtcctggcagtgtgagtcagtggtgggtgctggcagtgggtactggtctgcactgacccctgcactctctttctctttcagaaactggcctacgccattgcacccgagaaggaccgtgagctggtggacagaggggaggtgcgccagttcacggtgaggtcgaggtccctgctgggcctctctcgggggaattcagaatgatcccaagctcagtgttcttagcccccagggggctccgaggctggtgtagatggtgctcatttactcagccagcatgtgctctatgaggacaggcagccagtggtggcaggtgacagtggagacgtgtgcccgggacggggggcacatgacgcaggggccctgggaggtgcggctgcacagacgcctgaggaaagcatggtccctgcaaagacctgggcatgtcccagaccacgggagcagtgccctgtggggccagctgagccaggttaaggaccagcaagggaccaccaccccccgcctcacgggggcacaagggacagtgccaggaggggaggcctgggcctggccatgggaagccacagggagccctggaggggctgggagaggcctgggagcctggggctggcttcgagtgagaggatggtcacgccaggtgtttcctgcaccctgggagccatccagctgtgtgcgaacatgttcatgacatgccgtggagcaggtgcattcccgggggcacacaagtaaacacttgacgtgtttttactcccacaaccctaagaggcagcccagcactctctctacacaagggtccctgagacccagagaggccccggaatgtgcccaagatcacagagctggccagcaggagaggagcctgggctgtgccctgggcctgtggcactgtcctcctccaccccagagtggcctcagccccgacctgattccatacactaatgtcagcctaatgccgacagcagagtccaatgcacagcaaaagggagagaaggccatagtgtggagggcaccgcggccccacctcggacctgcctcttccctctggccacctctctgtggctggttctcgtaaacagtcctcccagcaggggtctcatgagctcatgcctgaggagcccagcatggacctgcacatggggcaggagcaaggatacaggcagagggagggggctctgcgtgcctgggaggtgggtggtgacgtcaggcagaacaagacgctgagcagggaacaggccgggaggcagtggggagaagccgcctctgagcacacatctgcacagcttgttcctcctacctgcaagtcaggttctggtgtgggctctgcctccctccgttggcaccctttcctctgtcctcccagtgacttgcctgctccaaacacaggaggcgtgtccaggcatcccatcccatccatccagaggatgccagcccctccccactgggcctccggtcctgctccaccagagcctctctcctctgagagtcctatacctgggggtcttacactttgtacaggatcttgctagtcttctcaaatatccaactttgacttcatgtgagattcttgctgtgcttcctgtcacattaatctcagctcctgtatttatcatttcttcctctctttttcttggatctactctgttgtagttttgctaactttttaatttggactttaggttattaatttgcatccttcgttcttttctaatgtaagcactcaaggctatgaatttccctcaaaatactccatgtgctacattccgtatttttttcatagtatttttctttatcttttagttctaagtatattttaatttccattgtgactttgtcaactcataacttgcttaaaagtctgcttttaaattgccaaatatatggggatgttttactcatctttttgtttttaatttccaaattaatttcattgttctcaaacacatatgatacctattatttaaaatgtattgagacttctttagggccttatacctgatcaactttgataaacgttgcacatcttttagatgaatgtgctattctctaattgtcaatacacagttctgcttctgtccatttgagtagggttatatattatgttacccacattgtctacactttgtcaactttaggggtgcttgaccatgagtaattgagagatgcctgtggcatattcttcctcgatagtatatttgtttgctgttcccctcagttctatcaggttttgctctctgtagtctgaggctgttttctgaggttgatccatgtccagaatgatcatctcttcctggtgacatgaacccatcttcactccctaatgatgcttttggtcttaaagtctgacttgtctgggacaaatatagttgcaccaaggtgtcttttgagtttgcctgaaatatcttttgcaatctgttaactttcaactttgcagtaaccttaagatttaagtgtcttttgcaaacccagcatacacctagaattttttacgctgacagttggacaggttaatccatttacatttgttgtgattattgatatatttgaacttgattctactatctttctattccatttgtcccatttttagtgtttttctcctttattgcctttttatagattgatttttcttggttcactcatttttattattccgtttatttctctctacttgcttagaacttacatactttattctttttttttttttttttgaggtggagtcttgctctgtcacccaggctggagtgcagtggcatgatctctgctcactgcaacctccacctcccaggttcaagcaattgtcctgcctcagcctctcaagtggctgggattacaggtgcccagcaccacacctggataatttttgtgtttttagtagagacagggtttgaccatgttggccaggctggtctcgaactcctgatctcaagtgatctgcccacctctgcctcccagagtgctgggattacagccgtaagccactgtgcccggacttattctattcctttaatagctactcttgaggttgtaccatacatatttcacttaaactctacagagaaaccatattttaaccccatcccattataaggacttaaatcttcctcctactgatgaacatgctatgattgttcaaatctatttctctctttttaacccacaaattagacactgtcattgttcttgttcctgttattattttgtacggactcatcatgttccttggactaatgtgcatgcttggtgtttgttggttcccatacttttgttatagacttcttttcttctaggaccattttcttgcttttcaaaaagcatccttcagacattcctttgaggaggtctcttgctaacctccctcactattggtgtgtgggaacatctttatgctgctctcattcacgaaagcactgttgtgggctcagggctctaggctgacagggactatctctgcgttttggaggcagcagtgttccgtggctgtgctgagatgtgtggcctgtgagcctgctctgtggtgggctctgtcctcacccctgcactcggccgagtttcttctgctttcggtgtctcgggttcactgcggagtgtcgggacctgggtttcttttttgtttgtttgtttgtttgtttgtttgttttgagacggagtctcgctctgtagcccaggctggagtgcagtggcgcaatctcggctcactgcaagctccgcctcccgggttcgcgccattctcctgcctcagcctcccgagtagctgggactgcaggcacccaccaccgttaatttggtttctttttatttttcctctctggatatgttttgtggccagatctgtggattcacaaatcttgtcattctgtgaattttgcagccacacactgaaagattgccttctgcctttctgtgttttccattatgaggctctggtgtgtccactttgccccaggtcctccaggtctcttacctcacttagattttgttttcatttgaatcttaggtgcacagttgagtaacgcatcttatcattaatccacatgtggccatttttaaattattaatttgtcaccgtaacaaacagacccttgtgagcccacagcaggaaaactaggcactgtggaaactgcctgcccctcacccattctgtatctgcgtctagcttgatctttcccttgcccttcttacaatttcatttgttgcatctctagatatttctagcttcctaaaaagtgtattatttggcttcagcatttggtgtagccctaaccaacccctactgaagcaagaccttatgcacaccccatgcagatccccgagaatcatgacattctcctggctgggggaacaggcaccgtgcccagccctgtgtgggcatcagaggtggttccctctggtcctgtcggcggatctctccccagcctcctcattcacagcgggatgtgctcgtctgaaccctcagcaggggtcctgggccattgtcccgggtcttctctctgtgtggccacctcctctctggcgctctggcctgcaaactgcagccacctccgtttccctcgctctcctttccagcgtctcagctcagggagtccaccaggctgcaccctccctgtgctgcaatctagaaactccctcgaggcagcgagcagggtggcaggggggcctccttgttggcttccctcagggaccactgacccttacggtctggtgtccatggtctggaaggtcatcggcacgtgtgttttgtttatttggggcttgtttcggacagtagggtaaattcgatccctattattccatctaggtcagaaatgtttgtatccatagctacgtttcacctaccgtgactggtccctgaccgtccgtcacgtgaacaaaccacagctcagctatggacgctccgcattccactgccctgcccctggtctgcagcccagccattctcttttctacttcatctctggaagctgcgtgtgctctgctgtttcttgtgaaattctcatcactgtgatgtgcgtgtgtcacttttctgagagtcccctatgtggccatcctgtaatctgttgcaacagctctggtcctttggggtcaaattgaggtctggtttctggggactcacttagagtgggctgctgtcttctgtttctagtctttattttacatttatggcttgatcttaatctgtgggaatctgggagcccccaagcacacctccctccagaggggaccttctgcttctgtcagcgggcaggacagagaactgcttcaccctggggggaacaggactcacagctgaagtcccaagcatggcttcttcatcgctggcctgaagtggggctgccacccagagcctctgctctagggctctggccgctgggccacccgtggctgtgggtcctggccgggctccctgaccccagcttccttcactgagccccgagctgcacctggatgctgcctgtgccggcatcagctgtggctgctccaggcccccggtagacccctggcctgcagtgtgatcccaccctggctgaggaggtccctgcaggctcttggtggagtggccagaggagcctgtggtgtggccagtggtagcttcagtggctttccatggccggcgtggttttgtcagaagcaagccccgcatgcccctgtttggaaatgtttatgaagcacacttcttgccatttagtgctatcgaggggctttgacgctcacaaacaggctgaactaacagctgcataatagcaggcgatgacatttgctggtggtgtaaatagctgctcttgtctatctcatcagtccctgagcagtcagtacacgctgcacttgcgcccgcgcgggtcgcagagagcaagatggagctgcagaggtagcgtgtcactcagatggagcatctgaggcccccaggaaggtggagggacgtgggggagaggtgacatcaccacgtcacacccaagtcgctggggtacaatctggaaccagccccggactgagggtgcccggcatctctcagactcagcatctgatcaatacgccccagaggccaccatggccaccacgccaaccacagtctcgcggctttttaaaaaatcaagtaatgattgatttgtaggagtttgagtgaggcatcggatccccggcacctgtcaagggtgtgttggtccaggcccccagtgagcctccccttctcccagggcacatggccaggaggctgcaaactgtctgctcactgccttcagctgctcttagccaccttcagctgctcttaaatggggcatcgccccagggtttctgactaaacctgttttctttccagctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaactgcctcagcctccttgtctcgtttccgctgggccccatccatttacacaggcccagctcacctgctcacaccccgaggtcagcttctgccccaccccagcccacccacagcaaagcttcctcacctgatgcctcttggcccatctctccttccggcctcccctaaagcctagacgttagagataacacatccactacgctcccatgcaggtgtgctgggtgtgacctgtcgccctccccaggctcccacgcaggtgtgctgggtgtgacctgtcccccctccccaggctcccacgcaggtgtgctgggtgtgacctgtccccctccccaggctcccacgcaggtgtgctgggtgtgatctgtttccccttccctgggctcccacacagtgttgggtgcagtggtgaccctcacccacgtctgcactcctgcagggtcccctgtggcaggttgtggcaccttatgtcgtgcccacttgctcaggctggacctccgtgccatcctgcaccgctctcccccagcccctcacctgcctttcagcattcttgtgggctccccacatgtccagactccaaccacactgcctgaccactgccactgcccaacccaagagcctcttccaagccccatcccagatcttggtgggtcctggtcctcagtccaagcatctttcgtcgctctgtggcctaaaggattcttctagataccaacagatcaggccacagcccaaggaaaccccagggttatcctggtgcttggagtaaatgccaatgccctcagcatgacctgtgataggatggcagcaccccttccaggcagtgacctgtgataagacaagcgtcactcccgccagccccacctgcagccctgccccgaactgcctgagggcacaccccacaccgagggctttgtgcctggcagcacatggggacactgctactgctgcatcgtagcacgtggctgcgtgtggacaggaaggacgctcgcacctttcagctgggtcagtgaactctgtggcaggaaaagtgctgggctgcctacaagggctgaacctgcctgcagcctaactagtgcctcccaccgtccccattgtcacataggatgtcccttaccctcaggggtggctacaccccgcctgctacaggtgccgccctaacagctcacacctggagcccccaggtgtgatccctgctgaccactcaggtctggggtccaggcagatactgtgtgggtggccataagtcactatgtgggctgagacttgaaggactccgacagcctcatgggcgactgtattaagccccagcaatcggagaggtgggctccggggctgggtgggtctcctctgccaggtgggtctcctctgcctgtggtcccagcagctcggcagcaggggccggcccagatggccgttggtcacagagacagctgggctttgctgagtgcgtcgtggtccagcctaggcccatgccactgaagcctttctcagaggtgtggggtctgcagggaccggtcacatgtgagcccaggatcagggcattgggggaagaaccagctgaggacattccccagccccaaaacaaaggcacggcagtcctcgagcagggaggagtgaggagccacatgtgggatcccgcctctctggcgtgtgagctgtggatggcatctggtaccagccccatgcccgctggccgctggcgagcttgcaggctctgcaggcaaccggaacagcatactgcaggtgcacacggggtcctcgtgccgagtgatttactcagggagtgcctgagggagcaggtgagggaggggcacttacaccctgaatgtagaaggaactccacaagtccatagggaagaggcagacaccccatcagaaaagtggacagagaccttgaatgactgccagcaagggaaagtgcccaagtggccaacaaacctatgaaaagaggcccaacctcaccagttgtcatggaaatgcagtcagccaccacgtaatgtgg

SEQ ID NO: 11889 - DNA, 24913 bp, Human
gcaggaaattataggatgcatacaggggacagtaagtcattcagttcacctggtgtgtggggcccatggtggggatggtgttatattaaagaaggccttgagccaggcattcaggaggcttgaagtaggaggatcacttgagctcaggaggtcaaggctgcagtgagctatgatcatgcctcttcactccagcctgggcaaaagagtgagaccctgtcttataaaaaataagaattaatgaatttagaaggtcttgaattccaagtggaagcacccagaatttgagccataaacaaccaaaggatagcctgatctgagctgagcttaatttatatgctgaaagtatgagagactagtagggaagagaccagaaataaggagactgctagaagattgtgcaacatcccagttcatcctccacaaatgtggaggaagcagatactagcagtggttactaactgtaaattctgggattgtagagactgtgacccatgcagacagcaaaggcagggagatgcagcatgcagcgcagcatggcaccgatactggcagacactttagtagacttagggactttaactgcagagaaaatgtgaggttgcactaagaactgtgaatcagccctatggggctgaaaattgacagcactgggataagtggaactggaaagagagcagaagtagaaaaataaagttcagccgggcgcagtggcttatgcctgtaatcccagcactttgggaggtcaaggcgggcagatcacctgggagcaggagttggagactagcctggccaacatggtgagaccccgtctctactaaaaataccaaaaaaaaattagctgggcatggtggcgcacgcctgtagtcccagctactcaggaggctgagacaggagaatcgcttgaacccgggaggcggaggttgcagtgagccaagattgcaccattgcactccagcctgggcaacaggagtgaaacaccatctcaaaaaaaaaaaaaaaaagaaaaaagaaagaaaaagaaagttcaatttattgggaaaaaaagagccctttggaaacaaggaggaagaagaagtgtcggcaaagaagcattaggaggttcagggtcaaagaagacaaggaaagctttggcaagaagggcagatggggtgcagaattatgcttcaattccagaaaggaaagcactggggtagatacaaggttggggctggcagaagagtagcagttcagagatcattaacacttgatccatttaatttcccaggtaaccaaagacaccatggaatataatctgcctccactaaagtgtaccttttgtacaataaggcaaagaaaaaataagtacacacctaagctctagacttttgttctatcctctctgcattttcggtgtggatgaatacaacttgggaagaaaggaaagaagaaccagcagttttaagcacttactatttgctctgcaaagtgtattcatcaacattgttgctttcaatcttaaagcatggattggagacaggcagtattacccacacttcatagatgcagaaattaaatctcaggctaaggaggaaggaaaagggagttcaccaaataagcaggagcctacctgaagcctgatgcatctggtcctagagccaaccttccatttccccccagcccccacctgtttaagcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaaggtaagaatatggcttaaaagaaattctgtacctaactcgttaatttattttttaacctttagccacataggtgtggctttacagatgcatttattcaaaccagaaaagatcctaagaatctgataaaataatataaaagagttttgttaacagcctccagcctaaaaattcagacctagaaattcaggacccccctcaaatcacctccaaaagctctctctcctgtaatactatctctgtctcccaccctgatcttttcccaaataccctccctgtcccatcctcctccagggccagctcaacttctctggccaagactatttcttcttccatgacagccctcctcttatgccagccattgactaagacacatgctgggcctgcaaggggactgaaccagatcctgtgctccaagggtccagacttataagcaagtaattgtaggacgtggagtaagacctataaaatttgcacacaaaatactataggatcccatggaaaggagtgattacttctgtttacagagtcagggatgcctccacaaaggaggccatagtgatctggcctgatatgatgaaaatgtccctgctggctgctcaaggggaaatgtatgtgtctacatgcctgactctccaagggcaggaaccatgtgctgatgtggcccagcaatgaggggcctggggagggtgagaaggacttgggacttctcctgtgggaactggcagatccctctgctcccactgcactacccagctgcctcaatctcttgctgcatctccttctcccagctttagccaggttctatcactccccgtgcaggcctccaacaagagcaatacagtgggatccatagttcactggacagccaagcccttaaccgccctggtcctcagcagcagcaggtgcccttccacacatgttcacagctgtgcccaggccctcggtcatcagctacctgcccagagcacaacgcctaccacagagttggtcaatgtgttgcgtggattattctcagggcattagttcaaggccagagccctaagctcacatgtacacctgcctacaggtgtacattgggaagtcccataaatacatcagactcaaccccagaattggactcaccatcccctcacccccaccctatggaggaccttctcactgtgtccttacatggtctttcctccatgtgcacacatccctggtgttgccttgtgtgtcctaatctcctctcattacaaggataccagattggaataggtctcatcctagcagcctcattttaacttaatcacctatttaaagacattatctccaaatacagccacatgctaatatactatgaattaggacttcaacatatgaacttagagagacacaattcaaaccacgataatgtccgtcttagtccattttatgttgctataacaaaatacctgaggctgggtaatttataaatataagaggtttattttgaatcatgattctggtggctgaaaagtccaagagcatggtgctggcatctgctcagcttctcgtgagggccatgctgcatcaagacatggtgaagaaatagaaaggcaagcaggcatgtataaagggaccaaactcacccacttctgggagatggcattaatctactcatgtggaatccacccttatggcccaaacacctctcacaagaccccgtgtcctagcactgccacactggcagttaaacttcaacagagagttttggtggggactaaccacatccaaaccacagcagtatccaaaaagtgttttgtagttttatgtttatatatatgtatactttttgttcataactatgtataaacagttttctatcactatcactgccataacaaattatcaaaaatttagcagcttaagacaatacaagtttattatctcacacctctgtaagtcagaagtccaaacaggtgtctctgggtaaaatcaaggtgttggcagggctgcgttcccttctggagggtctgaagaagaatcccttccaagctcattctggttgttggcagaattcagattcatgtggctgtaggatggaggtcccatttgcttgttggctgaggttcattctcagcttctggaggtcatgccttgtcttgtgttcccctttgtctctaagccatcaatggcaagttgagtcattctcatgcttccaaactctccagccacttcttctgccacacgactctctgactgctcttctacacccttgtccacttttaagtgcccttgtggtcacattagacccaccgggataatacaggacatgctcattgccttaaggttcttaacctaaattccatctgcaaagccctttgccacacaatgtaatgtattaggaattaggacgtggacatctttagggccattattctgcctacaacaatatacatttgaaaaagacagatagaaatacatcaaaataataacaactcttgtgtgatagatgttttccttgtacatttggactgtttccaaagtttctgcaatgtataactttaaattcacaataaaaaaaaacaagaggcaatttttaaagaaggaacataggattcgtatacagatgttggctgcgatcctgggcaagttattgatcgtgtgactctcagcttcctcacatttatgagggtgataattattccttcctaataaaattgtcatatgaattaagaaagaaaaagaaaagtccacgaaggacctaacatagaaggcctgcaagaaatgtttgttcttatccctcctctcctgaatttgatcataccattatctcaggagtactgtccaaactccaccttctttgatgtattataaatacaactgcttctcatatttgaaaattttcataaataatttgtctttcgttttccaaaaattgtcttcatcttaaagggctcagctcaatctggaagcagaagccaccatgaaaactgccctcactaatctgggcacctagttttctcatccattccatgaagcagctgggccagattattttattcaacctctagcaagcatgtactgttacattttctgtaaggaccctttcagctccgaagttctatcactcattttcagcaaaagttaaaataaattaatgtatacaaggcctcagcccagcgttggcaaattgacgtgttcgataaatgttagcttttaactactatttcattagtagtagtagtaataaatgtcttctggaaccccagtagccagttatccttgagtaacagtgatttacatcttctgctttctccttttggtgcatttaaaagtcttccctcaatacaacaatgacaacacacacacacacacacacacacacacacacacacacacacacacaatgcaaaactgggcaaagcagatatttctcccacaaatggccaataagcatgagaagatgctcaacatcattagacattaggggaatgcaaatcaaaaccccaatgagctatttatcaccgcacaaccattaggatggctattatcaaaaccaaaaaaacaaacaaaaaacacaagaaacaacaagtgttgatgacaatttggaaaaactggaacccttgtgcactgcttgtaaaaatgtaaaatggtgcggctgctgtggaagatgctgtaacatttcctcaaaatattaaacatagaattaccagatgatctagcaatttcacttctgagtatataccaaaaaaaattgaaagcaataattcaaagagatatttgtacatcgatgttcacagagacctaattcatgacagccaaaagtttccatcaatagatgactgggtaaacaaaatataggctgggcacggtggctcacgcctgtaatcccaacactttgggaagccaaggtgggtggatcacctgaggtcaggagctcaagaccagcctggccaacatggcgaaactcggtccctactaaagtcacaaaaattagtcaggcatggtggcgggcacctgtaatcccagccactcaggaggctgaggcatgagaatcgcttgaaccctggaggcagaggttgcagtgagcagagatcatgccattgcactccagcctggataaacagagtgagactctgtctcaaaaaaaaaaaaaaaaaaaaaaaaggaaaggtgtatatctacagtgaactagggaaggaaatcccatcacatgctacaacacggatgagccttgaagagattaagctttggatcaagctttcaattaagcataagattaagcttaattaataagacattcacaaaaggacagatgttatgtgattccacctaaataaggtacatagagtccatagagacagagaataaaatggtggttgccaggagctgagggagggggaatgggaattattgtttaatagatacagagtttctgtctgggatgatgaaaaaaattctagaaaagatggttataatggttgcacaacaatgtgaatgtacttaatgcctctgaactgtacacctaacgatggttaaaatgatcaattttatgttatgtatattttaccacaacttctttaaaaatctcctctattcttttcccatagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcaggtgattgcagggtaggagggacagcaaagacctgctgagccagcacaggctcatcacttaagttagaattccccttcttaggaaacctgctccttcttattgttccacaatgggttttggagctcagggctcacacaggatgcctgatatccgagttttccaggaaagctgctatgctctaccatgcactggtcttgggtggagagacccttgcctgtgctgctccactccctacagagatccaaagtccatccctcatggacttctatcactcatggcaaacaggattctgacccaaggggagggtgatgcaaacaccaaggctctacatcctcttcgtttactcgggactcttcagggaagattgtctaacagatttctgcttctcatccttcctttctgagcctcagggacaacgtggattcaggaaattgtggatatgattgaacagaatggggacgtggagaagtgccagcgagccatcatccaacaccgccatcctttcattgagtgggctcggccaccccaaccttctggtgagagcacctccctctttctctcttcctgctttctttccctctctcttctgttttcccctgtcttttctcacttttctcctcttctctcctctctctctcccccatctctccttcctcttctctttctctctcattttcactgtcatatgtttcttccttttatcttcctctcatcctctgtctacatattatttaagattttttaccaaaagtgaatcaccaaatgaaaaggatgtgtgctagggtcagattctgccttattttcttcttaagccctccctctgatcatgtgcaactgtagatcacattgaagatgtgaaaaactgtaagccatttattccttcttctatctgtaccccaacctgataaaacccagtgcagccaggagggtatccaagaatcgataattcacacacacatacacacacacacacacacaccccattgcatttggaaccaattatttctgttcaacagagaagacttttcaggtaatgctcaacctagaagtgtttctcttcacatcaaaaaataaagaaagctaaaaaatataaccagaatgctatatttcaggtaactggagctgctggaactattttgcaaaacaaggataggaggaaggcctacttccctaagttatagcattgcagagatccatgtgatagaaagctgggagcacagtagctgaagctatgaaaatgtagttaatgcagctctagcatgaagtctagacttggagcaactgtagacagaggtctgataaatccctaaaaatgtcctaagatagaaattccctgatctgatgcatacaagacacttgtaacctgtggaaggaggtgtctccaagtcagaatagccttaaaggattttgctttcccctatgatcctaccatccagcccctctggctcctctggctttcgaagaagagaaaatggtcactaggtaggtaactactcgctttgtaacccagtgcctgttcccgccctgctctgaaatacctgtggggctctgaccccatagacaggccagcctctgcctgcttaaccatgatctcactccatgtgccatgaggacctgctgttttgtgtgtgtctggtcttctgctccttgagcagcaggatggtataatagttaaggactaccagggtttaaatcctgactccatcactcacctcacaacgtttaaatcctgactccgtcactcacctcacaatgtttacataacctctctgtgttacagtttccttagctgcaaagtgtagatagaatcaaggcctatctcaaagagttgttgtgagcattaacaaattcagtataggtaaaaagcttgaagcagtgcctgacactcagaggatactatctacgtgttagctatctttactaaccacttctccaggccccatgaccccatgtgttccctgattatctaagaccagcattttttgtttatttaaagatggaggctagctctgtcacccaggctggactgcagtggtgccatcataggtcactgcaacctggaactcctgggcttaggcaatcttcccacctcagactcctgagtagctgggactacaggtgaacaccgccacacctggcaaattttttgcttgtagagatcgggtttcactatgtttcccagattggtctcaaatacctggcttcaagcaatcctcctgcctcggccttccaagccactgggatcacaaacatgagccaccacacccagcccaagaacggcttttgatctttgttctacctcctgcccctgccgctgcccagtgtcttacctctggcaatttgagagattaaagaaagaggagaggcctaagcaagatttctaatgaagtattcttagcagtagagagcagagtgttcaatcactaaatcggcataaaaaccaggatagagctgtagaatccagagaaaggatggtaatcaaacggccagcttggcatgtcatacagaggcaccctggcctctttaggaaccaaggtgccctgtgtgagaataacaaacagtctcaggctttatgatctgcccagccacagacagctgaatgctggctggagactcagctgtgcagtggtcgtttgtttggtttttttttttgagacaaagtctggctctgttgcccaggcaggagtgcaatggcatggtcttggctcactgcaacctctgcctcccgggttcaagcaattctcctgcctcagcctcccaagtagctggaattacaggcacctgccagcacgcccagcaaatttttggtatttttagtacagtcagggttttaccatgttggccaggctggtctcgaactcctgacctcatgatatacccgcctcggcctcccaaagcactgagattataggcgtaagccaccgtgcccagccagtggttttctttcagagtagataatccctgccagttgaggtgaggagcatcactgggaggagaccagttgctgacatagactcatggctgtcggccaaaggtctcaaccacccttggagcattctggagtggtcagacactactggacaatggatgagcttgtgccctgcatggtcagtctcccttccaggcccccttctgctctcccatcaactcccagccttgtagccgttctgtgacaaaagggattacatctgtgacccacagagaattggtttggaaagactttgaaaagacctgtgtgcatgtgtatgcatatgcatgtgtgtgtgtgaactgtatataggtgaaatctaggaatgatccacttagtttcagcaaacatctatgctcaagggcctatgctgctcataagacttcacacctacttgccctcaataagttattgtcccatggaagaaaccaatgcagatgatataacaacaagcatggagggctactggcagggtgaggggaacatggccaatgaaccgttcctggaggtgacacctgaaatgataaactgttgtcattactaattttctgcctctgtctcctgccagactgcaaactctttgatggcaagaaacaagttctgtttaactttgtactcccatggggctgtttctacagtattggctgaattgatttatccctcacagccacatgcaatttggctcaaatcccaaggctaaaatcttagtgcaactgacgaaggccaaaaatgaccccgtttgcccccttcttccaagctagtgggcttgggaatgggccctgcagcctgggctgtgtcatgcacactctccacgctgtgcttctccaccctgagtctgagcaaccatcgtggtattcctggcgggtgaggcaaccccatggggcttttctgaatcattgatgagagagaggtggggcgagggtgtgggggggcagaatgtacaatgtacctatgttcataaaagaaaacactggtcaactgctttatgtcaagccccgactccacagtatctctctcctgtaggggttttttggcagaaaaatttggagttagagctggactgagcccaccaacagggctggatcaggagtaggagtgggccttcttatttgtcatgggcaggaaggatgactgtgagccatctaaggaccataatgactgagtacagatttcccaattagaagactgggtctcttttaggcattaagtggttactgcccacagggcattaaatcaggtgtaataggaaagaggagagccgcgagtaccaggaaggaaatcaaccagcctgcagatctcactttctggcagattccctgaatttgctccccagcttgggattgacagtccaactccatccataaccttcccttctgtcctctatgtctgctaaggtttcttatagctttcatctccgtttctctacattgtgcttctttagctctgccactatttttcttttcagctatataagctctgctatttaaccctactcattgtaggttttcatgtccaaacactataaatcttcccagtctttttagtagtctcttgtttccttgctcatgttttcaactttctcttttattcctttgcacttttttttgagacagggtctcactctgtcacccaggctagagtgcagtagtgcaaacacagctcactgcagcctcaatctctcgagctcaagcgatcctcccatctcagcctcccgagtaagtagctgggactacaggtgcgtatcaccatgcccagctaattttggtattttttttttttagagacaggatttcaccatgttgcccaggctggtctcaaactcctgagctcaagcaatccacctgcctcaacctcccaaagtgccaagattacagacgtgagccactgcccctggccttctttgcatattttaaacatagttatttatattctctattaggtacccaataactgaggtcactaggggtttagttcttccacctgttttttttctagctcttgttcatagggcttttccctcatttgttttgtaattttgtataaaaagctcttttctccctgtcttgatctcacacctacattggaacatttccaatctagaatagtttaagttaacttctggtccaagctggtagtataatttcatatccatgcatgtagtatgaaaacaggattgtggttatgagttctcaagaaagcctctttttctgcacccagaggcgaggcaaggaaattaccttacctctctttggcagtaggtgatctttttctctctcacctttcactgaggtagcagacatttgagtttctccggctaatgcatgggtctctgttcctaatctgtgcctcactaaagtccagggctaccagcctcttccctgagcagaggtcactgaactgagcactgggtgtccagagggtgaacccactcagggcagctgtcatcaaagcctttgcccacttctccatcttgcagctccctccctcttcactttcgtccctggagggtccccttattttcttatgagcctgattatgcacttaaatgatacgtttggtgttttaatcagaatctgcaggtgtgtgattaacaggaaagatcttcataatgttcaggccaccatgtctccagcagtgaaagtacttggagagacccttgaagagtgagtgggactgtccagatgtgtagaaatgagagccggagggagccacaggggcgtggggcagcaggaccagggcatgtggaaggtcagagtgtgagctggcgtagaggtggagctgagaaaagagactagaggcaggagagctttgcagttcttctaaggaatatggacttcaaaaatggttaaaggtggttttccaacttttctttttagtaccaaaacacttttttatttaacaaaaattaccatgactacatgatccagcaattccacttctgggtatatatcccaaagaaataaaaacagggtctgaaacagatacctgtacatctacattcaaaataacattattcacaatagccaaaaggtggcaacaacccaagtgtccaccaatggctgaattgataaacaagatgtggatatacaatggaacattactcagtcttaaagaggaaggagattttctgcactaacttgacccagctcctctgacatgattcgcatgagcctctgattcccacactagagtggaagctccttagggagaaggcctgtgtttttcttgtctttgttgccttttcccctaacctcagcttaacacgatgattgcacaaagtgctcgttaaggcttttaaatgagagagtagaggccgggcaccgtggctcatgtctgtaatcccagcactttgggaggccaaggcaggtggatcacgaggtcaccagatcgagaccagcctgaccaacatggtgaaaccccgtctctactaaaaatagaaaaattagatgggcgtggtggccaagcgcctgtaatcccagctactcgggaggctgaggcaggagaactgcttgaacctgggaagcggaggttgcagtgagccgagatcgcaccactgcactccagcctggtgatggaccaagactccgtctcaaaaaaaaaatgagacagtagaaatcatgactcacaggccagcaagtatacatgtttttagagatgaaacaagtgattgcaaacaggccgggtacatgagacagcctgctgcaggcacatgggggtcatctctggctggcaggaaggtgagggagtcctctcttctctggtcctggctgactctgcctcagcaggacttcacttgaccattctcaccttctgtcacctcatccttaaagtgacagagtaaattaactctaaggccccatccaggactcaagctgtgtgattttacaaaaatgaaaattatattaataatcccattgtaaaatcccaaaagaaagtcaagagactagcagaaagacaggtgggtgatgggatgtcctggacagagcctggatcatgaggtccccatgtagtgcttgtactacgcagatgtttcctcttgagctattttaaaggtgtggaaaaagccaaagcaatgccctctccacggatactaaagactcacctttccactcagctgctgccaccgtctttctgggaaaacaactgcaaggtaagataccaacagctccctgtgacagaagggaaagtaagccaaccaaagcgagtcctgcagaccccaacgcagagcattcgtgatcacctttgcctctccactgtctctgatgcttaccagcaaagagaaaacataaagttctacattcagcaggacattcacctgaacagtttcaaataggacatgaaggcaggatccagattgaatgtttggagggaactagagacatggggaggcagtgagtgcagtaagcgtagctgtgaaatgaaggggagaagatggtggtcccaggctgcaggccatggggaggttttctaacagaccagggagggaagaatgagaggaaaaaagctaaagctctccccaaaggaggccaggcgcggtggctcacgcctgtaatcccagcactttgggaggccgaggcgggtggatcacaaagtcaggagatcgagagcacggtgaaaccccgtctctactaaaaataaaaaaaaacttagccgggcgcggtggcgggcgcctatagtcccagctactcgggagggtgaggcaggagaatggcgtgaacccgggaggcggagcttgcagtgagccgagatcacgccactgcactccagcctgggccacagagcgagactccatctcaaaaaaaaagttctccccaaagggtaaacagatgaatcaggcagagcaacgctcttgaggacaccccacctctgcctctggtagactctgagttcttcgttttatttattctgtgactttattcgtatgcaccccagtgcctaataagttcctggcacatagagggcattagacacgtccttgctgagtaaatacggaagtggctgtagagcaggtggagtcaagggtacaaactgagccgccagccttggtgagaaagtggggcactgcttccttaaaggcaggaatgaaggggaaagaagggctaagaaagatatgttgctaggggactggagtgaagttggaggactcaaatgacttcactccttttagtaataatgttggataaggggacaaaaacttccatttccagaattatggcaaactaggtgttctgaacccctgaagcccttatatgtagaacatccaggattactgcataaaaaaatcacaagtttccttttaatgcataactgagatcaaaataaagtccctaagtttagaaactgcagaggaaactgaaactcagagaggcaaattgagactgggactctccaggggaaatctgatgacctggataatccagcaatttaagttttaatggctgcacagggacagggtcaaagcccatggcacaaggaaccagaagaatgaggagccaaagctgggaccactgaagggctacatcctcaatggatgggtggaggaggcagagaaagaccttagggaaccactctgccttgacctaggcgctcagctcccttgagaatgtatagccacaggtttactccctcggggtttgagattgaaaattgcactccttgcattgtccaagaaactacaagcagagacattccacaaggtggtccccacagccagtgttcccaggtccgctctggagggacacagctgcaactcagacccccataggatccccacttgagctcaccatcccacattacaaaatacacaaaagaacaagccaccatgagatgcagtcttcagaaagaacccatggaagagtcagacctcaagaacttcagacaatgtaattatcaactctagaaataagagaaggttcaagttgtgtgaataaatgaaaaagtgtatcaaaaataaaataaagaaataagatgctacttttagacacagaaatattaagtaaataaatggaatttctataacaaaaaaatataaaatcatggaaattaaaaactcaagcataggataaagtgcagaacagctgcatagagaattagtgaactcagacaggaaggtttgagggtaaaggtttgaggagagaggagagacctgtgtctggagctaagagccaagagatggagcacgggagggattaataaaaggattatcaagcagcaatgaagaggaagaaaactgagcataaaaaatttagaaactaggggaattttttaaatcagcatttcttaaaaccttctttactggtgcttggcagcttggtaagttggagaagagaagatggggagtaggacttagtagacagtaacagagtcaacgctttcaggagcagggtttctcaaccttagcacttgctctaaagggcctgggacttgatataatcaggcatggcaagacatgcaggtacagtggtgactgtcataaggaagaagtgtgtcctcgcagatacctagaacaggaggcatggcatgtcacacagagcctcacagggaagcaatgggatagatcaggaggaagagacagtgagtagaagacatgggcaagagccttgatgtggtttctttgggaaggaatagttgaggcaaggtaggcaggcttgggattggccagtttgaaccactggagcaggctttcagccacaggggcttggcctagtggtctggtatctgaccctggggtgtcagggcaggtgaataatggcccagtgtgtaaaagcccaacagtggaagtgttgggggtataggctctggggtgttgtaggcagttcctccagagtcagcaaagccccaggatgtcaaagcatcagatacagaatataaaagacataattaatacagcactcctgacatttggggcagatttttctttcttgtgggtgggagcaaggggactcttctatgtattgtagaatgttgaacagcatacttggcccctgcatggatgccagtagcaccactactccaagctgtgcaaccaaaaatgtctccagacattgccaaatgtcccctagtggatacaatcatcccatcatccccaattgagaaccacttaaaagtgaaagaataaaaaagcacagcattgaaatagctggtcatagatctgagatgcatagtcaagaggcccatttggcattgatgccattaaaatgtgaactgagtactggataaaaggtcagatttggtaaaatgaaaggttgggagagtggagggatgtgaaattgtgggcaaagtggaacttgaaggaatgtttgtaggggcagagctgaaatgattagagatggaaatcattcaagccgaggaggccaggagaaaaataggagctattttcttgctgtgtggctcaaactcttaaacatgaagcttctgtgcatctttgggagggtgcgcgaggggtcatcagtttacgttgatactgtggaagtctcctattcaagtggcaggtcatagtttacagaaaaagattttgctcctgataccaaaggggcaatcaggcaatctaatcctcaccaatccctaattgattagctaattaaaaggactgagtttgaagtagagagcagacttggtgacaaagcagagacagaaagaagagggaggtcacaaggccaagtcgcagggccagcactgcagaactgagccagagtgcacagcaaccctcaggatggctctgcctaagggaactctgtgaaagtccactttttataccatcttttacccacctcttttcttaccccaaagttcctttatgtagctcgaaatgccaaagactgtatggtttcctactaccatttccaaaggatgaaccacatgcttcctgaccctggtacctgggaagagtattttgaaaccttcatcaatggaaaaggtacgggaacatccttcacacccttgcattctcactccagctaggctgggtctagggaaccacaggcagcattttatcccctagaatgcctgtacttcatcaggtgtgtcctaccacagactgggactgggcagagcaagctggccactgagtgtatgcccacagccctcagcaaacatcttccacctgattcagagtctttaattacagccatcctcttccaaaaggtgtccttgtccctatgtgattgcacataataggaagccactttagggacgatgttggggcaagtaaccctaaggctgtccccatctacaccaccctcaaaatcaaacagatcagaacccttaggacatatctaatacagaatttgggttttctctctctaactcacttcaggaaaatccctaatactcagaaggttttgtgtgatgcctatgtagactattctgtttcctgtgtctatttcagtggtttggggttcctggtttgaccacgtgaaaggatggtgggagatgaaagacagacaccagattctcttcctcttctatgaggacataaagagggtgagtgaaggctctgcagaagaaccattttaaagtggttcttcaggtgcagagaaattcaaagttgtttcaaaggacatcccagagaattgtagtatttctttatgatactctcattcattccagtccaatgttacccttgccgcaggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggtgtgtggggcctctttatcatacattcagattgtctcgtaacatcctgtctgcctcttagcagacaatattgagttttattaattccaagccaatgcatttcaactattcctaatatgtgtttctaataaaaccagggatttgatcctgttgtagaagagagctttctagggtattgttccagtatttggttgcaaggaacagagagtccctcaagctagccccaaagaaaggggcttactgtgaagattcaccatggacaataaaggaaatgcaatcacatagaaaactaggaagaggagccaccactggtccagacctcccaggggccgctggatctcagggtccaggactcagcagcaggagggatgtgtctttgctccaaagctccaccacttacaggactcagctgcttttcacatatctattaggcatggcttcctctgctaaccagcttccggtctctccacccattacaactttctcccactttataacttctgatgactcagtttctgctcataacttggtcttgacccttacccaaacctgctctacttcatgagtttcaactacaactactgttgagaactgcctcatcctcagtatttcttagttccaattcccaaaggaggaattctaactggcccatctaatattttttaagaaaaaactttatcactttctaatttaaaaagcaaaacatgtcattgttaaatattaaattgggctgggcagattgacttatgcccataatcccacgttttggaaagctgaggcatgaggattgcttgaggctaggagttcgaaactagactgggcaacacagcaagaccccatctctacaaaaaaaaattaattagctgggtgtggtgatgcatccctgtattcccagcttctcaggaggctgaggtgggaggagcacttgagcccaggattttgagaatgcagtgagctaggaccttgccactgtactccagcctgggtgacagagaaagacaccagcttttcttaaaaaataaactaaataggctgggcatgatggctcacgcctgtaatcccagcactttgggaggcctaggcaggcagatcacgaggtcaagagatcaagaccaacctggccaacatggtgaaaccctgtctctactaaaaataaaaaaattagctgggcgtggtggtgcacgcctgtagtcccagctattcgggaggctcatgcaggagaatcacttgaacccaggaggcagaggttgcagtgagccaagatcatgccactgtactccagcctggtgacaaagtgagactgtctcaataaataaataaataaataaaatcagtataaaattatattttttaaaagtctctccacaaaaactccacccccaagaagtaactaccaacagtatggaagtccctttctctctcatttataacatacagattttttattcacaacagtgaaatcatggtatacacactgctttgaaacatcttttcttcttcctctttgattttgcatgtgcttgaatttatgttgttgcattttccaatctacaacagtattccataccaatgaaacaaaccaaaatattctaccccttttctctttggataaccagtggtaatgatttgtcaaggtgcccttcttcaggctcatacataaccatctttctatacaccctccttcttcagactcacacagacacaaagatatgtaaccataatgaaagcttgctccctaaaatgcagaatggggtcatattttatacctttacttaccaggatatgagaaacccctctagggcaaggcatatagactcatacacctcattgatttctttggtcccatgttataccaagcgaaggatgcatcataattcatccaactattcccttaatgatagacactatagttattattgttttcaatgtttgtttttatgcataatgttacagtaaatatctttgtgcataaattatttccagatgcttttatttctgttgcataattttctggaagaggtattggtggggaaaagagaatttcccctgtttaaaattagtttaagttgttgtttggtgaaaaatattatctcattcatatttttccaaaatagttttttattgagatataatcaaaataccaaaaatgcacagatcttaagtatacagttcaacccattttaataaatgtatatacccacaccacccgcaccccaatcaagatatgaaacattttcattaccccagaaagttccctcttgtgcccttttcagtcaatgtctacctccagggacaaccgtttttccaatttctattactctagattgattttgcctgttgctggacttcacgtaaatggaatttcacagtatttactttcctgtgtctcgtgtcttttgctcaacataatgttttgagattcctccatgtggttgtgtgtctgtagttcatcattcttttatgtctatgtagtaatccatcaggtaaatacactacaggtggggccaggtcatgcaggccactagctgccttgggtcagttgtccagctgacttagaagtccatccccctgcacagagtcccctaggcctgcttcttataggagagctgctcatggacaggtgtccactgaagggggagttgggtgagtcaggtatgtggacaggccagattcagtatgggcactacaccactttactcagggacaccacatctttcaatcagagtgacactcctgtctggccttcctttttctaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacatcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatctatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatccccactgcattgtaaaatttttgttgttttgtttcatgtcttattcacctttgtatggaaattaattcagaaaccccaagcatagagtctacctctttaattccagcaggcagatgtagttctgcctgcttccttccaaggttaagttcataacagttcagaatcttgcaagctcacttcaggtataacctgtgtctccaaccctgcagtatttggatattgctgtttaaacagtagatttggcatagatgatggtggcacaatggttgtaaaggaaaagaagcagaacacctcagtttgttcaattctctcattggggttttcagttgtatccagaatttaaaacagtaaaatttaagagtgtgaacagcaacattcacactttgtttagtaagtacaaagttgtgctcatacaggaagtttactgactttgaataataactttaaaaacaaaatttactcttttctaagtgttaattatttgttttaaaatttaagaatgaatcaagaaataaaacattacaccagtggtatgatttagtaattgtctgacttatactttttgtagacattttagttttatttaaattggcattctgatttttttactggtcttgagtctatacacaaaagttgaataaaagaaaagtttcactgactacatttctttactattattattacttgtctctattcatgatcaacactgaaaataattttgttgtatacggaagtaatgttgatatggttaggctgtgtccccacccaaatttcatcttgaattgtagctcctataattccctcatgttgtgggagggaccccgtgggagatcattgaatcattgaggtggttttccccatactgttctcatggtagtgaataagatgtgatgattttataaggggtttcctctttcacttggctctcattatctcttgtctgtcaccaggtaagacatgccttttcaccttctgccatgaatatgaggcctcctcagccacatggaactgtaagtccattaaacctctttttctttataatttacccagtcttgggtatgtctttatcagcagtgtgaaaatagactaataaagtaaactgatactggtagagtggggtgctgccataaagatacccaaaaatgtggaagttgctttggaacttggtaacaggcagaggttggaacagtttggagggctcagaagaagacaggaaaatgtgggaaagtttgggacttcccagagacttgttgaatggctttgaccaaagtgcttataataatatggacaatgaaatccatgctgaggtggtctcagatggagatgaggaacttgttgggaactggagtaaaggtgacccttgctatgttttaggaaagagaatggtgtcattttttccatgccctagagatttgtggaactttgaacttgagggagatgatttagggtatctagtgaaataaatttctaagcaggaaagcattcaagaggtgacttgggtgctgttaagagcattccattttaaaaggaaaacacagcataaaagttcagaaaatttgcagcctgacaattcactagaaaagaaaaacccattttctagggagaatttcaaaccagctacagaaatttgcgtaaataacaaggagccaaatcttaatcaccaagacaatggggaaaatatctccaggccatgtcagagaccttcatggcagcccctcccatcataggcccagaggcctaggaggaaaagatggttccatgggctgggcccagggccttccctgctgtgtgcaccctagggacttggtgtcctgtatctcagccactccggccatggctgaaagaggccaacgtagagctcaggccatggcttcagagggtgcaagccccaagccttggcagcttccatgtggcattgagcctgcaggtgcatggaagtcaataactgaggtttgggaacctccacctaga

SEQ ID NO: 11890 - DNA, 46253 bp, Human
acactgtgccctttccttcccaaaccctcacccctgggcctgaccctggagtcaagaactgcacttggcagagttcagagagaagtcgcctgctctcaagcctgggtcggcctggagaaggggagaagccccatgttgcatagagattaagcttgaattcgttcccaggatgggacctaagcctgggaggatccccaccttcaggaggtgatggtgccattcactgggatagggaaactggcaggaggagccggttgttgagggttgggggtgcagacagtctgttggtcccattggtcttgaggtgtgtgggggacaactagagagaactattgtcccctgcttccacgaggtgacatctccctcctgccttcagctctattttagggatcaaggagtccttggagctgctcctaggcattctcataagggccagaagagctctgcatgtctgtccagcggctctgcagagttaaggctgtgggtcataccagccacaccctcagcgtggtccatgtcacagaaacatgtggaaaccaggtgatttcccagcctcctggtcaggaggtggggttttccatccccagggagtcacttcccagtttctcactcagcactcagcacctagaagcaccatccttgcaggctccactgtggggctggtggccgggagcaagggtctctgtacctcttcaggcagcctgcagtgaggaaacagggaacagaatagcctcctgccacccagcccaccccaacccttagaaatgccctatgtgctgggggctaggacccccgtaatccagggctggaggaatgtgctctggccccgcagggctggccctgtattagggctggcactcaaagtggggatggggggacagattgcagctggaatgggtgctcggtcatgatgtaaatcctggggaagccagctctcctgggcctggtctcagcagcccctcagggccctgcagcttccctggtgacattctctcccagcctctgttcatctgccccctgcctgggcaggagacttgagcagggaagtgcagagtcttctccctgtgagaaggctggatgcgtgtttaaggataaatgaacacgcgaagagtagtaacaacagccaagatttataaatgcctattgttatatatgtagatacttacttaagtatatataaagtacagactgcattatgtatattacatatctttaaatttttagaatagtcctatgaggtcagttcagagatccagacccaggtggtctggctctagagtctaaacaggccgagtgcagtggctcacacctataatcccagcaccttgggaggccagaggcgggaagatcacttgagggtgggaagaacacgtgagctcaggagttcgagaccagcctggacaacatggcgaaaccccatctctataaagaaatcagcctagcatggtggcccgagcctgtagtcccagctactcgggaggctgaggtgggaggatcgcttgagcgcaggagttggaggctgcagtgagctatgggtgaaagagtgagaccttgtctcaaaaaaaattaaaaaataagaattaaatatatttaaaatagagtctaaataagtgaatgatctagaattctcttggttcccctaaagcagctgtcagctttgggggatgtttttccaaattagtgcctcaccctcacgggacagggaagcctgtgggagctgggagggcaggtggaggccgggcaggtggaggccgggcaggtggagatggtgattcgaagaggaggggacgataggaggaggttgaggggtcacccgagtgctgggagtgacgctggaggtatcggcccagcgatgctggagtggtcgggtcggaggcccagcagcagcgtctggggaggggcgtgggggaggcgtgtccaaggccggctggccccgccccgccccgccgcctggcctctggcccgctggggcgcgggctttcgctttcagtcgagggctagcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtgggtgactcgcgcggcccacgggggacagccgccccgcatgtccacccggctggtgcgcagccttcgggtgcccgggccgcgctctcccggggcgctgtcacgggctgggaggctgggagtcccagtcgccgccccccatccgcatcagacacgcgcgcctctggggacccgctggggactccgggcccggcacacgtgcgctcggggcacaactctggcccccgaagcccctcttacccgcgtcgtgacaggggcgcaccctggttcctccgcgagcgcaggccggggcatttggggctgagcagcgggtcctgggcagacccccgctagacccgggacccctcttccctcaccccggcgactgccgcgacagcccttccctcccacgcggtggagaaggggctgtgccggggcgctgccccactgcccacgccgggcaccctcttcaaaagacttccttttcctctgggcgacggttttccgatttcttagaaataccagggtcctgtgtctgaagagcaggaccaggtgtgtgtcaggtccactgagggcacagctggagggcgagctgcctgtctgcttcctccgatgcgtccgggggctactgcagagtctgttttctgcggcctctggggacagggcaagcgagggaggtctgggctggtaatcgagcaaggcaaatgaagtctccgggggccgcaggaaaatggagacagcagaaaccctagggctcctattcaatatgaacgtcactcccacagtagcaacgggcgtacaagggactgtgcaccctttgcctgtttttgactgtctcctggtctggtaacataggataaccccatttttgttttactgtctccatggtttggtaagataagataaaccattttttagagaaggaaaactgaggctcagagaacttgtatttcatggaagggtctggggggaactcttcctccaaagggggcctctcctgccttcggcccctgtgccctgaggctgcggggaaggtgggcgttcatccttcctcagagccgcccctgatggacacatggcccatctgcccccatctgacatcttgaccgaggaggaaggtgggaggtggcactggcttctgtggtgacataaggtgacttgttgatctgaggccagagagtccagttcttgtgggtggaagatgggggctgtcagactagaattgactcaccgacagtgggtgtcaggagtgggtcctggagaactgccccagagtaagtcctgggtggcctttgggtcaggagagtccccactctagggccgagtgtgaatggggacgaccgtggtccccagcttgactttggggtcatgccatatactctggcctcagagggggtcttcctgccgctgagcttgggcctgcctgggtgaactctggggtcatgtgagcccctggatgggagaggggtgtcaggcacagggctcagcaggacaccaggctgcagtcctggagtagctggaggaggttccctcccacttccttcccttcctgaccagctcctgcggcagctcatattccctcctccctcatccctgctccccacgaccccacccggactattgccgcagccttgtagctggtctcccggccctgccccctctcccgctgatccttggcagagagacccttctcaagcatgaggcacctctctgtttgcctggggagcctcctgtggctcccaatggttgaggcagaaactcccctggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgcaaatgccattctctccaggaaagcctttccgcattctcagttggatttgatcttctcttcgaactcccaggcccttttgttccctttgaggacagattgcattctgctttttaatctagctgtgttttatccccctcagtggatggaaggtgtcttcagggccagaactgtgggttcctcttccttctcatcagtagcatcgccatagctcctgatttctgaacacccactaaacaccaggcactgggctaggtactttgtcacaaaatttcactgaaacctcccttacagcaactcccaagaggtgggtggtgccgtttgtctttagagatgtggaaactgaggcgtttcccaggatcacagagctgggggccggggagctgggggtgggatttgaatgcaggtctgcctgattcccaagctcctttcactgcaccctccccgtgcccgtatctgcactcatgctcccagccaggccctcacacacagtgggttctcaggatggaagtcaactgagctgcagaagaagcccccaggagacctgagctagccatggacgcagccgactcactgccagcagggcttttgccccgtttaaaagtcttatttgccagctggtatggaaaacatcattcattcatttagccatttattcatttgacaaagaaatgccagtaaacctggcagtaggtgagtgcttggtgccctctgatggggatgagcagggtctgggctgtctggggaggaggatgaggggtctctgcctgatgggcctggcccacctacccctggaagtcttggtgctgaggtgccactatttgcctcctcatcacccagggcctggggccagtttgggttaggggagaggttgggggctcccaggctggatgtcaaagaggagttgggtgatctggggtacctgctggccctgggggctcttccctccttccaccacgtctctgtctctttgccctctgtctgaaatcccagtggggaccctgtgtgttgactgagggtgtggtctgttggtcaggcacgtcttcagagggcaatgggtaggtggccaggcaccctgaggcagggccattcattcattcattcattccccaaagttcatggacacacctagtccaagcccagcccagtgcctggctctggggacctcaagatgactccagctccaatcctctaggagctacactaccaataggtcacagacctcacagacctgggctctgtcccaactgcccttatgagcttagctgagctagtaagcctatgttctcatctgtggttgtggaaagtattccctgcctggcctttgtcacagagccatgggtgtgaaaggctgagaacctgccgggcattcttacgtcagaggtgaccctgccatcctggcacctggcacagtggctccccgtagcactgtccctccccacggctgggtgacgctttatggtccttactatgcaatgttttctggaggagtagcagggacggttgtgcgtgggaaggggaagagttttgccggagccatggcatgtatgttacacccgactctacaccaactcacttcttactttttttctgagatggagtcttgctctgttgctcaggctggagtgcagtggcgacatctctgctcactgcagtctccatctgcctcttgggttcaaacgattctcctgcctcagcctccagagtagctgggactacaggcatgcaccaccatgcccaactaattttttttttttttgtatttttagtagagtcggggtttcaccatattgcccaggatggtcttggacccctgacctcaagtgatcctcccgcctcagcctcccaaagtgctgggattacaagcatgtgccactgtgcctggcccgttctcacttcttcttctttttttctatttaatttttttttattgagatagagtcttactctgtcacccaggctggagtgcagtggcccaatctctgctcactgcaacctccacctcctgggttcaagcaattttcccacctcagcctcccaagtagctgggattacaggtgtgtgccaccatgcccggctaatttttcctttttttttttttttttagtagagaccgggttttgccatgttggccaggctggtctcgaactcctgaactcaagtgatccacctgcctcggcctcccgaagtgctgggattataggcgtgagccaccccacccagccccattctcacttttaagccatgcttttctgtcctcagatgtgctgcacacacacctgctccagggcctttgcacttgctttccccatcacctccaatactcctcctgctgacgtctcttggtctccttccctcgcttccttctgctgaagtagacaatcctgcctgtaggtgctccctgccaggcactctcactccctgacctgctttgtattcctgtataatgctcttgacctattctatttatttcacttttattatgtcttcccacaagattgtaagtaccgtgaggacagggactcattcaccactgtagactctagcctagaagagggtttttcagtcagtgcctctgactttaattctttgttgtggggctgtcccgtgagctgtaggatgtttagcgacatccctggcctctacttattggatggcagtagcgccaccctccctcgtgacaaaaatatctccagatattgctaagtgtcctttggggttgggggattgcccctgattgagaaccactggcctaggacagtgcctggcacatagtaagtgttcaaaaaatattcatctgaccttgaccttgataatggccctgttttacagatgagacgggggtttgaaaagtcagtggtggcagggtggggttctgtttgcctccatctcttggggtatttttctgggctcctcttcccattgagtggtgtctgctgaggttaggggtcctctccccaaattgctcaccccctcgacatccctcgtgtagtgagggatggggccactcactgacggtgactcagggccccagaatgcatgtgatttacccagaagcgggcaaggagggaagctggggtttggggtgccggggatgaacaggaacaaaggagaggcgctgtggctccccgttctggaccctcgtctggccacagggaagcagcactgatgactctggggaaaggccccggcctctgaatcagataaacctcaagtcgctgctctgctgttttactggctgtgtgacctgggcaagtctttctatccctcggagcctctgtgttcttatctgtaaaatgggagtaatcctagcctcacgggctggctgtcaggattaaaagtgctttctaatcctggcattggcagctatttgagccattggtggctttgcaggtctgacccgactctctgggccatggggtggtgctcgggcctaggtggggacccctgtggagtcagactgtctgctctgagccccagggccctgaagcttgggtggcagccctgcagttgcccagagttcctgtctaagtggctttgttgcccatcatctcagaaagcaacttctttcctccctgccttttcctgtctgtgcttctgccccagtgccccctggctgggctctcaaacccactgcttgacagcctggtcttaggacactgtattgtggcaaaggctgtggggtcaggatatcccctcccctccctttgccaccccttttagtgagtaacaggtgctgtgtgttttggggatgagtgaagggtacatttggtgaagcacagagagagtgcacaaggcttcagtttgcaagatgggcacgggaagattccaggccatctccaaaacctcttccatctccaacctctgtgctgctgaaggttctgtttacttgtgaccctgagaaggggatgccctgtgggggctcttctgagatcatgctgtccattttcctgcctccaagtgacttctaagacagcatggctctgaggaaggagcactgacttgggtgttgggagatcacagttcccatctgagcaccgtcactggcttgctgtgctaccttgcttgggttacttaacctctctgggcctaagcatccctatctatgaaacctaacaaccctggttccaatgctttcctagaatattggggaagtgtcggctttgagtatacttgacaaaggccacagattgggggtggggtatataaaagtctacaggaaggagagcccaggactccccactgtcaatatcttggttccccagcttctcttcttcttgctgacctcaatctcacttgctttgggtggattgatttcctgactcaggctccagggccatcaagaattcacggctgcctttcagccttcatgaaggacatggtggagctccttaggcagaactggggtttgtggatgtcctgcctctctgccccttggtacctaggtggcaccttttcaagttcgggagctagatcctttccccttccccacactgtaggaaagtccttactgtaggcaggcgctgcagagcctgctgtctgggaacccacaggttcaaggaagccttgagcaggaagggcgttttcctggaagaagccctttgtcgctggtaatgggtgcaggctgctctgacccggttctgagtcctgcccccttccaggcctagggctttgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtctttcctgtgggctgtgacaagccactctgcatctctgagactccatttcttcttcttcttcttcttcttcttctccttctccttctccttctccttctccttctccttctccttctccttctccttctccttctccttctccttctccttctccttctccttctccttctccttctccttctccttctccttctccttctccttctccttcttcttctgatggagtctgactccgttgcccaggctggagtgcagtggcgtgatcttggctcactgcaacctctgcctcccaggttcaagctattctccagcctcaaccttccaagtaactgggattacaggcatgcaccaccacacccggctagtttttgtatttttagtagagatggggtttcaccatgttggccaggctggtctcgaactcctgacctcaagtgatctgcccgccttggcctcccaaagtgctggaattacaggcgtgagccactgcgcccagcttccatttcttctttgaaaagtaggaggggttggaattgtcaccctggaggttcatggttgctagattattgattctgttgctggattcaggagacctgttagctggctagttcacagcaagtattgggtgtttggaggggggctgcagagccccttctcaggccccaggagggccagctgccctccctaccccctcttttggacactagtgggcatgttctgctgggaaaacagacagtgtaacctgacttcgagggctgcaggctgaatctctttcagatgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaaggccagaggccgtgggagtgggcggggcctggggctgggagtcaggggtctgaggcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgcctcagttagcgggacccccaccagtgccctgggtgcccctgctggcccctcctctcgctgaccccagccccagtttctggctgcaactcacagaggccccaggctcctgtggccccatcaccagcagctcctgctgtcatttcctgagcctcgcaagcccctaatcctgctccttcctgtcctggcccccagctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacggggaacctcctaaccgctgagccctgaaaggtaggcgggtttaggatgagtggctacagggaggagaatggtgtggggagagagatatggaggaaagaatattaggggacaggccgggcacggtggctcacgcctgtaatcccagcactttgggaggccaaggcgggcggatcacttgaggtcaggagttggagaccaccctggccaacatggtgaaaccctgtctctactgaaaaaaaaaaaaaaaattagccaggcgtggtggtgtgcacctgtagtcccagctacttgggaggctgaggtatgagaatcacttgaaccccagaggcggaggttgccgtgagctgagatcgcaccattgcactccagtctgggtgacagaacgagaccctgtctcaaaaaagcaaaacaaaacaaaacaaaaaccgaatattagaggacaatgttaggactgtcccagctgtcctagctggagccaaaggtttgttggggacagtgacagcagcacacgaggctgtaagtttagggccagtttatggaggagtagtaccaattacattgagaaaactgtagcaactataatttgggaggaattttctaaatactttacatgtgttatttaatcttcccatcagccccaggaggtatgtgcatttatcagtcccattctacagatgaaaagactgaggtctatgaactcctttatttaaaaacaaaacaaaaccccctcaaggctgcctgctaagaggggaggagtgtggattcaagccagcatccttattccagtgtccatgctctcagccaccacacacacactcctatcaggagttggggcagtggggagccattatagtttttgagcaagagagtgacagggcaaagatcactgtggcctcagtgtgaagcacagatgagatggagagactggaggcagggaggcccatgaggaggctgtcaacatggttcaggtgacagctctgggttggtgaagaagcagagaacaggaaggaaggggcgagaggcttgagggaggaggaggaagcctttggactgggccgtggatatagggtgggaacataggaggtgaggagcatgctctctccacctgctttttgcaacatgcggcctctctggccttagctctgcctgtcctgagccctgagccctgagcccaatggaccgattctgttttttttttgagatggagtcttgctcttgttgcctaggctggagtgcagtggtgtgatcttggctcactgcaacctctgccttctgagttcaagcgattctcccacctcagcctcccaagtagctgggactacaggcgtgccccaccacgcctggctaattttttgtattttttttagtagagatggtgtttcgccatgttggcccggctggtcttgaactcctgacctcaggtgatccacctgccttggcctcccagagtgctgggattacaggcgggagccaccgtgcccggccccagtggactgattctggtcagtgtcaaccccatttgtccctggagcttttgcagtcggtcacagggccagcccggtcctggtcaccgctggctggttaccccggctgggttgggcaggagtctgggcagggctggttgctcatctcaggtatgaaattggctgcacccccactagtgtgggggagcaggattccagggcctgcctggcgctgctacccctgtgcctccagacccctcgagctcctcccagacctttggcttcgttgactgtgaggtgaaaacaaaagggctgctctctgtcacttcccctaggggcgggcagatgctggcagggcacagagagccgagggctaagagctgacatttagcctggctactcaggagactgaggcaggagaatcgcttgaacctgggaggcggagtttgcagtgaaccgagatcgcgccattgcactccagcctgggtgacagggtgagattctgtctccaaaaaaaaaaaaaaaagaagagctgacatttagcgggtgcttcttgggtgcaatgcgcaagagaccgatgcattaactacacagagtgcccttccttgtcacagctacctgggggcaggggaacatcatccccattttacagaagaggcctttgaagcacagagattaactgacgtacttagggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctctttgtaagtccatttcctgcccatttctcatgctagctccagctcatttcaactaattgaaaattaaaactttgcttctgttgagcaattcggcatcgatgagacgccagctgtgggctgtgtgctggctgtgtgtagggtgatgagtagcagaagcacgggtgacactgagctctttccactgccgggcacggtgccaagcacgccacgtatactgacttcatgaatcataaagccctgtgaagggggcactgtttctgtcgccattttatagatgataaagtggaggtgggggaatggcagaactgggatcaaagcccacgtgtctgtgtctggctcagcgcccatacaagggtgtcaaggttgcggggaggcacgagggaaccaataattaaccaaaactggtcgggtgtgggcagtatagagatgcacccgggttgtcacaggagcccctaggagggacctctgacctccctgaaatgatggcagagggaactcttgaaagaagctgagaagtcagcactgccaggtcgggggtggcgggtcaggacgtttgggcagaggcagcagcagtacgggcatggagaagggggcggaggagccaggtgctgctttgtgttgtgacagcaacaggtgagtgatgaatacaggtgggagatgctggcaggggctaaggaggttgcgcaggtggtggcagccgctggaagcttttaaggagagtcaggcttgattgtaggaagggggcttaggtccatctgaaagggacagaaggctgggaaccaagaccaaggagcctgcagctggcaggagatgctgagggcagcgaggaggaggggtcgtgggagatggagcaggcgacatcagcaggccccttggagggtgacggtgggagaggctggggcgtctctcattagactcagggttccttgcaggcagggaccatgcccggcgtctttgtaccctggcatttagcacaaagcctggctccaagaaccggataccagcccagtcttcctgtctgcccccagctcatttctaaagcaacatcacaggcagcgagtcgggagtgggatgtgtcacccccgggttgcctgcctgtgatgtggtcagtccttcctaacgcagatgccattcctctccgtgacggcagacgggcctccgctgtcactggccctggcgttgctgtgacgacctggcctgatgtagctgcaccctgcagtccatggggctcctgtgaacccccaaggttgagacccaaatgcctctgctgcctcccaccacgccctaggggccccgcgacccgccatgcaaatgacgtggtttccgcattgcttgaagagggtttcctctgtgtgggggtccctgggtccttgggcagatacctctgcccctccccacagctttggcccctgccctaagaccctggagacccttttgcctgggagagtcactgaaccacctgcccctgctcacagtgtgttcacagaagagtcactcccctctgtgggctccttgtctgtaaaatgagggagcaggacaagatcacagggtacaaaactgtcagagggcacagaggctgatgttgctgccatcagctcctggagtgccgctcactggctgcatgaccttggacaatttgcacgaaatctcccaagcctcaatgtctgcatctgtaaaatggatcatcctgacctcattgcgttagtgctaggataaaataaagagaaggtatatgaacgtgcccagcactgtgcctgcacacagtaggtacttttcctggatctgaacagtctctgttcttccagctctgtgtaaaggcttgatctcgacccctaaagcctgaagcttctccctgtggccacctccccaccgcatcatcttccgttctcagcgggtagatccctgcccaggggggaccccctggggaaggctgggagcatgacctcttcccaagggtacggcatctaaaagggatctccggaacattgaaaagccatgaaggccgggcacagcggctcacgcctgtaatcccagcactttgggaggctgagggaggaggatcgcttaaggccaggagttcaagaccagtctggacaacatagcaagacccggtctctttctataaatgaaaaaataataataaagccatgaagatccccaaagaaggctgtgctaatggcggccggaagagcagagggcaccacagatgccgtgctttcagctttttccttctcctccaggcctcccttctttccttcctctctcgctatttataaataagagaaggcattgagggcccccacctcgggtacttgcagggccttggcctgggaacaggacaagcagcaagtcagttgacccggggttgctcaattccccaagagctgacgcaaactccagaatcagacctgccctggccacctggccctgccccttaccagctaagggctccagcagagtcctagtcttgagcgaatcttatacctgcagccctgtccaccagctgtgcttcctgagtcctccagggtgagggggcgtggggtcagaagagaggggacggtgtgcagggagggtggaacctgactgaccgggtcagccttactcttccagcggggtcttttcttcctggagctcggccctcggcagctctcagaagctcaccttcttgcaggctctcacagccgcatcgtcctctggctgggctgctcacagaccccggcccctgggttttgtccactcacccagactctgttttggggtcacattacccttccagtgttcctctgagcaaagtccctgtgagttagcccaaggtccctgtcaaggaggaccacatctggcctgttgcactcttctcctttgccccaccgaagcctctgtcacactgtcacagcagcgggcctgccatggtctccccatgtaaggcttcctgaggaacgggcctggtgccagcctgggggtgaactgccagccccaggagtcacaggtcagcttccccacacttaccctggaggcaggatggaggccccctcctttgcaaggcccacacgggccatctaacaccccactaaagccgggcagttcgctgccctggggtgtgttctcgccttgccagttcttggctaaaaccaaggcaggaagagcccagttcccatgttctgtaacatgggtctatgaccagggcctttgcaggccccttgcagcgcccccatggagcccccaggagtctgggagaagatgatgaacccaagtgaggacctccccaggggcctttgctcctcacaagaacccctggaggagacagggcaaggagtaccactcccattttacaggtgacaatgccgaggctcagagaaagtccatgacacccccaaatcccccggacccactaccctgacctcctggcggtgcacagagcatgccacgcacctctccatatgcacatagaccctctaacctaagtcagcgccccttctacaaggccggtgtccagcacacctgggaaaggggacatttctggccctttcctctcagaagtcgcctgctcgagctgccctccctggggggaaggggatgggggcagaagctgagcatggaagcccctgctaatccaccctctgctctctccagaggcccaggaccagcccaactctgccccacatcccagcccccacctcccagctcgtgctgtttctccacctctcatgtggatgggccacacaccacccagcacccctgaggtctggtgagggactgagccttcgacacccatccttaagaacccagggctggtccttttgcttagagcatcaaccaggcccacactctcattttacaggcagagaaactgaggcacagagaacctggttactgcccacagcagaggagacacttgagtgaggacacagaggatctttggggtaggggcgggccttggggttgagacccagtcttcctggccagggaggaaacacaggactggaggtgaggaggcctctttgaggctagtttcttcatctgtaacttgggaataacaataggactggcctcagggggaccaggggaggattcagagaggctatgatgctgggacagctcttcgtgatgactggcatgaagcaggcttctagtagatgctctactgctgctttcgttctcaccctcacccacccgctctgggcccactgccctgacctcctgaccaagcactgagtgtgccaagggcatctccctgtctccccggccccgcaccttgtgtcacccttttccttagctcttaccaccaccttgaattctctattgaacgtgcatgtgtctccccagctaagatgacaacttcccgggggcagggatttgatttgttcaatgctactgtttacccagcacctacaacactgggtgctcagcacgtctgttgaatgaatgaatgaatgaatcactgctttcacctttgcccctgactttctccatggaccacggacaagtgacttgatctccctgagctgtgaaatggggccattcacaccagctttttagggtggaactaggattttatacagtgcctgccatctggcctggcacatagtagttgcttagcaaatatcccattgttttccttcctccccagagggccaaagccaagacctggaggagcaacagggtgggggtctaacccctgggtgacagagacagctcccatctgggatggaggctgcatggtgggaggagctgctgaggttgggccattcagctttggggcccttggagtcctgggtctgtgtggagggggaagggaagctctctgggccccaagagaagggaggcaggattgggggtggcaaggattgcagctcttctgggatagccttgggcacactgctttgtctccctgagcacctgcgaatgtcagtgagaagaccagacagtgggtctaacacgcacagttgcccctgggaggtagcaggtgctcggtaccgatgagctaccgctaactgcaggtgctacctgtcttagaggagggagcccaatctggaggaggggaaatgggagctgtggacccagatgggaggcggctcagagactgtgggtgggccctgatgagcttcttatccatagtcctctatccgcttgccgccatcctggccctggcatggcccaaagtctctgggagacgaggggaggtggctttgcctttttccatctctgttatctcatctgtgaaatgggcacaatcagacctgcctcaccaattggaatatagatttaggtgcagttttcttttttctttccttttatctattctctctctctctctctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgattttcaatttttcacttgaggcccccatattttggaagattgtagtttgctgaacacgctgactgaatcaagtactatccaacttatttcctcattttaacatgtcaaagatcccctgtggggtgagtggggtgtgaattggagcctccccaatccaaggcacaggaactggaagcttctgtagccctgcatttcctagagaatgcttgccatgttttggggacctcctggggggcccctgtactgaccagaggccggctcccagggctgtggtttgggcccagccccctgctcctggggactgctgctgtggagggagtgaccttttgttctgctttgccaaggggctttctgttcctcattgtttagccatgacaaggctgtggatttttttttttttttctgtccaagagaataaacaggcctgagattgctcaagggagccgaccccctctgccagctactgggggctggaggctcacagagccagggaggaagtcctaccccctctgccggctaccgggggggctggagccacacagagccagggaggaagtccagggacggtcactcacagcaaagcctcagacaagagaggaacctggaggggaggaggtgggaggccaccactcagccggcctgggggccatgggagtccagctgcctgccgttagtggccaggagccctcgtccattgcggctcttgagagcccaaacttggccacggcagggctctttcccatcaggccctttgagccctgatgggaaacccttccccagccagggtgggatttcttgctgccgcctggagccgccctggccctgtggttctcaggccctggaggagtgaggggctcccctggttaccccaagggcactcgtggggatgaagcccgcgggatgcaggattcccacgagacctgtgctggccactgtgcggggtggggggctgccagggaagaggtgcagcccctgcctgcctcagggatgcgatctgagggaagaggcagctgtgtctgggaggccgttcggtcggagggggataggcacagcccctgcccttggggaagcgcccagcagcagccttcagggaaggcagtttgggggtttgccgagggccaggaagaccctctgccgcagttagtattcgatggaatggcttgtgcagagggagctgcagaagctgccatttctctgggttaggggctcccacagcctttggatgccgggtctcggccatgagccccctccgccacccctcccccaggtcaccttgctcaatccaggaggccggatgatcagagtgtgttctgcaaaggagcgtgagaatcactggggagatttcctttttctttttctttctctttttttaatggtacagcttcctgggcccacccctgagattctgcacttgtttggggagtgggtgttggcttcatgacaggcacccctgggtgctttggacacaggcagtgagctccccccacactgtgtgaacccctgagaaggcttctccttttgtctagggtgcctgggagtctgctccagcagcaaaccggggaggggaggggtactgggaccgagtgtgtgtggcagcaccgtgtccaggcaaactgaggctccagacgggggttacttcttcagaccctgttatgcagcatggttcccactgcccgtgcccagaattcaccatagctgatgggcctggggtgggcctccggggcaggccagggtggaaagtgcatctgtgtttgagctttgcggccctggcgctggagttagatccctacaggaaaggacattgtaacccagcccgtggttgagactagcagctgctgagcacctacgccctgctaggctgtggggcaacagcaaagggtaacccccagcctgcagcctcaggggggcttcccatctagcgaggggcccagggaggccatgaggagagccatgagggaggaaggtggggactctgggcctgagtgactccttcagggtggggtgcgggcagggagccttcaggagggagggtactgcctgagcagggctcttaagggacacgtggaatttgttacaggaagcaccaggccattccaggcatagaaatcagctggggtgcaaaggcctgggggtcagaagagtggcagattgctccatggcaggaagccccagctcctctgggtcgttcccgctgagggattccagctgttggcaccgaggggtgcagccagggcagggtggtgctgcctgccaggctgaggtgggagacagctgggtttctagccctgcttgtcactcgctataggtgcagccaaacgctcagcaggcccaaactctgggcagtcctgactcccaggcagtgctgtgaggaaggggaggaggaggcacactgaacccacctgctacgttggctggtggaaatttggccaggtctgcactggcccagcggtgctgggtgtcgtgactggtgtctgctctgactggcttgctgacagctgaagtccaggataggtccatggccacgttgtgctggtttgttaaatatttttagtatctcccctgctcctatatgttaggtactggagtccagagaggttaaggcacttgcctaaggccacacagccgctaagtggtggagtgaggatttgaaaccagttctttctgactccctgtatccttatctatggagaggccccatgactcgttcactaaaggttatggatctcgatcttgtactggccacatgactgcagctggcagtacagtggggagtgcgccagccctggctctgacctcctagaactgccctttgttcatttccaggtgacgcatctgtgggggcccctgaaggacttggggtgtgtgtgtacaccctctttgcttgtacagatgtgttcacacccatgtttgcctacatgtgaatgtctccattctgagcttgctctcagcctggtagaggtggctaattaatgcttgtccctgaaagcccggactgccaaccccagtctttcaggagagagggcaggactcaggggcttgctcccgggggtcctgggaaggcacaatggtgacagtgctgcagctctgcactcctggagggtcactcagagacccgagagaggagggctctgcgtctgctcctctgtccagggctgtagcttctctgggtgcctttgcttttctcttttctcccctctttttttttttttttcgagatggagttttgctctgtcaattaggctggaagtgcagtggcatgatctcagctcactgcaacctcctcctcccaggttcaggggattctcctgcctcagcctccagagtagctgggattacaggcacacgccactatgccgggataattttgtatttttagtagagacagggttttgccttgttggccaggctggtctcgaactcttgacctcaagtgatccacctgcttcggcctcccaaagtgctgggattacaggtgtgagccaccacacctggccctctctctcttttcattcatcacattgttcatctcttcccggaggcatccagcacagtctttgagactgtgagctgtgaagtcagacaggacccaggtccaaacccttctctgtcacttaccaggtctgggaccttgggcaggtgacctgccctctcaggcctcggtttcctgttctataaaatggctgcagtagggaaaccgtctccatcttcattgggtggttgggaagtcttgctgagaccacacacctgtctcaggtagggtcttccagaagcagagcctgaggcagggatctttgtgaaagtgatttgctagggagggctcccaggagaagcaggcagggcaggtcaggggagggggcttagcagggacgttgttcaccagcttcagcccaacaccacgggggtggctctggaccatgaattgtaccagggtgggtcccaccttgaggctgtggagcattcattatcagccaacacccacagcagctgggggagcggtgccctgctggcagcaggggtctgagtggggtgcaacagcacccaccaattcgagcagcagaaacgcttagaacagtgcctggtacctaggcagtgcttcaaaaatggcaacgattgtcatggtcataaccaacattcagctgatgagtgccggctctacggtgggtcccatgtgagagattgagggtctagagatgacaaggctgccacctctgctgtctgcatcacatgagtgtgtgtgtacacatgtgtgtgcatacatacccacagggggtggaaggacaagcaagtaaccattccagaacaatgagatgactgttagaggggtcataacccacgtttagagagagccgagaggaggaggaggaggagcttgaattagccttgggtagtcagggagggcttcccagaggtggcagcactcatcttgaaagacaaagggatgtttcaggtgcaggagggaaggagaggtatcttccttcctcagcagagggcagctttgtgctgagaacccccgttctctgtgaccaaggccactgtcttctggatatctgtcccatgcagtgttaggggtcacccagcactggagaaggccagcagagtcagtgcttctgcctgcagacatgactagggtacactgaggtggggaggcaggggaggtaaaagaaggcacgagctctccttcctgtaccctgctccagggggagaaacctccccagccatcatcagtgcagactggcagggggagggccaaacatttgcagggcggggacctgggcatcaggcatggcagaacccaggggcggccctgttgatggcagtcttcccttcttccttccaggtggcatttacaccctacgccccggagcccgggagcacatgccggctcagagaatactatgaccagacagctcagatgtgctgcagcaaatgctcgccgggtgagggcagccacgggggcactcggggcccatgccctggaggagcgtgtgtgtacaggggctggggcgcaagagcatagcccttgattcttactgaactcctagttctatgcactggcccatgctccctgctgcttctgggcctgtgaacatgctgttccctcttcctggcacacttcccaactccctttccctgattaactccaacttgccctttagacctcagctgaagatgtcccctcttccaggaaggctgcctgccccatactgcccagccggtggaggagggggaggaggagcctaaattagctcctgggggagtcagggagggctgcctggaggaggcagcactcagcttgaaagacaagtgctgcctcctttgagctctcactggcctctgatgttcccatggaagctctttccttgctgtgggattatagcccggtcctgcttcctgttgcctccactgtgtgctcctctagggcagagattgtggcttgttttctgctgaatccccagcacgtggcgcaatgccatgtaggtgctcagtgcatatttgactgactctgtgaatgcttacccatttcacagatggtagacctgaggcccagccacagttggtggagctaggtagcctgactcctggtgccctccatctattcatttgtgtctgtattcattcatgtcatgattataaggtatctgctgtgtgttctaagtgctgggaatacacagagagcagggcagacaaaacccttgccctcgtggagtctgcattttaacggtggatgcagacagatacattaggagatgtgtggtcctgtctatctgtaagtgctgtagaaagacaaggtcaggtaaggcgggggagacagaacgggacatactgttttacacagggtggtctgggaaggtctctctgaggaggtgacatttgggcagagccctgcaggaggtgagggagcaggtcatgcatgtatacagggaacagtgtgccaggaggaagcaacagcatgtgcgaaggccttgaagtcggagcctgtttggtgagttggaggaacagcagggccagcatgtgtggcccaggatgagcgaaggcgagtacggtaggggaggaggaggaaggagtgagcagggaccatggtaaggagtttagattttattctgtctgggagccaatggagggctttgagccgttaccttgagatgtaggtgggcatatgagtacctgtcaccgtccctagccattttaagacatcctagggaaagtgactctcttctttcttttattaactggaagggtctctttaagaagttactagagaggctgaggtgggcggaccaccggaggccaggagtttgagaccagcctggccaacatggtggaacccgtctctactaagaatacaaaaaaatagctgggcataatggcaggcacctgtaatcccagctacttgggaggctgaggcaggagaattgcttgagcctgagaggcagaggttgcagtgagccgagattgtgccactgcactctagcctgggccacagagtgagattctgtctcaaaaaaaaaaaaaaaaaaaaaagcagctactgagtcaacttttttttaaggtttccgttggtgttctctgtccctggaatgcctgctttccaggcccatgcccttgtccttgataggataccagggactacattcttactacctgttccccctatcattcatgcccctagctggagaatattagccatctatcaagaaggaagaaactggcaagctagttcttactaaagtgtgattgactgataatagggctccagtggtggaggttcaagcatctggaaagagcagagaggaatctatttttgagcagaaggggttcagaaatgacgtgatagctggtacaatactagatgggagatgattctgaggaattggaactccacagaatagccttcccagctgggctttagaactctggactttgtggggacagtggatgagcccagggtcctggcagaaggctcgcccagctgagacctctggcccttgtttcctcaggccaacatgcaaaagtcttctgtaccaagacctcggacaccgtgtgtgactcctgtgaggacagcacatacacccagctctggaactgggttcccgagtgcttgagctgtggctcccgctgtagctctggtgagtaggttcagagaaaaagggggcccttacacccctgcctccaacttcccccggcaactccagcctctttggcttccagctgtctggagttaccccaggctggttgttggaagtggcacaggtgcagctgtttacccctaccactggcattttcctcctctgtctcaccaaagcctcttcacagccccacggggcaggcggtgggagaactgtgcccacgtgagggttgaggaggtggtgcgtgggagagtggtgcgcatgctcgtgctgcgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggtacggggtggggctcaggtccttggggacgcccatgggcctctcctttgtagacatccttgcagtgtcacgggcatcaacccattaattagtccagcagggagcactgttagtggtggccaggtgcctgctacccatccgtctgtccacctgtccaccgttcattcttcctgccagcactcccgattaggcacctcttatgtactggaaccaggagacccagagatggatcagaccaagccctaagctaggaaagttatgtgatgctgcaagatgaactcacataactctacagcccaatcccgtgcatgtgtgtacaggaatctgtgtgtgtgcatgtgtgtacaggcatctgtgtgtgtgtgtgtgtgtgtgtgtgtgtgtaaggggtggaggtgcagacagagctccttgggcccctcagacctctcctagggctctagtgccaaggcccagctgtcccgcagagtgtctgagtggttgacaagttcggattgttccctgaaggaactgaaacatcagacgtggtgtgcaagccctgtgccccggggacgttctccaacacgacttcatccacggatatttgcaggccccaccagatgtgagtagctgagtcctttggttctggaggagcagggaggggctgtccctgggtgactgtgggtccaggacacagagcagctcaccaaccaccattgtccagactgctttatctgagggtggctcccaggataaatggcatggtgggcaggaccttgccctggaaggcaggactgggtgggtgcatggggaggtgggggagggctaggagggggtggtcctcagagagggcacacatcgtcactctcctatcctgcctgctggggcccgtgaatgagcccagccaccccagccactctgtcccctgctgcctcctgaccaagcctcctcctcctccagctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggtaagtcgcaagaagtctcattcattcactccttctgtctgcctgtctttctgtctctctttcttcctctcccatggttttactgagagcccacggggggctggaccctgtgccctgtcctgggatacaggtggcagtgagactgctttctccccacacctggtgctatcattcaaaatccctaagtgcgtgggctggatgcagtggctcaagcctgtaatcccagtgctttgggaggccaaggaggctggaggattgcttgaggctaagagtttgaggtcagtctgggtaacacagcgagactccatctctataaaaaaattaaaaaattatttgggtgggatggtgcctattgtcccagctactcaggaggctgaggtgggaggatcacatgagcccaggaatttgaggctgcattgagctctgatcgtgccactgcactccagcctgggcaatgagtgaggtcctatctcaaaaacaaaacaaaaccaaacaaaacccctggataggggagaggtggggtcagcaattcacctgaatatgcagatggtctccttgctgctgtttctgatgagcccattaggctaagaagacagcgggctgggccaggtcacctccaggggcttccattctggggtagaactgcatcaggccagaggtctcaaactagtggcccttaggctgaatgaggcacacagacatgattgctttgtaattggatttgagaatctccggcctagactcgcccctcatttgcaatgacccgaagcaccttgggtccctggcttgcctggctggcccctggtacatttgagtttgttttctgtagctgtctgagcttctcttttctttctaggactgattgtgggtgtgacagccttgggtctactaataataggagtggtgaactgtgtcatcatgacccaggtgaaaagtaagagtccatccttccttccttcatccacttgttcaggaagcttttgtggggtgcctcctgtgagtccagcactgggcacagccttaggggtcagacagagctggatatgggggtccttgttctgtaggagcttaaggcctggggtgaaggtacctctgctaacttaattactaaaaggcaagaggtgatcagggttttctaaagggtaggaggagttcaggattcctatccaggaagcctgggggattcgggcttcctgcagcaggtggtctctgagctgggtaagatcttgatgggtggagtctgtgcagggaaggacacgcatcctcagtggaggcgcggatggtatagatgggggactggagaatggttgggatggtggcaggtggagttgggtgggggcttctgtggaccttgtctggtaggcgattggtccccacagggctgggcctctctgctggttctatggggccccatactgccctcctacttaggacagatgtgcctgaggaagtcaatctcttacttgtcccctctcctctttatagagaagcccttgtgcctgcagagagaagccaaggtggtgagtgtctccactgccctctccccctcttcccctggtctccttcccggcgtgctgggctgtcacagaggaagcagtgaattctgtcattggtctgtccagtgtcaggaggtgtgcagagccctgggaggtggaggaaaggccggggagtcaggcagccctccatgggctaagagaggctgtgagtgtgaaatgctccggcagagagcagatgccttcgtggcgttcgtggcaggcacgtggtcgtggacccacagcgcaaccttgggcagatgtgaaattgctctatggctacttccttaccatgagatgggggttgtgtctgctcgatccagcctgcagggtggtgccattcggtcagctgacaatgatgtttctccttgcctccattgtgtttacagagcactttctcagagagcagtggttttcaaactgaattctgggatagcccagtgtcccacagagggcccttgggcgtgggggaagtggtcatctctcaggtttgaggtagaggctgtggggctgggccctgggtcctcccaaagcaactcacctttgatctgttttataaagtagggcctgcgaaggctttttgttagagacagaccaacagtgtgtcatatcatagtatttcattcattctccatcaggaaggcatttggctgcaagtaaccccaaacctacaggtgactttagaaaaaatggctttatttttcttgcattgtaagaagtcaaggggttggtgtctgctggaatggcctccactatccccttgcatggtgccagcaggaccccaggctctgtcatctttagtgtgttgacttttgttctcttgtttgtggcctcatgtcataagatggtaatcatcacttcatatgtcacctctaagtttgaggtgggaagaaggggcaggtggccaggtcagccatggtgcccttatcagtaaatcggatgccttcccagaagccctgggtagacttctttcatctcactgaccagacagtgtcacatgaccacccctagctgcgagggaagctgggaaagagggtgttttgcttttccagcctctatggaggaggaggacaagggaggggggttggaagtgggtatggggtgagccagaacatacgtctgtcacagccttgcacctggtaggcagggcaggttttttacccaatttgacagatgagaaaacagagtctgatgagttttctcgacctcaggggcaggtagagaaagaacttctcaacctcatggatatttgagacaacatcttacttaagggaggccaaggtgggaggattgcttgagtctaggagttcaagaccagcctgggaaacacagtgagaccctatccctaaacaaaattaaataaaataaatatttttaaaaaggatcttggctgggcacggtggctcactcctgtaatcccagcactttggaaggccgaggtagatggatcacttgaggtcaggagttcaagactagtctggccatcatggtaaaaccccatctctactaaaaacagaaaaattagccaggcgtggtggcacgtgcctgtagtctcagctactcgggaggctgaggcaggagagtcgcttgaacccgggcagtggaggttgcaatgagctgagatcacaccactgctctccagcctgggcaatagagcaagactccatctcaaaagaaaaaataaaataaaataaataaataaaatatcttacttagttgtgggggctgtcccgtgctattcagcagcatctttggtctttatttacttacatgccagcctcattcccactccagtggtgacaatcaaaaattctccagacatcaccaagtgtcccctggagggcaaaatcacccctagtggagaaccactgctcgagggaacagctcagccctgggcagcccaatacccgaagcttacaccaggtgtttggaatcagatagattgatttcatcccctgattttggtgacaagaaaagagatgcagggaggaaaactgagttgctcaaggtcgcaccgcagtgtgtctctggactcccatctcagtgctctttgccctgccctacagtatttcagtggggaggaaattttctcattccccggcgagcgagtttcactgctccctttctccagcttcaattcagtgacactgacggttgccgcctggtggcgtgcgtagagcaggtgtctcccccaagctcttccgcagcagcccagctgtcaccttccctttccccaccaagcgtttcccaatcctctgtgcactgaagatgtcctgggtgtggcctagcagcctctgcttcccttttccattttttttttctttctttctttttttttttttgagacagctatgtcgcccaggctgcagtgcagtggcgccctcttggctcactgcagcctccgcctcccgggttcgagtggtcatcccacctcagcctcccaagtagatgggactatgggcatgcgccaccatgcctggctaatttttatatttttagtagagacggggttttgccatgttggccaggctggtctcaaacccctgacctcaagtgatctgcccacctcggtctcccaaagtactgggatgagaggcataagccaccacgcctggcccctttcctttcactgttgctctcagtgttcactgaatgtgagtgactcaagtatctgttgagtgccccagtggtgtgtctagtgcagaaaaaaacccccaaaccctgatttgtggtgtttgctaatttctgtggtataaacactcacactgtagccagtttccaactcccaagaccttcctgaatatggagttgggaggaaatctgcacaggcctgagcttatcccagcacagccctggctgagccctgccaggctctttgtgactgagtccccacgcatccctgtggggcagggagcatcatcacccccattttacagaggaggaaactgagactctgggaggttccatttttcctgtaggattagatcattaggtgagtggcatagcccaggtttgaatcaggtttatgcctgtgtcccacgctactcctcaaccagcagctactcctgataagaggccagtggagagtcctcttgagctgggctgctgggcttagagtgtggactcagcacccacctgctcctcctgccacagaaagaacgtccagggcatgggagacagtggcgttcctttgtttagaaaacaccaacatgtggccgggcgccatggctcacgcctgtaatcccagcactttgggaggccgaggggggcggatcacgaggtcaggagatcgagaccatcctggctaacacagtgaaaccccatctctactaaaaataaaaaaaattagccgggcgtggtggcgggcgcccgtagtcccagctactccggaggctgaggcagaatagcgtgaacccgggaggtggagcttgcagtgtactgagatcgcaccactgcactccagcctgggcgatagagcgagactccatctcaaaaaaaaaaaaaaaaaaaccaatatgtgagcttacccacaatcacccccatggacacggacacactcatgcacggacccacgtctgataacaggtgcgaacatttatcgggtgttgaacggatgccaggcactgtgcccagcgttctttattctcacagccatgctgccacacgcaggcagtatgattcttgtcccccattatatggcccaagaatcatgggcccagagaagttagtaactttcccagtgtggcacagctaatgatcacggcctgggacacgaacctaggagtgtctctcctcgccaccccagcgcacacactcactacgtcactcacagatatgcacacatgcccccaacatagacacacgtgtgcacgcttcacaccctcacgcctgtagacacaggtgtgtgagccttgtgaacacacaaacagacggacacagcaggaacctggaggacctggcccgtggctctgctgggtctctgcttctgcccagcagggctgggccaggaggggccgggagctgagggtgctggctggctggctggctggctggaattctgtttttttttttttttttttttttttttgagaaagagtcttgctttgtcgcccaggctggagtgcagtggcacaatcttggctcactgcaagctccgcctcccgggttcacaccattctcctgcctcagcctcccaagtagctgggactacaggcacccaccagctcgcccagctaattttttgtatttttagtagagacggggtttcaccttgttagccaggatggtctcaatctcctgacctcgtgattcggtgaccacctcggcctcccaaagtgctgggattacaggtgtgagccactgcgcccggccctgggatcctgtgttttgaatgaggctcctcagtactcggctctactggggtcccagcccaaggaataggactcagcctgcttctgtgccacctggggctgcttgaactttgcgacttgtggcttgggaggagggaggtggccgtgacctttgggggtttttgttctgcctggctgtagccaccagcagagggggtggggcacaggccagaaaaaccccttttgtggggttgtgaggagtgacaattggctgcttctcctccccttccaggctcagagcagggctggggggcagttgtgggcagtgaccagggtcagaccacctgggcggaggttcagcatgaacttgcaatgccctccatctctccaaaactgggggacccagcccagggagggtgtgggggttcctggggaagctggtctaggcttctgctcctgccacggaccagctgtgtgatgctgggcacaggatgcactttctctgggcctccgtggcctcttggggatggcttgcacgagatccctccagtcctgagtgagaggctgtggccttggggaattaagggtgcaggtggcgctcaggtgtccgagaagccatgggagccgggggctgcagggattggacagagaggaccctggtactcgcatctgttctcagaccacatctggaattgtagctccctctggagggaggcaggaggtctcagcctttcttggggggcggtggcacctgcgctgctcgctccacccctgctctcacctcccgctgcagtgctggcgagccccatcagcccttcactcatctctaccctccttctttctgcctgggacacttgttttcatcctgggcaggccaggggccagggcagctgttgggaatgtggcctgtgccatctccttttttgctgggatcagaaaacaatcgcttagaattccaaggcaagggtgtgagcgcctggccagccagtgggaacagacaacagcctgggagaggaatttccagcctctcttcagtgtgcgtgtctggaaatggggaccttgccttgagcctccagagttgaaaccccagacacccaggaaaggccctttgggatttagcccagccacagtatgtcctaaccgtgaccttgggcaagtaactcaatctctccgtgcctcagtttccacaaagcaaggataacactgggttgttggaagaatcaatatagatattgtctggagggatgtaggtacagtgcatggcattgggtggcactcaaatgtcagctaataatattattattattctacgggaagaagacatcaggggaagttgcagagcagcctgtgggcggactctggaacaagaggctgaggcagtgcagcagagggtctcagacgtgagcgctctctgccccggaatgattgactgagcgcaaaggtctgcacgctttctctgtaaagggccagatggtaggaatttcaggctttgtggactgtatggtctcagtgacagctactcaaacctgcctctgtagcaagaaagcagctacatgcatagacagcacacacccaactgagagtggtgtgttcctatctaattgtgctactggacacccaaacttgagcttcccaccattccatgtgccgcaaattattctttttttttgagatggagtttcactcttgttgcccagcctggagtgcagtggctcgatctcgcctcaccacaacctctgcctcccaggttcaagcgattctcctgcctcagcctcctgagtagctgggattacaggcatgagccaccacgccagctaattttgtatttttagtagagacggggttttgccatgttggtcaggctggtccccaactcccttcctcaggtgatccgcctgcctcagcctcccaaagtgttgggattacaggcatgagccaccaagcctggccacaaattattcttaaacatttttttttcaaccatttaaaacatgaaaaccagtggggtgtggtggtgcacgcctggtatcccagcactttgggaggccagggtaggaggatggcttgagcccaggagtacaagaccagcctgggtaacatagcacaaccctgtctctacaaacaatcgacaacaaaaaaattagccaggagcagtgacacgtgcctgtggtctcagctactcaggaggttgaggcaggaggatcacttgagcctggaaaatcgagggctatagtcagctatgattgtgccactccactcctgcctgagcaacagggtgagaccctgtctcaaaaaaaaaaaaaaaaaaaaaaagtgaaaaccattcttagtggcaggctgtactgggcctctgggcaatcatttgcctagttctgatttaacaaactcttgtatggagtttactatgtaataggcattgttttaagcactttacaaatattcagccatctaatcttcacaacaaccctatgaggtaggctattattctccctttatagagtaaaaaaaaaaaaaaaggcacagagaggttaagtaacttgtccaaggtcacacagcaagtgagtggtagagtcatgatttgcacttgtgtggcctgggtttagagtccacactcttggttgctaggctgggccatgtctccctgtgcagatggggtgaaggaaagctgctttccttctactcccttatgcaaaataaggatgaaaatcctgccccacctctaagactatttggtgaacagggccaggtattctctgccctcataggacactctagtagagcagctgggtgctaataacagaaacacagaaaccacggagaatcacacctcccaaaaagtgccgtgtgtggaaagaacgtgcaagggtgggcagaaacgtcacgtaaactgagaagtgctgatggcaggaggtgtggatggcagtgggaaggaagaggggaagaaagagctggctggtgggctgactgctctcccctaccaccccctgcccatccagcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcaggtaagaggtgggagcacacctggcttcttcccaagcctccttggtctttctcacctggtttctgtcttagccatctcctcctgagcctccccgcagggtgggacgaggcctgagccacagggaacttccttcggttcgctgaacctaagttccctcccgcctttgcccatgctgggcctatcacctcaaaatcctcccttctgtgggacaaccccagcttgtccaagtccctggtatctgggggaggagttttcctgaaaccttctccctgctaccacccccagctggcctggctgctcctccgggctcaccatgccctggcctccctttcacaggactgtcagactgcatgtacagacattgtcttctcctgtctcccacgccaggctgtgggacacctggtgagcctggatcatctcattcatccctgtatctgcaggcccaacacggcccagctactgataattaatcataacaatcgcttctacttatggaaggctacggaacagcaggcactgtactgggcactttacatgcataaaactgacctgcatgtcaatgctaagagatagttcctgttgttatcccattttacagatgaggaaactgagccccagagaggttaaacagcttcttcaagggcacatggctagtaaacagaagagccagactcacccctaggctgtcgggctccagagccctgggattggaagatgaatgaagaaatggtggctccagggctccactcactgcagtttgttgctgggtctctttaggtctgaggcactgggactgtggggattgtgtcccatttatgcaggctgcattgtgccctggacctggtctatgacagatgtcactcctggttggcatctctagggcccacactggaggggcccctgtacagggtctgctggcctgtgcctctctccctcttacctggcagtgccagccagtgagaattcagggaatgaccatgaacttgggtcagtctgagatccttgcctggccactctggtgccataagaatttgggtgggatgcttaaccctgccaagccttggttttttcacctagaggtgagctatagcgcctccttgccagggctggtgagagatgggtgacattgtgcccagctgggcaccagaccagggccaggctccctctgggccgcctccaggtggggactgatggctgcagcccccaccacgcagccctcctccagctcactcacccccagctgctccccagctcactgcgcccctgcctcttgcctgcactcatgccacccctgcctgccacacctgttcctacctgcccccaactgcccacaggagctgacgtggccatttctgtctgccccatcatagcccccagcctcctcggtgggaggtctcatcagtgcccctcactccatcctgagaactccctatgggagggcctgggccagtgcctggaagagatcaggggccctacacactgttgaatgaatgaatgaatgagtgcgctccaattataaactcttagtctttgcccagttcttggattcgtctgattttttttttttaaatggggtctcgctcgtcgcctaggctggagtgcagtggcgcagtcttggctgacttatctgctcaccgcagcctccgcctcccaggttcaagtgatcctcccacctcagcttcccgagtaggcgggattacaggcatgtgccatcacgcctggctaacttttgtacttttagtagagatggagtttcaccatgttggccagactggtctcgaaatcctgacctcaggtgatccatctgcctcggcctcccgaagggctgggattacaggcgtgagccaacatgcgcagcccatctttctgatttcttagctacacctggtgtggctccctccttgggccagggtggagccctgaccatgtctgccctcccctctcccctctgccccttctgctctgtgctccttctcccgagtcccccagcccgtgtccctggcctctgtcttctctttctctccctcccacccctaacacctccctccactgtgggaacctgtaaaccccagggttgtgccccttcatggtcccccatccacccccgcaatgtctcatgctcgatatgcaaaggccatggtgactttgggtgacatttgggtgctgtggaggctcagggtggaaatttccttccggccttgtgatttcaaccctcctcccccaccacatgcttggggctgttttgagcacagcaggttgccagctccatccacctcccggctaccctatccgagtagttggagttagggagaaccaggctggggtgagggcactcagcaggcccctgcagcaacagcagcagcaactctcattttctgagggggctacttactgtatgccagtcccttcatattcatctcagcaaacccaccgtccagtgcctccccaaccagttagaaaactcagttgcccacaggggctgggcaggaaggtgaggcaaaccttgggctgtccttggccggatctcctgcatctggctcccaagggaagccataaatccagatttttaaatgtaaacgcctgaattttaaatgttggtaatcaattcacttaaaaacatcaccaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctctactaaaaaaataaaaaaaaaagtccctaccctcctgggttcagagtctggttggggaccccaggagctgggggctctggagatcaggagatcacagaaatggggagggacccagagagtggtggataggatgggaagtaaatgtctctagagagggaggccagggggtggagggcgcttcgtggaggaggtggcctttgagctaaggcctgagcactagagaagagctctctaggctgagggagcggcctgtgcaaaggcccaggggacctgaagggctcaaggggctgtagcagggggtggggaatgtggctggaaggaaccccatcaaggtcttggagcggcaggagagggggtgggagaaggcaggctccagatcagacagggcctggtaggctgtagcaaggactgtgggtttttgagcccccaaggaagtgatctgccaggttcaagggccagctctggctgctgatgggaaacagatttcagaggggtggggttgaagccaggacagatggaggctgttcacacccatccagatgggagtgaggggaggcttccatagcccaccatgcagcagcagggcagggtgacccttgcagaagtcatcttttgtttttgtttgtttttgagatggagtttggctctttcgcccaggctggagtgaagtgacgtgatttcggctcactgcaacctccgtagcctgggttcaagctattctcctgcctcagcctcccgagtagctgggattataggcacctgccaccatacccggctaatttttttttttgtattttgagtagagacagagtttcaccatgttggccaggctggtctcaaactcctgacctcaggcgatccacctgccttggcctcccaaagtgctgggattacaggcgtgagccaccctgcctggtccagaagtcatcttttgaagggagacaaggcaggaatgatggatgggtgtgtgatatgagagaaagatgggtccgaggctctgggcccaagcagctgggtggatggcagcaatgggaactgtgatgagcaggagaggttttggatgcgagatgggagtagaatcaagagttaagttggaggctgagcacggtggctcacacctgtaatctcagcgctttgcgaggctgaggtaggcagattctttgaggtcaggtgttcgagaccaacccaggcaacctggcgaaaccctgtctctacaaaaaattagcagggtgcggtggcctgtagtcccagctattcaggaggctgatgtgggaggatcacttgaggccgggaggcagaggtcacagtgagttgagggagtgacacagcactcttttgagaccctgtctcaaaaaaaaaaaaaaaaaagacagaagagacagggtctcactatgttgcccagtctggtcttgaactcctgggctcaagcgatcctacaaacttggcctcccaagtagacatctgttttatataattggctcctcccatctctggggtgattggggctgggtaggtagtgatgctattcttattcggcagaggggaaaatgaggcacatgcaggttaagtgacttgctcaaggtcacacagcagagctgggctagaatcttggtctcggctcctggcccagtgctctttcccatgtgtctgaatctgcatcttgggcaggggtccctgggccccactcctggacccccggactgacccccaccccatcttgtgcttagcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctggctctgcctggggtctgggcttgggtttgtccatgctcctacttgtctgccacccctgtgtaaggggagatggcgtcacggtccctggagtctggctggcccctgttgtgactggaccacagagggacccctgttacagccgccccctcaagcctgtgaaccataagagaacttcctgctcgggaccacacagctggctgggttccaagtgtgccctggtctcatgccttcatcctccaggtctcctgggcctgctctcaggaccgggatggggtctctgcagatccctagcagcctaggcagccaggctctgccctcctggggaccccactcggggagagtggttgcccctgggatactcagaccagtacagggttttgggggcccagaggacatccctgggcccaggtaggaggttagaacagggttctggagatgacctctgacctcctcctgagggatgagcagcagttttccagaacaaaggattgcagggaactgtcaggcaaaaggagttctgagtttaaaggccttagcctggccagcatggtgaaaccccatctctaccaaaaatacaaaaaattagctgggcatgacggtatgcacctataatcccagctagtcaggaggccgaggcacgagaattgcttgaatcgaggcaacagaggttgcagtgagctgagatcgggccactgcactccagcctgggtgacagagtaagagtctgtctccaaataaaataaataaataaaatcaattaattagaagaaagccttggaggggagagagaccttggcctgtgtattggttccactgaccccctgggtcaccatcgtcactccagctcctgtgactccctcagtgggaccattttcattcttggtgattataggatctgtgattgatggaacgccccgcctcctggcttctcgccctcctctcctccatggtcctgtcctccagcctgtctcagtcactcaacccttgaccaaggctccccacacttattccataaagagccagggagcaaatttattttaattttttgagacaaggtctcactctgttacccaagctgaaatgtgatcgtggctcactgcagccctgacctccagtcgcagcctcttgagcagctaggactacaggcatggaccactatgccgagctaaattttaaatttttttatttttattttttgggtttccctgtgttgcccaggctggtctcgaactcctgggctcaagtgatccaccggcctgggcctcctgaactgctgggattacaggtgtgagccattgcgcctgaccagaatcaatattttacacttggcaggccttacagtttctgcaacaaccactcacctgtgctgttgaagtgtgaaaacagctgtgcacaggacatgaaagaatgggcaggaggcggatgtggccttcggggtgtgcccatgccagtgccttagagcctggcattactgataactgcacgctaatctcaatttcaagcatcccacttccccccacccctacttcctcctgtctttctccctcagtggcacctgcagctgttggttacgttttctcccttgtacgcacccacggcactttctcctggtttgttgttctctctctggttgaacccagctctctgcctgtgccacacctgcacgtctgcacctggctggggcaggatgatggccttccaccatgctggctggtcgcgttttcatttcatgatcattagacttggctgggcacagtggcttatgcctgtaatcccagcactttgggaggctgaggtgggcagactgcttgagctcaggagttcaagaccagcctggggcaacatggtgaaacctcatctccacagaaaaatacagaaactagctgggtgcggtggcacgtacctggaatcccagctacccatgaggttgaagtgggaggattgcttgagcccaggaggcggaggttgttgtgagctgagatctt

SEQ ID NO: 11891 - DNA, 15511 bp, Human
gcgccactgcactccagcctgggggacagagcaagactccgtctcaaaaagaaaaaaaaagaaagaaagaaaaactaaaagggccaagcgcagtggctcatacttgtaatcctagcattttggaaggccgaggcaggaggatcacatgagctcaggagttcaagaccagcctgggcaacatagtgagacacccatctcaacaaaaaatataaaaactagcccagcatggtggcctgcacccacctgtagttccacctactcaggtggctgaggtggaagaatcacttgagcatgggaggttgaggctgcagtgagttatatagaaccactgcattccagcctgggtgacagagcaagactctgtctaaaaaaaaaaagtctttgctggctctccagtgtttccctacagagttcaaactcctgggcagtgtgtataatgcctttcaaaatgtaacctttccccagccttcgatcctttcttattactctgtaagatccaaactgtgaacttggcttcctaagcgacttgctttttcttgcttcactgcctttgcacgtgaggttcccactgagagaaaccctaactagactttcaagactcaattcaagctttttcatttttccttcaagctttcacagtcccctgcctcccagaacctgggctagatgccacgtctccctgttcccaggcgctgtgcttccctctgccatagcacaaatcacaaatcacagtaaaatacagtgttaggtctgcgtttctgccccccttccagaaaaagccaatgcttggataagaggggtctttctcctcttcatccccagcgcccggcttggagcaggcaccaataaaacgtgaatgaagggtcaacgccaggacccgagggctgaggaagggatttacgaggaatagctggggccgggcgcggcagctcacgcctgtaatcccagcactttggaaggcccacgcaggaggatcgctttgaggccaagagttggagaccaacctgggcaacatagcgagagcccgtcaccacataacaaattaaaaattaaccaggcgtggggcctcatgcttgcagttccagccactccggaggctgaggtgggaggatggtttgatcccaggaaatcgaggctgcagtgagctatgactatgccactgcactccagcctaggcgaaagagcgagaccaaaaaagaggaatgactaggtaagaaaattctaggactgacttgggaaggggaagggggcgaaccgcgggggctcacatacccgaagttttcttctccaccattggcacaacacaactgtcggaagaaactgctgcgcacgcgtactaaccccaaggctttagtaggggcgccatcacttccggtagcttgtacttctgcgcgtgcgccacagctttgactcattacgtggcgtttccttggagacaagaaagcttttcgccatgttttataggggcaaaaccacttccggcctcagtgtggaggtgtaaatcttgtgggagccacgaaatgggtcattttaaagatgtggtcacggtgttcttacaagaaatcttattttcctttggtccttgtgaagatgctgtgatcacaaaggcagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccaggtgagatcccggggaggcccggcacggccgagggggcagaggctggcgtgcctgccagcctggcccggagagggtcggaggctcgaggaggtgtctggcccgtcccccgcccagcgtgctcttgaggctgagtcgcgccaagcccctcgcccatcactaccctgaactggggtttccagcctccctatgcaaagggactcggaattcctgggcaccactcccaccctgccctccttggggtcagagtgttcctgggtgagaagagtttaagaatgggaaggaagaaagggagggaagtcgagtgagagggaggacagcaaagcacgtgaggcccggagctgggcggtggatctcaagtgccatttccctctggtaacagagaagctgctggtgatcactgtggccacagctgaaaccgaggggtacctgcgtttcctgcgctctgcggagttcttcaactacactgtgcgggtgaggagagggaaaggcccctgggagggggtcccagcaggaggggtgggctgaagtctggatgcccaggtccccacggtaagcctggtcaggagttccccccacaactccccaccccttgcctggcacggggcaatcttctccacagaccctgggcctgggagaggagtggcgagggggtgatgtggctcgaacagttggtggaggacagaaggtccggtggttaaagaaggaaatggagaaatacgctgaccgggaggatatgatcatcatgtttgtggataggtaacggggctggggatagggagcggggtaaggatgctgaggttcccagtggacccctgcccatcctccccttcctcacccagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggtgagtggcagagtgcccaaggcagaggggccaagagcggtgggacacagagtgttaaaggcgcctgagggctggagacagcctgggggacaggccctgggaccctgggagtctcgaggtcaacactccccctccccgccaggattcatcggttttgccaccaccatccaccaaatcgtgcgccagtggaagtacaaggatgatgacgacgaccagctgttctacacacggctctacctggacccaggactgagggtagggaaggcagaggagtgggcgcatcccgcagctctgtgggagtggaggcctcaggctgaatgggatttggggagcaaagggggttgcaaagagaaaaatgtgtgcctgggcgtggtggctcacgcctgtcatccaagacttttgggaggcttaggcaggaggattgcttgagtccaggaatttaagaccagcctggacaacatagttgagacctcatctctacaaaaaaaaagaaagaaaaaattagccaggcttcatggtgtacgcctgtaatcccagctacttgggaggctgaggtgggaccatcacttgagcccaggagtttgaggatgttttgcaccactgcattccagcctgggtgacagaatgagactctgtctctcacaaaaaaaggaaaaccatggtggctcatgcctataatcccagcactttgggaggctgaggcgggtggatcacctgagattgggagtttgagaccagcctggccaacatggtgaaaccccgtctctactaaaaatacaaaaattagccaggcgtggtgacactctcctgtagtcccagttacttggaaggctgaagcaagagaatcaattaaaccgggaggcagaggttgcagtgagctgagatcgtgccattgcactccagcctaagcaacaaaagcaagagaagaaaaaaagagagagaaaagtgagaaatgatgtcctttccactccttccattttaaccactccatcgcatctcattccatttaggagaaactcagccttaatctggatcataagtctcggatctttcagaacctcaacggggctttaggtgaggaggaagacagccgcaggtgggcgatgcgcagcctctgcagctaggggtcttgagctgggagaggcttctggaggagctgggctgatccaagcccacctctatgtggttttgtcaggcgtctgagtggctggttgtgtaagttgcactgtgctgatggtactaccagaagcaagggaagcaaaaacgtgtctggcatctgttgcacacatgctgtgcctgggcaccgggccagggacttttttttttgagacagagtttcgctctgttgcccgggccggagtgcagtggtccaatcttggctcactgcagcctccacctcccgggttcaagtgattcttctgcctcagcctcccgagtagctgggattacaggcatgcgccaccacgcccagctcattttgtatttttagtagagacagggtttcaccatggtggccaggctagtctcgaactcccaacctcaggtgatccgcctgcctcaacctcccaaagtgctgggattacaggcatgagccactgtgcccggtctacttctgtgattccatttaacaaagggaaggtccctggttatccttcttgtacagatgaggaaaacagcttgtggaggggttggtgacttgcctcaggggatggggagaacggggagagagagaggccaggcacggtgcctcacgcctgtaatcccaacattttgggaggcccaggcaggaggatcacttgaggtcaggagtttgagaccagcctggccaacatggcgaaaacccgtctctactaaaaaaaagtacaaaaatgagctgggcgtggtggcgggtgcctgtaatcccagctattcagaaggctgaggcaggagaatcactggaacccgggaggcagagcttgcagtgagccgagattgcgccactgcactcctgcctgggtgacagagtgagattccttctcaaaaaaaaaaaaggccaggtgcgacagctcacatctgtaatcccagcactttggaaggctgaggcgggcagatcatgaagtcagaagtttgagaccagcctggctgacatagtgaaacccagtctctactaaatatacaaaaattaggctgggtgtggtggctcatgcttgtaatcctagcactttgggaggccgaggcaggtggatcacctgaggtcaggagttcaaggccagcctggtcgacatggtgaaaccctgtctctactaaaaacacaaaaattagccgggcatggtggtgcgcgcctgtaatcctggctacccgggaggctgaggaaggagaatcgcttgaaccctggaggtggaagttgcaatgagccaagatcgtgccactgcactccagcctgcgtgttgggagtgagactccatctcagcataaaaaacaaaaaatacaaatacaaaaattagccaggtgtagtggcatgtgcccatagtctcagctacctgaaaggctgaggcaagagaatcttttgaactcaggaggcagaggttgcagtgagccgagaccacgccattgcactccagcctgggtgacagagtgagactccatctcaaaaaataaaaataaaaaaaaaaaaaaacaaggagagagagaatatgaggaggggtagggatgctgaggctcctactggcctcccgctcagctcaccctccccttcctcgcccagctgcggtgtgatcacgcaggtagtaggcagtggagctctctgggccagcagcctggtcagaacccaaaggttcctgcccacaacgagccacactccaggatagccctggtgtccctttattccctggagaatttgggaccccatatttagaagaatgtgttgcttggtagctcccagagaaagggggtctgaagcctggcctttttcttccccagatgaagtggttttaaagtttgatcggaaccgtgtgcgtatccggaacgtggcctacgacacgctccccattgtggtccatggaaacggtcccactaaggtgccaccagtggtctcaacccccgccccgccctgccccaacccccaggcacctccaacccttctgagaagctggcccttcccagcccccatatcagaggtgcctgacccccacctccacccctggaggcctcagccactcagcctcagtctgtccccaacagctgcagctcaactacctgggaaactacgtccccaatggctggactcctgagggaggctgtggcttctgcaaccaggaccggaggacactcccgggggggcaggtgaggtgggggtgccagggaggggcacgagagggcagcgtgctgagcaggaggtacaaggacagcggactggggggcggtgggggcatcgctcctgggtccctgcacctgtcagggtggaggttgggtgggggcagcagggaagtccgggcttctctctgagtccctgcgtgttgcatcttccagcctcccccccgggtgtttctggccgtgtttgtggaacagcctactccgtttctgccccgcttcctgcagcggctgctactcctggactatccccccgacagggtcacccttttcctgcacaacaacgtgagactcccctgttggagcctctcctgagggaccctttccctgccctgatcagaactctcgtgcccccacccccatctccttcctgcacccccatccctcaggtgccgcctccctgccctctgagcccatccccctatgtcttcccctcccaggaggtcttccatgaaccccacatcgctgactcctggccgcagctccaggaccacttctcagctgtgaagctcgtggggccggaggaggctctgagcccaggcgaggccagggacatggccatgtgagcgggtgcttgcggggaggagagggtgggatgaggctgtagggtcaggggtgctgccacctgctgcctggcccttgcctcacctgtcacccatccagcccctcctgggcctccccattcgcatccttgcagcccccatgctgtcactcctgcccttgccagctcacccagacagcagagagcctggggaaggaaggatagacactgcctccctcctcttctcctgggggcatgggccagttaccccatccacaccgcctccccacctgccgccgtctcagctcgcctctcacctccagggacctgtgtcggcaggaccccgagtgtgagttctacttcagcctggacgccgacgctgtcctcaccaacctgcagaccctgcgtatcctcattgaggagaacaggtggcttaccccctctccccgcagccggagggcaccccaacaggccccgggaaccccactcctgccctgggcaccgggctccccaggcctgctcccgtctgcccagccctcacccccacctgtccgcaggaaggtgatcgcccccatgctgtcccgccacggcaagctgtggtccaacttctggggcgccctgagccccgatgagtactacgcccgctccgaggactacgtggagctggtgcagcggaagcgagtgtgagtcccgccagcctgcagccccccgcctcctccgacccggggcccaggtagacccaagccccctactctcaggggtttggagtggtcaccagtcagaggtgccatgaggctggctgcagtggctcacacttttgatgccaccactttgggaggctgaggtaggaggactgcttgagcctgggagtttaagatcagcctgagcaacgtagcaagagcctatctctacaaaaaacttaaaatattagctgggcacggtggtgcgtgcctgtggtcccagctactacggaggctgaggtgggagaatcacttgaacttgggaggttgaggctgcagtgagccatgtttccaccactgcactccagcctggaaacagagggagaccctttctcaagaaaataaaaaacaagggccggccgcggtggctgacgcctgtaatcccagcactttggaaggcagaggcaggtggattactcgaggtcaggagttcgagaccagcctggccaacatggtgaaaccccatctctaccaaaaatacaaaaatcagccgggcatggtggctggcacctctaatcccagctatttgggaggctaaggtgggagaattgcttgaacctgggaggtggaggttgcagtgagccaagatcacaccactgcattccagcctgggtgacagagcaagactccgtctcaaaaaccaaaaacaagaaacaaaaaagaagtgccacagcttggggtaggaactgaccgcattttgggaggtggggtggttgggaccagcagtgcttgacaagggacatgcaggggccttatgttcagggactgggataccctgagggaagaaggacttcccgggatgagctgggcagaatttggggggctgtcctcccagctgaccgcggtgtcggtgcctccaggggtgtgtggaatgtaccatacatctcccaggcctatgtgatccggggtgataccctgcggatggagctgccccagagggatgtgttctcgggcagtgacacagacccggacatggccttctgtaagagctttcgagacaaggtgagcgcgggtgcacggtctggcctgggggcagtcccccagactccaggcatcgcctgcatcacggacacccccaccccactacagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtatattgggtatactggtgttatgcttgaaatcacatcttaaaagaagaatggggctgggctcagtggctcatgcctgtaatcccagcactttgggaggccaaggtgggtggatcggttgaggccagaagtccaagaccagcctgggcaacatagcgagaatctgtctctacaacaacaacaaaaaaattaaataagaaatgaggccaggagtggtgctcatgcttgtaatcccagtacattgagaggccgaggcaggcagatcacctgaggtcaggagttcgagaccagcctggccaacatggcaaatcctgtctctaccaaaaaaaaaaaaaaaaaaaacacaaaaattagtcaggtgtgatggcgtgcacctgtagtcccagctactcgggaggctgaggtgggagaatcgcttgaacctgggaggcagaggttgcagtgagccaagatcacgccactgcactccaccttgggtgacacagcgagaccctgtctcaaaaaaaaaagaaaagaaaaaattagcttggcatggtggcatgtgcctgtagttccagctacttgggagtctgaggcgggaggatcgcttgagcccagaaggtcgaggctgtagtgagctatgattgtgccactgcactccagcctggttgacagagcaataccctatctcaaaaaaaaaaaaaagaggtatgcactgttacggaagtttggaaaccactgtcccagcacgaggggctccaggaccctctgccacctctcctgtgccagaaaccggtcctcagccttgccactccctcagcccctacctggcgggtccccggctgctctcacaaagccttccctgctcctccctgccccttcccattctgcctgctgcctgtccccttccccgttctgcggcgtcagctagccctgttctccctcgccccatcctcagccatgcccggacgtgtactggttcccactgctgtcagaacaaatgtgtgatgagctggtggcagagatggagcactacggccagtggtcaggcggccggcatgaggtaagggcctgggcgaggagggcagaggccttcccagaggaggaggtgcaggatctggtaaacaaacaatggaatcaggaaaatgggagcaaagaggggttcccaggggggaggcagaccctggggtcacaactgcattcattcatgtattcaagaaatatttactgctgggcacagtggctcatgcctgtaatcctagcactttgggaggctgaggcgggaggattgctcgagcagggggagtttgaggccagcctgggcaacatagcgagaccctgtctctacaaaaaatttaaaaattagccgagtttgggccaggtgcggtggctcacgcctgtaatcccagcactttgggaggccgaggcaggtggatcacctggggtcaggagttcgagaccagcctgaccaacatggagaaaccccatctctactaaaaacacaaaattagccgggcatggtggcgggcgcctgtagtcccagctactcgggagctgaggtagaattgcttgaacccgggaggcagaggttgcagtgagccaagattgaactccaggctgggcaacaagagtgaaactccatctcagaaaaaccaacaaattagccgggcatggtggcatgtcccagctattcaggaggctgaggcagaaggatcacttgagccccagagttagaggctgcagtgagctatgatcatgccgcagtactccagcctgggtgacagagcaagactctgtctctaaaaaaagagaaaaggaaatcattcctgggccactgtcctagactgcactgcaggaatgcctcatgccggtcgagctctgccctgctgtgagcagcagccaccacacagcttctaaggctgcgatgagcagcctgggtgcaatagaagccacggggaagccttgacccagacttgggaggagtagggagcttcacaggacaggtgacatcttagctgagacttgaagggccgggagcagtgagtcaggccgagaagtagcaaagaagactgttctgcacagaggaacacaggtgtgaaggctggaggacgggaggaaggaggctggactgccctggggtggggagcgccatggctggaggggcgggtggctcagtgcccgccgcccccaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggtgcgctgcccacctgccagctgcctccccaccttccccaccccagtcccggacaggaagtctccacgcagacccctttcggccccggcagcatttgggctccatgcattttagttcccaggggaatgagacgctgcaggaggcaccccaggggagggagggcgccaggctgagacccaaggtgaggcttggccctaatttaatgccagtgagcagcgagagcctcctacgcaggggtcccgccgcccctcccctcccctccctggacagggaccgtcatctccctgaagacaccctgcgatggccgggcgtggtggctcacacatgtaatcccagcactttgcgaggctgaggtgggtggatcacctgaggtcaggagttcaagaccagcctggccaagatggtgaaacctcgtctctactaaaaatacaaaaattagccgggtgtggtggcaggtgcctataatcccagctactcgggaggctgaggcatgagaattgcttgaaaccgggaggcagaggttgcagtgagccaagatcgagccaagatcgcaccactgcactccagcctgagtgacagagcgagactatctcaaaagaataataataatacaaaataaaagaccccctgcgcccgcagctgtccctgcagcctcttccctcctctcccccaggcgcgggcggtgatgaactttgtggttcgctaccggccagacgagcagccgtctctgcggccacaccacgactcatccaccttcaccctcaacgttgccctcaaccacaagggcctggactatgaggtgcgccccagtcacactacccacccacgcttcacctcaggaccctcgggtccccacctagagcccctgcgtgcatcccccagctcccctccctgcccatttcccagtgactttgtgggtatcagctcctggatcgcttctgggcaggcggcctctgcttcctcctggatcttcctgtctgcaggcaccccagcctccggtgtctgccatatctgccatctcccttgtcaccccggtctgctgcaccgtgccccccggtctggccgccctgccccgtgtatctgcctgctccccaggccccacgtctgctcactccatgtttcctttcccttctctttccagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttgagtccattggtctgcccattaaccccatctcccctcctgccagcagcgtagaggggagagacccagaaaagcgaagacaagaggaaaagggagaggcagaatgttagaccctcgtgggaacctgggagcttccctggctcccactttccccttcccctgtattgcctgagctggagacagtgtgtgagaggggccgggcgcggtggctcacgcctgtaatcccaacactttgggaggccaaggggggcggatcacgaggtcaggagatccagaccatcctggctaacatggtgaaaccccgtctctactaaaaatacaaaaaattatccaggcgtggtggcgggcatctgtagtcccagctaatcaggaggctgaggcaggagaatgacatgaacccgggaggcagagcttgcagtgagctgagattgtgccccggcactccagcctgggccacagagtgagactccatctcaaaaaaaaaaaaagtgcatgagagggcacagaccaaaagagggacttcccaggctgggcacagtggctcacacctataatcccagtactttcagaggccaaggcaggcggaggatcactggaggccaggagttcaagaccagcctggacaacatagcgagaccccccccatctctacaaaaaataaattagctgggcgcgatggctcacgcctgtaattccagcactttgggaggctgaggtggatggatcacctgaagttgggagtttgagaccaccctggccaacatggtgaaaccctgtctctacttaaaaaatacataattaagctgggcacggtggcccatgcctgtaatcccagcactttgggaggctgaggcggacagatcacgaggtgaggagttcaagaccagccaggccaaaatggtgaaaccgcatctctactaaaaaatacaaaaattagctgggcatggtggcgggcgcctgtaatcccggctacttgggaggctgaggcaggataattgcttgaacctgggagggggaggttgcagtgagctgagatcgcgccatcacactccagcctgggcagcaagaatgaaactccaactcaaaaaaataaataagccgggctcagtggctcacgcctgtaatcctagcactttgggaggccgaggcaggcaggcagatcacttgaggtcaggagtttgagaccagcctggccaacatggtgaaaccctgtctctactaaaaatacaaaaattagccaggtgtggtggcacaggcctgtaatcccagctactcaggaggctgaggcaggagaattgcttgaacctaggagacggaggctgcagtgagccaagatcgtgccacggtactccagcctgggtgacagagcaagacttcgtctcaaaacaaaaaaacaaaacaaaaaaagctttccacgctacccacagagggctccatccggcgttgttctggattcctgttgtaacttaaagagaaactttcacaacatccggagcccttgatgtcctgcaaatgaaggaggaagatgtccttaatttccttgcagcaggaaaccaattaggtggcaccaaccttgacttacagatggaacagtacatgtataaaaggaaaagtgatggcatctacatcccaaatctgaagaggacctgggagaagcttctgctggcagctcgtggcattgttgccattgaaaaccccgctgatgtcagtgtcataccctccagaaatactggccagagggccgtgctgaagtttgctgctgccactggagccactccaatcgctggccgcttcactcctggaaccttcactaaccagatccaggcagccttccgggagccacggcttcttgtgtttactgaccccagggctgatcagcagcctctcacagaagcatcttatgttaacctacctaccttgctctgtgtctcacagattctcctctgcgccatgtggacattgccatcccaagcaacaacaagggagctcactcagtgggtct

SEQ ID NO: 11892 - DNA, 56302 bp, Human
  misc_feature (1)...(56302): n = A,T,C or G
ttacaggcacctgccaccacgcccagctaattttttgtatttttagtagaaacagggtttcacctgttggccaggctggtctggaacgcttgacctcgaactcaggtgatctacccacctaggcctcccaaattgctgggattacaggcatgtgaatcaccacgcccagtctttttattttttgtagagatttgatggtggtggtgggggctcttaccatgttacccaggctgtacttgaacttctgggctctagcaatctgcctgacttggccttccaaaattctgggattacaggcatgagacagcatgccttgcctggagtgtatctttttttttttttttttttttttgagatagaatccttctctgtcacccaggttggagtgcagtggtgcaatctcacctcactgcaacctccacctcccgggtttaagcgattctcatgcctcaacctcaagagtagctgggatttataggcgtgtgccaccatgcctggctaatttttgtattttttgtagagatggggttttgccttgttggtcttgaactcctgacctcaagtgatcccccaccttggccttccaaagtgctgggattacaggtgtgagccaccaagactggccacccccattttaggacaagagaagagaggtgataaggaactgctatttcaaaaagatgaatgggagggaagggaccagaaagtgacatcatcagggaacacttgattcaggcatgggtagcaagttcagttaccttactcctggcagcaacaggattgggggagggggtcttggagaagattttgtctgcaaatgtcgcaacactgttgcagtgtgagtatgacccaaagtgcttggcagggggacaggcctgctgcttccctgcattctgggctgacctcttcacctgagtcggtcagtggacgcttttggcctccttcctggagctagacagctgttaggcttagggagcagctccggacctacagggttggggtgcaggtagggagggaggctgcagcatgtcagagtggtaaatacatgtcctgatttccaggactgatttcacatattctgccccacaagttcaccagcacctgtcagattggatgtcccagtttttggtttggaaaattcgatctgtctcaggtaatggagaagggggagacagcagttcattcattccagtgtctaagcctgtggttggtgggaacaagagactgtctgggatggctccagcccttcgctggaatctcgcattgaattcctagctccgccctgatccgtgctgaggcgagcaggtgagtgggacggacagcgctgtgcctgcaccctcctagccccacttgcttaccgcggcccctgccttatcccacactgggaagtatgctctgttagcctcggctcagccttgcctcatcggcccagtggggagagtccagggaggagagaggctccacgtgctaaaggaaagcggcctgccagacactgctgcttaaggagactgtctaagcaatcggattcggtgcggccgagatgcagacgtccgtttctcccaagggaaggagcaagggtactccaggtcccaaagctgcgttacagccagttgggctaatcccacccgcccctcccccaactccccgagtggcaatctgtccagcccctcaagcgatcaggccacaacccccagcaccgcgcgttctcctcccagcctagcccggcccatctccccacccggggccccgccccggccccgcaggctcccaagaggcggtggacgggccagcgggactacaagtcccagcaggccccggggcccgccctcgtggggcggagccaagccagcagcgaattgggaggagccctggcgctcaggctagggaacgcgtgtggccaatcgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtgagcacgggaggctgttttcgctggctggagcccgctcgccctaggagcttcctgcctccgtcccccaacccggaaccgccttccccgacgcgggctcggtgcccacgcgccctgctcggaagttttgagggtcttagctttaggttagccttcgcccggggtcccggccggtggccgcgtgttgacgcccctcccctccccccgcgcgacacacacatattccagttcctgggagtttgcatggggcttgccgccatccttgcctcttctgcctctgccacattgcatggtccccctcctggcgcgcctcacccctcccgggcacagctatcgaggctcctcgggctcatcgggacgccttttggctccatccgggttcccccatcggatgccgggacgggaagtagagaaagcggtggcgactggtcccactccgattcctcactggccgggctcaggcccttcttggttccgtgggtacaaaattgagctccacgcccaagtggagagaatgagctatgcgcgcctccggggcgggccacgcggggccaggctgccccagggtgcccgaggcctcgcctcgtctcgccgcgaggactggaatctcgcagcaaggaccctcctcgcactggaggtatcgtcgagtccagcccctaagcgacagatggccggggtgccaccccacccttgagctgacgccaagtctggccggggaaaggtcctcaaggggctggaggatgctgccgccgccctcctgtcgagcctggcaatgggccagtcccagcgcctgccgcggtctccaaccttggcagataccgtgcagtgccgagttctgccgttatggggtccctggaggtcttcctgggaagaggattttggaagagatgataaggaaaagtgcacagcacagtttggccagctagcctactcctctccacccttaactttcctctgtgttttcagctggctcagctgaactaaaatgtggggtgagggacagctggtaggtctcatttgcccagatgggtgattttcacctcttagaaaccttcctaaacagcttggggggcggtagtgggaagacccctcagacactggacagcttatggctccatccccgttctgacactatgcctgccgcagtaaggggcactcacagaattctgcctctctagaatttactccagggattgcctgtcttctcaaaaaataaataaataaatacctacatacgtaagtcccaatcctgcagatactaaccttcaaatgagtgtttttgtctttcccagaggcacccttagtagcatccccagtgattcccttcccctggctgtgtcccaggggcgtgttctggggaacaggcttctttcattcagcctcctgtgtgggctgcttctctcagtgtctgctaaaagtgaactcaatcctgggtcactcacccgtctgcagaaagactccattcagctcataaggcccctcccttagagaatgtgtgtatgtgtgtgttttcaggttccttggcatgatttcccccaaatggtttacacatttagctgttaccaagtaacagttcctggagtccaagctcagcccaatcatctgttacttgtttgacagcacattcagctactggggaggcagactaagacgttctggggagcggtcccaaacccagataggtatttgtaggtatttgctgattccactagagcaaatattcttttttttttttttttttttttgagacagagtcttgctctgtcggcaggctggagtgcagtggtggatctcggttcactgcaacctccgcctcctgggttctagcgattctcctgcctcagcctccccagtagctacaggtgtgcaccaccacgcccggctaatttttgtatttttagtagaaacagggtttcaccatattggccaggctggtctcaaactcctgacctcgtgatttgccctccttggcctcccgaagtgctgggattacaggcgcaagccaccgtgcctggccgcaaatgttcttaactggtggtcagtctgtgggccatcggatcattgtcacaggtgagcaccttgaaacaatatgcacaattggatttgtgtacctttttctggggtttttttcagtctcagaagagtctgaggcctcaaagaggttaagagccactgcctagagagactttaagacctcactgaaggccgggnnnnnnnnnnnnnnnnnnnnatggttttagcccaaactccctttttcttctgatatttcctgggtatttccccctcatctcccttcccatccccttaatccttgttaatttatcaccctgtttgaaatggtctctattgggataggggtacaggggggtccctgaagtggcattgtcatctgaaatccagtagggatgtccaaccttcccaaaggttggtttgggtgagaatcaaagattaaagcacctggcccaccaatagttggttgaaatccagttgaaaaatcacaccttaaaggccgggcgtggtggctcatgcctgtaaatcccagcactttgggaggctgaggtgggtggatcacgaggtcaggagttcgagaccagcctgaccaacatggtgaaaccccgcctctactaaaaatacaaaaaaaattagatgggcgtggtggcgtgcatctgtaatcccagctactcaggaggctgcggcaggagaatcacttgaacctgggaggctgaggttgcagtgagccgagatcactccactgcacgccagcctgggcgacagagccagagtccttctcaaaaaaaaacaaaacaaaacaaaacaaaaaaacagaagacctcactgaaccactaaagttgcgatttatctctactgagtccactccctgggtttgtgagccatttgccttctctttattggtgaatttgcagaggccttatttttattatgttgtatacattccttgtctcaacctcccgtctctaagccagaatgctctagtggcaaatctcttgttttctatcctgtattatcccattgtgtcttctctcctatcccccttccaaagaccctatggagatgggctcttggacctgaaatttgatctgggtctcaagaaaactgtgatttctcagctgcaggggtccattttttctcccttgtcctttccaaagttgggtcttgtgtctgttttggaggtgccaggttcaggggactgttttactgggagtctcagacttctttcttctagagaggcatagcccagggacttcctttcccctggagttatggaaggagtctgaattgctgaggatggtcagccactgccccctcctctctgagtgttccttgatctgccctgggctgcactctctttggaagggggtgggggctgtacccattcaatctgaggaccagtttttctggtctgagtcaaaaatattgggaaatggagcagtgggtggggggtggaggaccgtggggcagtgaggtggttgggacgtctctggaaactcatactgagaaggaatctcaagtcattccaggggaaggccagaaaagggaacatctctgagccccttcccagctaccccactttaggcagacaccaggctgaatacacccattgtgccatgctggatactagctaggaggccgacagaggcagccaagccaggatgagaacctgaagccccaccagcctggccgattgggagggggcgcaatgtagcccctggaatgttggccttctctgagttgggaacggagacccaacttccagcacgtgtaaacaagccggctccttcactctgccctcctttatttgtacttgacttttttctcccccagcaaattaaacagctttgcttctgggctttgggggagtcaggagtgacttttcctgatccggccaagctcttggcctgaatttccatgcccacctcccccgattcccctccccagctcagtccttgagttacccacaggagaatgggtgtatcaggacagagtcttggagaggggagatgatgaaattcttatcatagactctttgaagtgaaaaggacacatgggcctggctcttggaaaaatggtcttttcttgggctggtgtggatttttctggggacctaggtgtaagagggtttgggttcgagtcttgggtcataaccttgcttattattaggtgggcttcttgggcaagttatcctaacgcctctgagattttattcctcatctaagaaatggggttataaatctcagtgtacctcccagagctcatatgagatgagtttctttttatctttttttagacacaaggtcttgctctgacacccaggctacagtgcagcggtgcaatcatagctcactgtagcctcgaactccaagatgagttttcctatacatgtgatggaggatggtttctgcctcttcctcctcctcctctcagtccgccccagttagaagtgaccactacagggtggtccccagagaggcatctgttcttcttagtgagttttgctctaaattagcagctggatgacgcagtggggcgggtggaatgtgctaaaggtcggtttccctgccctgtgtctgctccatactcaggattgggaggctagtgtccaggagaaaagaggagaaaagagcttagcgatgatcctcccccctcccctactccccttctaaccaggacctgggggtgtgaccctttttgaggctaagtaaacttgctggcttggccattggcccggtggtgtgtaagggtgtgtataggggtaaatctgggtgtgggggagatgaaacctgtagggagagaaaggctagccttttgcaatttcagccgtactctgcactggtcagagaacagaaaggtgtttcagtgtctgcccacctcagatgggaccagcactcagatttgggtcaaagcaccggttttcttggccttctagccagctgccttttgctccaggatgagtgtggttgtggatcagctagtttgcctagagggaatggggcagggtaaggcaagagtcccaggggaaatggcacttttgtttttctctatcttccctcacccattatctctggatcttcttcctctgctggcaaaagtgctgcttgatatctctcttccatccctcccgctgggacagcattttttccttcctcttgagaaaagctgagatctggttttattgtctgggggcaactgggagtgggtctgccctgctggggaagatagtgcctccacacgcctgcccccttctgaccagcttctctctcccagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccaggtgagccctgcctccactttgggcctttcttccaggcccggggtctgaggaagagaaagccattggtttgttggtgatgccgatagggtcatggggttggaggctgccagcagcagctgtgggaagcatgccatgggctgagcagggtttgtgttcatgctgagccctgcatgttgaggtaccccagcatggtataccctgccatgggcttgaaactggacaaactggtgtccaaatcaaagctgtgtttattaaccatgtggcctggggcaagccatttcacctcttttgagttttagattccccatctctccaatgggataatactcactttgagctgtaaagattagcaagaagcatttagcgtgcttggtgcctggcacatggtagatgctcagtaaaaagtagggatgtgccctctcctcccctaagtggagtatatcaggaatgtatcaaggcaattaggaagtgtgatgttgtactttgtgaagaatggccccgaccctggagggtcagcctggaatagagggctctgttcttgagatctttgcagggccattgttagaaagctcttagatttccttggcagggctcagagagtaagcctaggactagtggtggtgtttcttcccactaggaggcagctcaaccacaaagggatggagggagtttcctggccctggagatgtatgagcagtggttaggggctgcttattgggcctgttgtagacagggttcaagcacagggatggggttgaccagatgacctctaaggttccttgctgcctcaaggctctgtctctctgttttcctctttggaacacatgttctggtccatattctgaggggcttactgttgaatgaagaagctaatgtatcacatagggagggtagagaatcacttattcactcagcaggtatttgctgagcgcctactctgtgccaggctccatctgggcacaaatgcctctagatacctggttgtcaaaagcaagatattggctagggtaggtggaggaagcatccaggagttgactctgaaggatggttagggctggctttggagcagagtgaatgggaagtcaatccctgctgtcctctatttggatccccaaaatactacggtttatctaattcttcctcactctaaatacaaaccgcttttgttccagaacttggtagtcaagccagaccagctgatcaaacgtcgtggaaaacttggtctcgttggggtcaacctcactctggatggggtcaagtcctggctgaagccacggctgggacaggaagccacagtgagtgggcatggggtcaggatgaacgtgtgtggtaacagaagcaaatatggtcaccttcaggtcagcagctctgtggatcacccccacagccagtctcattgtagctcagggaaggcaggagtcctgtggcgctgacccactcaggtggctgccagcagtaggctcagtcttgatgcccattcccagctccctcatcatccaaacttctttgttttattggtttgggcaagatgtgctgcagaggtaacctcaatataattcaagagccaggtggaaatggtctgattctttttttttttttttttgacagggtcttgctctgtagcccaggctggagtgcagtggcgtgatcttggctcactgcaacctccgcctcctgggttcaagcgattttctagccccagccttctgagtagctgagattacaggcatgcagcaccatacttggctaattttgtatttttagtagagacgaggtttctccatgttggccaggctggtctcgaactcctgacctcaggtaatctgcctgcctcggcttcccaaagtgctgggattataggcatgagccactgcgcccggcctactttatttttttttaagacagggtctcacactgtcactcaaggctgtagtgcagtggcatgttcacatctcactacagcctccacttcccaggttcaagttatcctcccacctcagcttcctgagtatccgggactataggtgcatgccaccatccaggctgctttttaacatttttttatagagttagggtcttgaatgttacccaggctggtctcgaacttctggcctcagggaatcctcctgcctcagcctcccatgtagctggaaccacagatgtgtgccaccaagcccaaattcaattattaacttctcccagcttggtgatgaatttcaaccacgtagatgagagagttaaagtgaaacatggtttaggaagggtaagagatgcctggaataaaattatgtttcttcttattccccaggggagctggaggactaagggagggagtggagctgaggcctggcctagcctgggaagaatgtgccatccacacctggctctgtagagcacgtggctctgaagggcctggtgctcatctggggtgaaactgtaccagggatgagctgttctcttccttggctgcctcgagaatagcaatgaaggtggtgatggagatgtcttcctccctcattgggcttcctcagagtagcccttaaatgttaatttcccagtttctggccctcatgggtaaagcgggatccttgaagttgcacatggacccaggcgtgaagcgacctgtcccttgagttcccaggcctttggagagaggatggtgggattggagggagggatgctgagcatgtccccagggagcacatcctgcttccttctgctggcctctgggaggggaaggtgggacatcagacatctgagctggcagcagcgttgggccagcaggagtggctcattacctcttatggattgctgtctggtccctgactcagcagtgacgcacaggccaggcgggggttttgggacttactaggatgagggctgtctcgccacagccgccgccagggaatcactcgaactgattagctctgcaggcctgtggtcctcagccaggagagtctgcgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgttcaggcacagcccgcaccagagcaaggggtgaaagggcatctcctgaggacttactgagcttagggatctgtgaccccattttttctggaaaaatctctctttgctgggtgtggtggtgggagtgcttgggcaccacccctgtgcagtccctccttctgccctaggggcaagacgtgctgtccctctgagtttcatctccctcaatttttctgtaggttggcaaggccacaggcttcctcaagaactttctgatcgagcccttcgtcccccacagtcaggtatgtgtgaggcggctccaggctgggtcttctccctcctggaaccttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttcctctcccagtacatggtagaccatcttccccagttcagcgcccctcaccagcttcgcccccacaaccccaatcccactgtcctgtctcttcacctgcaaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagagttgagtgagagggacggtagggaggtggcagttcggatgagaagaccgacaggctctgggcacagactggggagagcagagcggtctcctctctgggagccaggtggtagacacggccctgtcctgaggaagacagctgggtgcagggcggggactggcttggaaccagactgaaatatgccgccagcatccctcacctccttgcccctgtctgtctgacacctctgcctccagcttctcgcctgacagctcctttccgcctcagtggctgaagagctatgtccagggagcaggggttgcagaggagatggaagggccagtggggtgcgtttagggaaatggagctgtcggtggcagtgagagattgctgcggggcgcctggggtgctgccgagctgctccctgatggatgaactgtccctctctccctcccacctctagaattctggccagttttatctccggcctcttcaatttctacgaggacttgtacttcacctacctcgagatcaatccccttggtaactgggtgtgcttggctgggagggggcaagggtcccagtgcctatgacagccctggccttggcattcagagaaccagactcccacttgccagagggtaacacaagacagatgtgcacaagcagaggggtccccatgcaggtttagtgccagttcctgtttctgagctctcagaagactgtagttcttctcttagtcaactccaacctctctctttggtcttagagacagagtcttgccctgtcgcccaggctggagtacagtggcacaatctcagctcactgcaatctccgcctcctggtctcaagcaatttttctgcctcagccttccgagtagctgggattacaggtgcccgccaccacgccaggctaattttttatttttagtagagacggggtttcaccatgttggccaaggctggtctcgaactcctgacctcaggtaatctgtccacctcggcctctcaaagtgctgagattacaggcgtgagccaccacgcccggccagaagtcctggttttgatctgactgtgtgcttctgctcctcccgccaggtcaggctttctgacagcaggaggtgggcagcctctgcactgctctcaccctttggcccttcattcctcctggtacactcagaggcctcacacttgcctccctctgtgggagttggtcaatcattaacccttgatgctgggaagagcttggtctcagtctcttgggctgtgaaggaagcaggtggtgttgagggagagtggcgtgggctggctctggccaggacttctcagggcaaagtctaggaaggcgagaaatcaaatcattccagctgaggatgcagcccctctaatggaccagatggccttgtgctaactcaatcagctaaatggccctgggggaggaggaagatgggtgtccagtgaggtggtataaacgaatcctgctgattgggagtccagtgcaccctgcggcccctgctccacctgacactgaggcttcccctagccagaccctgggagacatagatgtgcataccggtggggggtcttctgtcagcaacatgtacctttaaacactttttaaaagtggccggaccatgggtttgcgcatggttagatactcaaaagcagggagtgtagcgttttgtaaagatgtttgaaaattgccatggcaactaatacagacctccatgtcccattgcctataggtcagggagaggggaatggccttgtagaatttgttttgcctttaatggggaaaagctctgtctccataagggcctctctggtttcttactgagcttagagagttctgaggcctgaatgggccaccatgggatcggtgtttgtggaggggttggaggttggtggttgtctctacccagagccggtgtctgatgattgcctctgctccccttgaagtagtgaccaaagatggagtctatgtccttgacttggcggccaaggtggacgccactgccgactacatctgcaaagtgaagtggggtgacatcgagttccctccccccttcgggcgggaggcatatccagaggtaaggctggtttagagaggagatggggactggggggagggcggtggggaggtgactcatctttgatgtgcatttggccccccttcatgagctgtttatttggcagggaaaggaagactgagaagcatttaattttcttaaaacctcaatggggtgggggtgggagtgagccaagcctctgaatcccagccagaaatccttttagatttctctctcaatcagcctccctcgactcttcacttgatttgttgcctctccatgattccaagtgtctcgccttaatcctgatggaaggtcattctctccgcgtctcactgagaattttaattgctctttcccactctgtcctctgagaagtcctcacagcaggactgggctttctgggaagtaccccaggcccagggaagaggctgggctaggagacggtctcgtctggggaggcctggggttggggggacgtgtgatgggccgagcaggcagatgctggggtgagggcatggttgagcagagggacatggttaggctcaggacttaggcagagggccaagtacttgacgtcagagaagggagatgggaagtttgtccctaggcagtgactgtgactatgggtgtttttggtacttggagacaccatcaagtgtcttcaaggcatgtggggccctgcgtagccccttcttcccaccccattaaggcaccttttcatgtgcttccagggaaagcggggaggggtcctaggatctgggacctggtaaagggggtaccccaagggcctacctgttgctgtctggtccccaggaagcctacattgcagacctcgatgccaaaagtggggcaagcctgaagctgaccttgctgaaccccaaagggaggatctggaccatggtggccgggggtggcgcctctgtcgtgtacaggtgaccgaagggggttgctgaagggatgccagcccagtctacccagcatcaacatgtgtgtggcctgggtgggtggggtcctgtcactttggtgtgggaatttggggcagaggaaagcagtggcatcccagagggcttcgagggatgttggtgagggcctgtcctgcacccagtgtcttctataaccttcttgtttgtgtcaaaatgaagctgttttatgagttttaattctgaaaattacgtgctccatacaaaggtacagaaaatgagctagaaagtgaaagttgcctggacatttccccatcctctccctgaccaggtcaccccagttagcaagttactgtatgtcctgtcaagcatatataaatatttatactctttgctttatagaatattaggatcatattctacaccctttacaataattagcagtttttttcactttaagcatggtagacacctgctcacttctagatgtgcaatctgccattcccttctgtgtgtgactggcactatttcctctggctgcagcacactttctcttgggtagcccgtcagggactcctgcagtgtgtgattttgcttgtctttgtgttagggaggtgctcattgttcattttacctgccattgtctgtccagggctccccagtgccttagggctggcagagtgcactgcccagaagagtctgatgtagcaccattaacctgcaggccagacttgcatgggaattgggggctggagatccaagaggccggttccacaggctaactccagtgttttgagggatccgtgtgtcctcccaggcaccaggctgccactccctgccccaagtgtgagagccatcactgacttctgtctccttggcagcgataccatctgtgatctagggggtgtcaacgagctggcaaactatggggagtactcaggcgcccccagcgagcagcagacctatgactatgccaagactatcctctccctcatgacccgagagaagcacccagatggtgagatacttgcacacacacatacctgtccccacttccccaggacagcccagcaggctgcaatgggacagcttcgtctgaggagtcaccaaggctgtgtgtggtcctttgcaacttgaggctaatcattgaactttggctctcagtttctctgactgcacagagggcagggaccacatctatcagtgggaggggactgagagggcaagaggcgatgtgtgataaagcccttcaaacaagtgcaggggaggaggtggctgtggcatgctcctgctacaattgcagtaaactcagtttatccgattgcgataaactctgattgcaataaactcagtgaccctcttatattacctggcctctgtgagtctcagtgcccctttaccacctgtgttttggagctctgcataccagttcttctttccttgagccagagagggagagagattccctccagagatatctagaaaccaacctggatttttggatgttggttaggagttatgtagtgctcctgtgggtttgttctgacccctgtctggtggcataggtaatggagagttgagctgataaagtggaatgtctggagagactgtcctactcactccccagtacctcctggcagatgggggaccctcattcaggggaacaagaacttcctcagttggattgctgggaagatgctcaagtctacctatgtaactgtttttgattctctcttactccaaatccaggcaagatcctcatcattggaggcagcatcgcaaacttcaccaacgtggctgccacgttcaaggtaacagttgcaacagtggtgcagtttctggggaaagtggtttggggaaagcagggaaggggccttgaaagcagagtttgagccagagccaagttaccatgagttcccaggtcaggtagggagctcttgccccagggtctcttaaaggggtggagaagacactgggacaggagctgcccatctgcgctgtgtgtctctgggcaagcagctgctacgctgaactataactctcccacctgaagcatgggaggcgaatttctgctttcttccttctcaggaccaatgctttggagcactggctcaatcgatcctttctttctttccttcccttctcttcctttcccttcccttcccttcccttcccttcccttccttcttcccttcccttccttcttcccttccttccctttccttcttccctttctttcctccctccctttccttcctccctcccctcccttcctccctcccctcccttccttcctcccctcccttccttcctttcctccctcccttcctttcctccctccctcccctcccttccttcctttcctccctccctcccctctcttcctccctcctttcctccttccctcccttcctttcttccttccatggagtttcactcttgttgttgaggctggagtgcaatggcacgatctcagctcactacagcctctgcctcctgggttcaagtgattctcctgcctcagcctcctgagtacctgggattacagacacccaccaccgtgcccggctaatttttgtatttgtagtggagcaggggtttcaccatgttggctaggctagtctcgaactgacctcaggtgatccacccgccttagcctaccaaagtgctggtattacaggtgtgaaccaccatgcccaaccgatcctccttactttcaacactctcgtgagactctgggttctctgcatctctttttttttttttttttttttttttttttttgagacagagtctcgctctgttgcccaggctggcgtgcagtggcgcaatctcggctcactgcaacctccgcctcccggattcatgccattctcctgcctcagtcctccaagtagctgggactacaggtgcccgccaccacacccggctaattttttttgtatttttagtagagacggggtttcaccatgttagccaggatggtctcgacctcctgacctcatgatctgcccgcctcggcctcccaaagagctgggattactgacttgagccactgtgcccggccatcctggtcttatatctttctgtcatgagccctttttccaaaagattggaatgaagaaagtgctttgatgatccggggctcctctcatcctactggggtcttctcaacctgggtgcctgttcacgagtcagggctgtgtgtgcacatgctttaaagcacatgtgactgctgtcaacaaggaagacagagctaacgtgtctcaagagtcatccctttcaagatagccacccaaggaggccatttattaatattccatgctgtcagatgctcagtgagtgtattcaaaagagtgtgtgccacatctggtggtggatccatgtgagttttgagaataatgactagataagtgtcaaacttgaaagtctgaggtctcaagaagtgagaggctgggcgtggtggcttataactataattctagcactttgagaggctgaggcaggcagatcacttgagctcagaagttcaagacaaggctgggcaacataatgagatctcatctctactaaaatttaaaaaaaattagtgggttgagctaggaggattgcttgagccccggaggttgaggctgcagtgagccgtgatcgtgccactgtgcttcagcctgggcgacaatgagaccctgtctcaaaacataaataaaatgtggggccagaccccatcagtcctgcccaaaacagggtgtccataactggacctgatttaacagacaaatctgggacaggggagcctcagcagcttttatttaacttctgagctgccctgtactgacccttggttagggcacttggtttggagcaggtactgtacatggaactttgtgtaaaatgccttgggtgacagaagtcagactctaggctcaaaaatctagcctctgtcttgagaaacagaactaggacacacctttccaccctctcatttttccaaagtggatatccattgtaagaactgttcttacaccgcgctgggcgcggtggctcacgcttgtaatcccagcactttgcgaggctgaggtgggtggatcacctgaggtcaggagtttgagattagcctaaccaatatggtgaagcctcatatctactaaaaataaaaaaattagccaggtgtggtggcagacatctgtagtcccagctactcgggaggatgagacaggagaatcgcttgaacccgggaggcagaggttgcagtgagccgagctcacaccactacaccccagcccgggtgacagagcgagaatttgtctcaaaagaaagaactattcccgcacatcacttaagaagcttttgtaggacattgactatgtcttagtacctctgagaacccttgcatagagcccaacatagatatccccaccaaaaacaaaaatgtagtaagaggcagtaatgactgcagaagggacaaaagagagaccagcaaggccttgctgatgatggaggcctggagcaccatgacattaagggatgtcaatcccgggtaccccacgttcccacctcagcaacattctgagtgatcatattccaggccgtggctgcttatgcgtagtcctgtgcttcctgaggagcagcacttgtcacatatacctggtatgtttgtttatcacggttataaatcattgacttgtggctgccttgtttttagtcacatgtcactttgggcttccagggcatcgtgagagcaattcgagattaccagggccccctgaaggagcacgaagtcacaatctttgtccgaagaggtggccccaactatcaggagggcttacgggtgatgggagaagtcggtaagatgaggaccttttctctccccctcaccctgagtgtgggtggccttcctctttgggatttctgattcctgagcatcagtcttaggctcttttgctctctactccccttcctgggtgtgcagtttgggtttccattccctgtcccaacacagagtgctatcctaaactttggagtggtcaggaaagcattttcattgagctctacacttaacagatatttattaaagatcactcgctctgtgctgggctttgtgctggtgacgagggttacagccacaaatggacagacagcaagccttgatggaacggaggacacaaactgctatgtcagggggtgccgagtgccaggaaggaaaacaaagcagggaaagggagaatgcatgtgggaggggtcggggcagccttcaacagggagatcagaaaatgcttgatcaaacttgatcaaggctgggcacaggtggctcatgtactttgggaggtcgaagtgggaggatcccttgagctcaggagttcaagaccagcctgggcaacatggcgagaccctgcctctacaaaaaaaaaaatacaaaaattagccggtcatggtggtacacacctgtagtcccagctacttgggaggctgaggtgggaggatcacctgaacctgggaggtcgaggctgcagtgagccgtgatcatgccactgcactccagcctgggtgacagagtgagaccctgtatcaaaaaaaaaagaagaaagaaaagaaaactgacatttgagcaaagacctggaatgagggagcagcgccatggtgactcttggagagggaagggcaaattcccataccctgcagtggtaaggggctgggactgagagagtggcagcgagacactacaggtcacaggaggacttggccatcactgtgagacagcaggcacaagaagtgttcaagcagaggaaccacatatttattattattattattttttgagacagtgccttgctttgtcacccagacttgagtgcagtggtaccatcatagctcattgcggcctccaccttgtgggctcaagtgatcctccctcctcagcctcccaagtattggggaccacgggtgtgcaccaccacacctggctaattaaaaaaaaaaaatttgttgtgagatagtgtctcactgtgttgcccaagctgatctcaaactcctggcctcaagtgatcctcttgcctttgcctcccaaagtgctaggattatagacgtgagccactacaaccagccaagtgacacaatttgacttaggtttgaattgaatagggttaatttttttttcttttttttcttttttttttattttgagatggagtctcgctctgttacccaggctggagtgcagtggcgcgatctcggctcactgcaagctccgcctcccgggtccacgccattctcctgcctcggcctcccaagtagctgggactccaggcatctgccaccacacctgtctaatttttgtttgtatttttagtagagacggggtttcaccgtgttagccaggatggtctcaatctcttgacctcgtgatcagactgcctcggcctcccaaagtgctgagattataggcaatttttttttttttttttttttttttttggagacagggtctcactctgtcgcccaggctggagtgcagtggtgtgatcatggctcactgaagcctcaaactcccagactcaagtgattcctcccacctcagtctcccaaatagctgggactacagatacatgccacaataaatactcaatttttgtacaaaaaattagcacacacctggctaatttttttgtagacgaacttttgccatgttgcccaggctggtctcgaactcttggactcaagcgatccacctgcctaggcctcccaaagtgttgggattacaggtgtgagccttttgttttctttttaatagagctggttcaaagctgaggatctgctatgtgcagtggggcaggcctggggacagcacagtgaagttaccagatcatgctcttaaaattagaacattccacaagtaaacagtaggagaagatgctaggggtctgtctgtacaaggaggaggggagcgtggcatgggagagtgaccatcaaggtcagagggggcctttctcaggaggtagtgcttgggttgagctgggagaccagagagcagccaggtgaagctccatggagagctccacgcagagggagaagcagggccagagccctgggggaatgggctcagggtgtttaggaacagagaccaagcactggtggatgcatgcgatgagggctaaggaaagctggagagctggggtccagactgcgaacaggaggaatatgggctctgataatttggttacttgaatcttgccagtaaatatgtttcttatgtggttttttttttttggagacaagagtctcactctgtcacccaggctggagtgcagtggcgcaatctcagcttactttgcaacctctgcctcccagtttcaagggatcctcctgcctgagcctccgagtagctgggattacaggcacacgccaccacgcctggctaattttttgtgtttttagtagagacagggtttcaccacgttggccaggctggtctcaaactcctgacctcaagtgatctgcccgcctcggcctcccaaattgctgggattacaggtgtgagccactgcacctggcctgtttcttgttcttgttatcagcaagtggcctttagaaagatttgtctggtggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatccaagttcaaattgtggccgggcatggtggctcatgcctgtaatcccagcactttgggaggccgaggctggcggatcacctgagctcaggagttcgagaccagcctggccaacatggtgaaaccgtgtctctactaaaaatacaaaagttagccagacatggtggtgcatgtctgtaatcccagctactcgggaggctcaggcatgagaatcacttgaacctgggaggcggaggttgcagtgagctgtgatggcaccattgcactccagctctgagcaacagagtgagaattcgtctcaaaagaaaagaaaagaaaagaaaaacttaaaaatcgttactcttactttttgctgagagagcaaccttagccagtaccttgtccacccagggcctcagtttgctgatctgtaacatgggataatattaattcgtatcttagaggattattagtacttttggaagcagcttataaagagcattgctgtgcataatttttattacgagttttctttggggcctttaaggaccagtggcttttttcccaggtgtgactcttacctcttacactctctccttatctcaccccagacgccagcccccagcaggacagcatctttttctgagtccagggccgatgaggtggcgcctgcaaagaaggccaagcctgccatgccacaaggtaactccctgaggcttcaggcatgttgcagggagtggccttgcggtaccctctgtatctctctcccctttccctttcccccctgggctggcagaggcagatgaacagcggtttgggttttgcaatgggagtgcacctgggacacgaggatggtatgacttgagccttccctgtgggcgctcctgaggcagaggacccacgccgtgcctggtcgcctcaactccccctattctcttctacccctggttcttcttatgggggtgtggactgggcagggaggctgtggaggagatagggttacagaaattccaggaagtggaaagttctctgagactcttctcctgagtggagggcagacaccgggaccccaggacggcagagccagctcatacgacagcagttcccaggccacccccaccatcttggggccctaacagacattccctcctttgaatccccagcaagaaaagcccccgcctgtcagcccatctgtatttcaactaatttttctctccgtgtagatgtgattcctgccggccagcccttgcagccagctctacataagtggtgttagttacccctgggctggtatacctgtgcagcctcttcctgggacacactttgctatggcattttggaaaatagtgacactgtcccaaatcagcatccttgtccatggcacgggtcaaccccatgctggccaatcatctcatagtgtttcatggagacaaaaagggattggcattaagagggtgggactgcgccagctagagagcccagagttcaagtcatccagctgtccctgcagagggcctgggggaggcgctggtgttgagcacatctgcccagcctttgtcctcctcctgccccctctctgcccgtttggtctttgctctttcttgcttccattctgctcatcggtgctttcacctcttctgctggccttactccgttgtccattgcagaacaggagagggatggtgagggctttagccctgaaaggcttgtccatgggacccttccctgttcccaccctctccctccaaagcctccagccatcagtgggtcactcagttgccttggtcattttctttgacagattcagtcccaagtccaagatccctgcaaggtaggatgcccccaccctgcccccactccgcgtgtggctttgttagcgggtgacagttttactgtgtgctctgtttccccctcccctggtgggttgcagtgtcgtctggtctattttctgtccctgccttgatgtggcctgaccccaagtcctaagtcttcgctcttcctcccctcctatccgtgctcagtacgcgccccactcagtcctctcctcactgtgtggctgtttctggctccaagcttgggaaggggtagagattttggaaggagcaagagccagacccacagccctggagagtgtagtggtgtcaaggagagagtgtcgcctgggaaggagggagccatccaactaaatggggagtggcagagagtcgtgggcgtctgtcactgctggggtgcagaaggggagccacaagtcacccctgcttctcatttacatctcctgatgtcattttcccacctttcctgcctcggcttcaccactgccagcttcatcctcaagctccagggaccagtttatctttttctggggttgtggtggaggaacaagagaggtgaagaaggaggtagacggaagcgcagaagggtgtgcagcggatctagtgactgggtaattggaaggggtatgagctttgtctggtgtatgaggtcacattttacagtggatacttctgtgcatgcgcattcacccaccagcctagctgagtagattaattggttcatggcatcagagcgtccatttaactttgacattcacagccgtggaggcggggaagtctttgttgtccccttgctaaggggaggggaaggagtaattggcagggtcgataaccagctggaaaggcctggaatgcagcactgtggccacctggctttaatcctgatgtttttgcctctggaaaaagttaagagcagagtgagcccagtgtggaaagaacagggaccagccctggttctccaggagctctctgtgctctgaaggggaggagggttatgaggaggggggttatccttgttactttctggagtgagagaaataaaaggagggtgtgtcagggagaacagattatggctgagcgagccctcccctcagcgaggccagaggaggcctggtgtagggggcatagcccctggcacagaggttctctgtggagcctctctgctgctggtgggctgaggatacacccttcagctttggtttctctgtgcttgaggaagggccactttacctccacccttcctgctggagatgctggtaggttggtagattccaggctttgtcttgatttctgtagctggcagggtagatagatcagaggcatgtgcacgtgcgtcacctggcgggggtgacatgatgcaggcttcccctgaggatggcgggtcatgaactcacacttatattctccctcctcactttcacagttgagctgcattttaagtgattgtgtaatcctggctctgatgctggatgacctcggacctcaatcatttggcatctctgggcttcagtttcctaggactgggaagtgggagaactggattaggtggctccccttgttctgtgatctcatgtctcagcagaacccggggggtctaggtgacagtaaatcccaggtatttgcaacatcaggaaccttctgtcatgagaagctgtaaggctgtgatggaagaggcaggcctgtacagggatttaatgagaccatgaacttggttagccaagcctgctctagtacagtaggttaattaataccagatgccactgggctagatgcatcattcttcctaggggagctcagaacctccctgagggctgctttcctcctcttggacttgcagggacccagaggggaaagtcaactgcctgaagcgtggtaaaagtcctttccctttaggctaaggactgcacttttttctttttttttttaaatatacttgctgcattaaaattttctttttaaaatttttgtgggtacatagtaggggtgcatgagatattttggtacaggcgtgcaatgcgtaataatcgcatcatggaaggtttttctttgttgtttttttttttgaggtggggtctcactatgccgcggtggctggtttcgaattcctgggctcaagtgatcctcccatctcagtctcctaagtagctaggactcaagcacgcaccactatgcccacctagagaactgcacttctaccagctccttttgttcccttaccctttttttttttttttttttttttgagacagggtctcactctgtggcccaagctggagtgcagtggtgcgatcttggctcgccgcaacctctgcctccttggttcaagtgattgtgtgttggtttcccaagaagctgggattacaggtgcatgccaccacgctaattttttttttttttttttgagatggagtcccgctctgtcacctgggctggagtgcactggcacgatctcggctcactgcaacctctgcctcccgggttcgagcgattctccctgcctcagcctcctgagtagctgggattacaggtgtccaccccaccacacccagctaatttttgtatttttattagagacagcgtttcaccgcgttggccaggctggtcttgaactcttgagctcaagtgatccactggtctcagcctcccaaagtgctgggattacaggcgtgagccaccacacctgacctgcgccttacctcttaagtgcccactggagggtctgtccaagagcactgtcctgagcaggaaagagccacctggtagaagggagaaggacaggaaaaacaggagagcaggttgagggcactggccctgtgtaactagcttgctgctcctgccttgtgcagagccctggccagaaccacagttagcgataaggctgctgtgtcctcagccccggctgcacaaacctcttctttggacctacactgacctagaattcatgctgattcaaaccctgactggagctggttttatgtccagatttacagggtaataagcattgttggaacataagtcctgaacccaccaaaattgggcgagctaagcatttttttccaatgactttaaaaataatttgttaagacctcatttgcatataagctgatgacacaccttgcctgggaaatgaagcaggtcctataggaattatcctgggcatctttgactgtggggcccttctttctccattctttgcagagctacttaccagctagcaggccctcttagcttgatttgctctttctgccaccttcttccagaaaaatcgaggcacctcctccccaagttctcagaattctgtcctcttgacattcctttacggttgtgatgaggcatcaccctgtggacatggggcgtggaggggtctgtcaggcagccctggcccctgcaggtctcccgggggtatgtgttctgggtgcactctctgtgtctttgcccaccaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcacgtgagttaccccatggcgggaaatatctccttcctctgctaagacaaagcttggggctgggcacagtggctcatgcctgtaatcctagcgctttgggaggtcgaggtgggagaattgcttgagcccaggagtttgagaccagccctgggcaacatagggagacccccatctctacagataatttaaaaattagccggatatggtggtgtgcacctgtagtcccagctacttgggagggtgaggcaggaggattgcctgagccttggaggttgaggctgcagtgaactctaattatgccactgcactccagcccgggtgacagagcaagaacctgtctcaaaagaaaaaaaaaaggcaaggcttgaggagtcagtgagctcattccctttgctggggaaggctttgcccatcctagagacagaggcagtcagtattcctgggggatctttgtcccttagatgaaaattctttgagggcacagaccatgccttttctatcttctaggtgaaattcctcccctcagcttccccttccccagtcctgacaggttgaggatatcctaattcttcttttactttctcacagtggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccaggtagatcactgggctctggagggtggggggtggggaccatgaactatgcgcaggtagatcactgggctctaggggacagagggtggggaagcaggaatggctcctggttgatgtcccgtcactgctgcctgggacaaagggctggggatttgggagtagccagtggtttaggtggaaatggttggagacacatgatcttcagaagtcaggatagtgacttagggcaggtcagtctgggcagaggctgcttatctgggcttacaaagaggctgctcaggcctgggacagtgacttatgcctgtaatcctaggactttggaaggcagaggcaggaagattgcttgaagccaagagttcaagaccagcctaagcaataaagcgagacccattctctacaaaaagcttaaaaattagtcaagccaggcatggtgactcacacctgtagtcccagctactcaggaagctgaggcaggaggatcaattgatcacccaggagttcaaggctgcagttagctatgatcattccatggcactccagcgtgggtggcagagcaagaccctgtctttaaaaaattaaataaagtaaaataaaatatacgctgggcatggtggcttatgcctgttattccagcactttgggaggtcaaggcaagaagattgcttgagcccaggagtttgagaccaacaaagcaagaccctgtccctataaaaaaattaaaaaaaaaaaagaattagctggacatggtggcatgtgctggctgaggtaggatgatcacttgagcctgggaggtcaaggctacagtgagttgtgatcacaccactgcacttcagcctaggcagcagagtgagactctaaataaataaataaataaatgttaaataaataaatgaggtggctcaggctccaccccacccccactatatcctctctgtgctatgcataactggcttgaaaactgggattggctggatgccatggcttgtgtttgttgggcggcagaggcgggggtattgtttgaggctaggggttcgagaccaacttgaacaacacagcaagaccttgtctgtacttaaaaaaggattagccaggcatgatggcactcactagtcccagctagtagggaggctaaggtaggaggatcgcttaagctcaggaggttgaggttgcagtgtgctgttatcatgccattgcactccagcctgggcagcagagtaagtcccagatcctgtctcaaaaacaaacaaaaaaacaaatcaggattaaagcactttattttatgtatgtttgtatttatttattttttttttttgagacagggcctcactctgtcacacagcctccacttcccaggctcaagtgattctcgtgcctcagccttctgagtagctgggattacaagcacatgccaccacacctggctttttttttttttttttttttttgtacagatggggtttcaccatgttggccagactggtctcgaactcctggccttaagtgatccactcaccttggcctcccaaagtgctgggattacaggagtgagccactgcacctggcctattttaattaaaaaaaattttttttttttgagacagagtttcactctttttgcccaggctggagtgcaatggtgcaatctcggctcaccgcaacctccgcctcccgggttcaagtgattcttctgcctcagcctcccaagtagctgggattacaggcgcctgccaccatgcccggctaattttttttttgtatttttagtagagacggagtttcaccatgttggccagggtggtctcgatctctcgacctcgtgatccgcccgcctcggcctcccaaagtgctgggattacaggcgtgagccaccgcgcccggcaaattttttttttttttttcaatcggtcagcttcccaagccagaggaggctcagaaagactccaacatttcattataaaaatattacgtatttattatagaacagtttcaaaatactgataaatactgttttgttgaaaataaatacttgaggtcccatttcagaaaaacatgactgctgctatgacggtatgtccttatctacccccttttctagatttgagcaaagggaataatactgtatgccactcatataatctgctttcttcagttgctctttccacatcagtaagcactaactggcagcatcacttttgcttttgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagcctttctccatcacccaagctagagtgagtacagcggcgtgatctcagttcactgcaacctccacctcccgggttcaagcaattctcctgtctcagcctcccgagtagctgggactacaggcgcctgccaccacgcccagctaatttttgtattttcaatagagatgggattttacctttttgatcaggctggtcttgaactccaggcctcaggtgatccaaccgcctcggcctcccaaagtgctgatattacaggcgtgagccaccacgtccggctgctgcttctttagtttagggcagaggttggcaaactatggcccaaggcaaaacctagcacatcacctagttttagggctgttttttgtttgtttgtttgtttttgttttttgttttttgagacagagttttgctctcattgcccaggctgtagtgcagttgtgtgatctcggctcaccgcaacctctgccttccaggttcaagtgattctcctgcctcagcctcccaagtagctgggattacaggcatgcatcactatgcctggctaattttgtatttttaggagagatgggttttctccatgttggtcaggctggtctcaaactcccaatctcaaatgatctgcccaccttggccttgcagattgctgggattatagatgtgagccaccgcgcacagccaggggtttttgtttggttttaaagagacacacatactgctctgtagcccaggctggagtgcagtgatgcaatcatgcaactcactgtagcctcaacctcctgggttcaattgatcctcctaccgggtctccctgtgttgcccaggctggccttgaactcttgggctcaagggatccacctgccttagactcccaaagtgctgggattacaggcatgagccactctacctggcccctacaatactatcttgaccctttacagaagtttgctggccctggtttagagccaaagagaagtgattcctggatctgtcccatgcccctcccaccccgcctctgggctgagtgtagaagcagctcatttctcttaaacgctgaccctgtcctgtggggatggtgacaagactcggagggtcccatgaagaaaagccttagatagctgctttatgagcaggcacaggaacaggtagacaacaggagggtgtgagcttttgggtgagagtgaacgtagctgctatgactgtagcagggcttccgaaatacctgcctctcttgggtggatcactgtggtgttagctagtggagatcagtttcggctatccaccacttgtgttttcaggagatggttagagtgattacgagcagaggcctgtgggaagaatgagatgcatattggttttgttttttcgttttgttttgtttttgtttttgagatggagtctcgctctgtcacccaggctggagtgcagtggtgccgtctcagctcactgcaacctccacctcccgggctcaagcagttctcctgcctcagcctccctagtagctgggattataggcgcgcaccaccatacccagctaatttttgtatttttagtagagacggggttttgctacgttggccaggctggtctcgaactcctgaccttagaagatccaccctcctcggcctcccaaagtgctgggattacaagcatgagccaccgcgcccggctgatatgcatattgttaacattactttgttcttggaccctggaagaggacatgtggaatgggaggtgggcccttaaacggtgctgtcttgttgccctttctgaggcagagagttaacaggaagggacttttgtcatcctctagatccggaccatcgccatcatagctgaaggcatccctgaggccctcacgagaaagctgatcaagaaggcggaccagaagggagtgaccatcatcggacctgccactgtgagcttcccctccggaaagccttttacgttcgatgctatcttatgaagttcaatgcccttaggaagtttactttttgactcctctatctccctcctaggttgagaagattcaggaagtatgtgttgaaaatcagtctgtccatttttagctttttttttgagacacagcctcactgcaatgcctaggctggagtgcaatggcgcgatcctggctcactgcaacctccgcttccgggttcaagtgattctcctgtctcagcctcccaagtagctgggattacaggcacccgccaccatgtccggctaatttttgtgtttttagtcgagacgggatttcaccatgttggtcaggctggtctcgaactcctgacatcgggtgatccacccacctcggcctcccaaagtgctggagttacaggtgtgagccaccgtgtttggcctttttttttttttttctttgagacggagtcttgccctgttacctaggctggagtgcagtggcacgatcttggctcactgcagcctctgcctccttggttcaagcaattctcctgcctcagcctcccgaggagctgggactataggtgtgaaccaccacgcctggctaattttggtatttttagtagagacagggtttcaccatgttagccaggctggtctcaaactcccaacctcaggtagtctgccccctacagcctccaaaagtgttgggattgcaggcgtgagccaccatgcctggctgaaattattctttgaattattttttgtttgtttttttaagaagcagggtcttgctgtgttgctggagtgcagtggcttttcacaggtgcagttataacacacttcagcagccccgaactcctaagctcaagcaatctccctgcctcagcctcctgagtagctgggattccagaagtgttctccacacctggcttatttttacttcttactgtattaaaaaaatggagctagtatttatttccaaagagctgagattacagacctgagccactgtgccgggccaagtatacgtatctgaacctgaattagtgagccatgctttacaaataaggctctcttttgttctgtatgtctcttgagagagagaggagactttcctaagcaggaaacccagtgggcaagtgtgatttctcttggtcattctctccccagcctggccagaaggggctgggcagtaatgcaggggctttgtgattctttgtggtgaatctggaagtcaccttcctccctgattgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaatacatataagtgtctgagccagggcctgcgttcagcaggtgctcagtgagtttttattgtagttaataatagtatcctcattatttttggtagtgggaacactgatcagtaggtcatgaatacagtattatatctcagagtaacgtctggcacttagtaggttcataataaatgttagccattattgtttattattcctactattactactgctgtcgggcttagaaaccaaaagctgttgagatagagtcaccttgttcgtctccctggctctaccacatgatttccgataggatgcctgggtgaggaagaactctcaccaaggtctttaggggtgtagcctgggaatccccagtccttgggtactgcctgaccaaaggctcagggaataagtctaggaaatgctgcttgtttagattgtcttcttagatttataatgatcatatcaaaagacatgaagaggccaagaacagtggcttatgcctataatcccagcactttggggggctgagggaggaggattgtttcagcccagaaattcgagactagctgaggcaacacagtctcgaatttggtagagacccccatctctaccaaaaaaaaattagccggatgtggtggcatgtgccagtagtgccagctactttggaggctgaggcaggaggattgcttgaacccgggaggcggaggttgcagtgcaccaacatcgcaccactacactcaagcctgggtgaaagagcaagacttcatctcagaaagaaagaaaatatgtgtgtgttcttaggttttttttgtttgtttgtttgtttttgtttttgagacgatcaaaaaattcaagcgatcctcccgtctcagccacctgagtagctaggactgtacaggcgcccacgaccacacctggctgatttttgtatttttagtagagacggggtttcgccatgttggccaggctggtctggaactcctgacctcaggtgatccaccctcctgggcctcccaaagtgctgggattacaggcgtgagccactgcgcctggccggaatttgtggatatattttaaaacaactgcaccagggcgtactttctaagtcatctcttactgctgagcgaacctctctgggcttattttgtgcccagtcttttcctttgcaagttaaatagctccaactccttccctctttcttctcttctgttccatttgctaccttcccctgtccattattgctggggcatctctggacccttactggccatccacatccccccaaaatccagtgtacccagtacaagtgtgcttcctaaccctgtacacacttccccaggcctcctcctgatcctgtatcctgatactccctgctctcaacaggtacccgggctccacattcatggatcatgtgttacgctatcaggacactccaggagtcaaaatgattgtggttcttggagaggtgagttactttaaaaaaaaaaattatgattttaaaactgtaatgcatgatctcagttttcaaaaaattaaaacattttggttacatgtaacttaaagggacagtccctggtaatcccatcccctagatgctggggcctcaaggttgtcactattagtactgccatttatgtttcagagaagggagttcttaatctcccagcatcccaaactttagcgccaataagagagaagctctgctctggctggccatggtctctacctggtgggcagtggaaagctggagtaaaaaaagtgcatttttttggccaggtatggtggctcacacctgtaatcctcccagcactttgggaggctgaggcaactgggtcacttgagatcaggagttctagaccatcgtggcctacatggtgaaaccccatctctactaaaaatataaaaattagccaggcatggtggtgcacacttgtaatcccaaccactcgggaggctgaggtgggagaatcacttgaacccaggagacagaggttgcagtgaacagagataacgccactgccctccagcctgggagacagatcaagactccgtctcaaaaaaaaaaaaaaaaaagcaaaaaaaaagcgctttttaaaaaatgtgatgacttttggatagaacggttaaaaaaaattttctaaatactaaaaaatttgggagtcccataaccccatcccttgtttgcacctctgaaggcaggtctaatcctaaatcatgttatatttctagattaggaagggggagtcccagagattcctctaggagacctgctgtttgttcctttagaaatcttccttgtgtccaggctgaaattaaactccttttatttggccaaagcccgtgtcactccattttctatccagtttttacgtcaggatgggctgcactaacttggctttttctcattccccattccttggcagattgggggcactgaggaatataagatttgccggggcatcaaggagggccgcctcactaagcccatcgtctgctggtgcatcgggacgtgtgccaccatgttctcctctgaggtatggctgagatgggtcacttctgggctgggagtggggattgcaagagggggcatttgaggcgaaccaggtaatcatcttattaattcgcagctagttccttcaagaaacgtttgttacttgcttggttactacaaagtccagccagggccctgctctctgggagcttatatccagttggaggagaccaatttataagcagattaaagctacagtcaggctctgagtccctacttggcgtaggtagcaaccagctgtctggagaagttgagatggcatccctgagaaggtgatgtttgaactgtagtttaggggatgagaagggctttgctgatgaaagggaggccaaggagggagaaggacacagcctgggctcagctgggcggggcttggtgagatgttttgtgtggggagaggtggtagaaggaaaggtttgttcttgatgtgttaaaatgataaaatgtacttgaaagtgtctggcgcacctgatggtgttgaatataaacactccttgggcttctgctgtctgctaagcttctgagctatctgtcttctgctgggggatcatacgccagacttcagcccctgtgcttcggcttagagaaccctttaccaccttgaaggtggctcacgtgatgatgatgaaattgaaggaaaagccgggtacctggtgtgtgtacaagaatactctgcagtatcattaacagcaaaaactggaaacaactttttttttttttttttttttttttttttttggagacagggtctcactctgtcgcccaggctggagtgcaatggtgtgatctcggctcactgcaacctccgcctcctgggttcaaatgattctcctgcctcagcctcctgagtagctgggattatgggcgcatgccaccacacccagctaatttttgtatttttagtagagatggagttttaccatgttggtcaggctggtctcgagctcctgaccttgtgatctgcctgcctcatcctcccaaagcgctgggattacaggcgtgagccaccatgcctggcctggaaacaacttacatgcttatcaggaggggactgtcagcatggcatatccacaaactaatggaaaacagggcaggcatgcaaagaaggaggtggaacttgatatgttgatacagaaagagtttaagatacattacctgtaagaaagggcagagttcagtaaatgcttataatatccattttgtgtaaagtgtgtgtgtatgtgggttttattttttatttttccatgtaagtaaaaggggaggagaggtccagaatcctgcccatccctccagggtgagctctgcttgcacaggctttaaaatcagaccttggtagatctgtgtagccagacgtggtggcaggggcatataatgccagctactcgggaggctgaggcaggagaattgcttgaacctgggaggcggaggatgcagtgagctgagatcagatctttaaaatcagatcttggtagacctgggcaagtcatttagcctcttggtaactgtttcctgagctgtaaaatgaggatgccatgccgcaaggttgttgtatgacttaaatgaggaagtaattgtaaaggtctggcgtgcataggtcttagaaacttcttttttttcccatgccttgtcagtccgcttattccatgaagctgttcctgattctccttttttttttttttttttttttttgagacggagtctctcgcctaggctggagtgcagtggtgcgatctcagctcaccgcagcctctgcctccctggtttaagcaattctcctacttcagtctcccaagtagctgggataacagccaccacgcccggctaatttttgtatttttagtaaagacagggtttcaccatgttggccaggctagtctcgaagtcctgacctcaggtgatccacctgcctcggcctcccaaagtgctgggattacagccgtgagttaccgcacccagccgattctctttcttcttgagtgctctcccccaactccattgctctccccccaactctgtactcgcccaacagccaaaaaccagtcaccctcctccattgtttctcctggcttgctttgcattaccagcccctccccctttccaccccacctccccatccccaccatgatcaggacacttctaagagggtgagcacctcgcatttcagtatctggtggcactcatcgccccatgggtggggtgggtccttgaattattttaggtttttgtgtttttttttttttgagacggagtctcgctctgtcgcccaggctggagtgcagtggtgcagtctcggctcactgcaagctccacctccggggttcacgccattctgctgtttcagcctcccaagtagttgggattacagacgcccaccaccacactcggctaattttttttgtattcttttagtagagatggggtttcaccgttagctaggatggtctcagtctcctgacctcatgatccacccatctcggcctctcaaagtgctgggattacaggcgtgaaccactgcgcccagccctttagttttgttttttaaataattcatctcccttttagaaattttgtttttagttttgagaaatccagagttacaagaaacttaacttctttaaacctagggtttctgagtatagactctcttcttcccacccatctgccgatgcagattaaatcctacaaagaacgcattgggaactcacgctttaaggtgtctttcaacctttgcttacagagcagcagttcctaaccttttcacctttttgttctgtttgcatggtgaagagcacaggctgaggccagattgcctaggttcaagtgctaccacatgctacctgtgtgacctgggataaatcactttacccatctgtgctcccatttccttttttataggaaacgatcatagctactgagattgaatgagtaaaactcttagaaaagtgcctgaacatagtgttatgtaaacaggttagatagtactatgattactctctgcaccccatcctaagacaaggctttgcatcagatgtcttgtgggttaatttcctccatcgcttgattaaagactcagtcacgctgggcgcgctggctcatgcctgtaatcccagcagcttgggaggctgaggtgggtgggttgcttgagtccaggagttggagaccagcctggaccacatggcgaaaccctgtctctactaaaaaactacaaaaaacttttagccaggcatacacctgtggtggcatacgcctgtagtcccagctacacgggaggaggtgggagaatcacccgagcnnnnnnnnnnnnnnnnnnnnnnnnnnnnnnnnnnnnnnnnnnnnnnnnnnnnnnnnnnnnnnttccagcctggggaactggagcgagaccctgtctcgaaaaaaaaaagaaagaaagaaaagacacagacaccatttagcacttcttttttttttttttttttttttgagacggagtcttgctcttatcaccctggctggagtgcagtggcgcaatcttggctcactgcaacctcagcctcctgggcacatatctatagtcccagctattgaggaggttgaggtgggaggattacctgagcccaaggaggccaaggtgccagtgaaccgtgactgcatcactttactcctgcctgggtgacagagtgagaccctgtcacttaaaaaaaaaaaaaaaaaaaaggcggggggggcaggcgtggtggctcacacctgtaatcccagcactttgcaaggccgaggctggtggatcacctgaggttaggagttcgagaccagcctggccaacatagtgaaaccccatctctactaaaaatacaaaaattagctgggcgtggtggcaggcacctgtaatcctagctactcgggtggctgaggcaggagaatcgctggaacccaggaggcagaggaaggtgattctggagttgggctgccagtctttgtatcctgacttccatgcaccttagctgcgtgaccctgaggaagctcctgaacttctctgtgctttggtttccttgtctgtaaaatggaaatcatctattgtacctattcagtgagcttgcttgaggcttaaatgaagtgattcatgtaaagtgtttagcacactttacatgggattctatgttcactcttgggggattagcagtaaagctactttcctttgctttccaggtccagtttggccatgctggagcttgtgccaaccaggcttctgaaactgcagtagccaagaaccaggctttgaaggaagcaggagtgtttgtgccccggagctttgatgagcttggagagatcatccagtaagtggaccttggggaggatgccggcctccccctcctttccaaatccctcctgagacagcagcctctcccacacagggacatcatgtattcctggtccctctcggtgtctagcgcagctgtatggatggttcaaaatcctctttctctttggctttccttttgttttatttagtttgtggaggcagtaggtctaggctggtattaaaatgtgttgagtttctgagcctacctatttggctgggaggtggcagccatagatgagagctccacatgaaaatgtttagagagtgttatctatgattgatagagagttattagatatcctgtgatctcttcccatttctacctcttaaacctgcctggactcccggctgtgtccttccttgccatccagagattgggacatgaggtagtagggagcagagggcaggtgcagtcttggctagaacttcttttcatttagttctcagaattcagcaggtaagagtaaactaagaaacctacagtgtttgggttagatagagcattcttgggatgtcttacaggagcccaaaataagaaaatccacatggatgtcttttttttcctgcctcccaggtctgtatacgaagatctcgtggccaatggagtcattgtacctgcccaggaggtgccgcccccaaccgtgcccatggactactcctgggccagggtaggtgccttaaatgtctctaacagtgtgagcaagggagatctgtgggtctatggtggtgggtttcgcgttgatttgccttgaactcttggaaaccaggccttctgtattagtcggggatctcttagagggacagaactaataggatatatatatataaaggagagtttattaagtattaacttacatgatcacaaggtaccacaataggctgtctataagctgaggagcaaggagagccagtccgagtcccaaaactgaagaacttggagtccgatgtttgagggcaggaagcatccagcacaggagaaagatgtaggctgggaggctaggctggtctctcttcttcacatttttctgcctgctttatatttgctggaagctgattagattatgctcactacactaagggtggatctgccttccccagcccactgactcaaatgataatctcttttagcaacacctacacagacacacccaggattaatactttgtgtccctcaatccagtcaagttgacacttttggaggtcaaggtggaaggactgcttgagaccaggagttgaaggctgaagttagccatgactgtgccactgcactccagcctgggtgacagagtgagaccctgtctgtaatttaaaaaaaaaaaaaaaaaaagggctgggcctggtggctcatgcctgtaatcccagcactttgggaggccagggtgggcggatcacctgaggtcaaaagttcgagaccaggctggccaacatggtgaaaccccatctctactgaaaaaatacaaaaattagccaggcgcggtggtgggctcctgtaatcccagctactcgggaagctgaggcaggagaattgcttgaacctgggaggcagaggttgcagtgagccaagatcgtgccattgcactccagcctgggcaacaagagcgaaactccgtctcaaaaaaaaaaaaggagagagagagatagagaacatattcatgttgtttttgtaataaaaatgtaactgtaaagcattttaaaaattcatagaggataattggagaaataggattggactaaattggctgatttgcctcaactctggaaatgggaaattcaggaattcagtccccgtcccctgggtaaaagacatattgaagggctcccccatttcttttttttttttccttttttattttttatttttttgtattgatcattcttgggtgtttctcgcagagggggatttggcagggtcataggacaatagtggagggaaggtcagcagataagtgaacaaaggtctctggttttcctaggcagaggaccctggggccttccgcagtgtttgtgtccgtgggtacttgagattagggagtggtgatgactcttaaccagcatgctgccttcaagcatctgtttaacaaagcacaccttgcactgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctttctacacagacacggcaaccatccaatttctcaatcttttccccacctttccccctttctattccacacaaccgccattgtcatcatggctcgctcacaatgagctgttgggtacacctcccagacagggtggtggccgggcagaggggctcctcacttcccagtaggggcggccgggcagaggcgcccctcacctcccggacggggcggctggccgggcggggggctgacccccccacctccctcccggacggggcggctggccgggcggggggctgacccccatctccctcccggacggggtggctgccgggcgaagacgctcctcacttcccagacggggtggctgccgggcggaggggctcctcacttctcagatggggcggctgccgggcagaggggctcctcacttctcagacggggcggttgccaggcagaggatctcctcatccccacatctcagacgatgggcggccgggcagagacgctcctcacctcctagatgggatggcggccgggaagaggcgctcctcacttcctagatgggatagcggccgggcagagacgctcctcactttccagactgggcagccaggcagaggggctcctcacatcccagactatgggcggccaggcagagacgctcctcacttcccagacggggtggcggccgggcagaggctgcaatctcggcactttggaagggcaaggcaggcggccgggaggtggaggttgtagcgagctgagatcacgccactgcactccagcctgggcaccattgagcactgagtgaacgagactccgtctgcaatcccggcacctcaggaggccgaggctggcggatcactcgtggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggggagagggagagggagaccgtggggagagggagagggagaccgtggggagagggagagggaggggggctcccccatttctttagccacgtatctcgtcccccctttttttttttttttgagacggagtttcacttttgttgctgaagctggagtgcaatggtgcgatctctgctcactgcaacctcctcctcccagattcaagcgattctcctgccttagcctcccgagtaactggggttacagacacataccaccacgcccagctaatttttgtagtttcaatagataatggggtttcaccatgttggccaggctggtctcgaactcctgacctcaagtgatccgcctgccttggtctcccaaagtgctgagattacaggcataagccactgtgccctgccccattacgttattgttatggttggcagctatatctgaagtgtatgtaagattttccctttggattcattttaccatttcttacccaggtgaccttgggctggttactgagcctctctaagcctcattttttttttttttttttttgctataacacaaggaatgcttctcctttgtgaggttaaaatgaagcaatgggctggatgcagtggctcacgcctgtaatcccagcactttgggaggccgaggcaggcggatcatgaggtcaggagattgagaccatcctggctaaaacggtgaaacctcatctctactaaaattacaaaaaattagctgggcgtggtggcaagcgcctgtagtcccagctacttgggaggctgaggcaggagaatggcatgaacctgggaggcggagcttgcagtgagctgagatcgtaccactgcactccagcctgggcgacagagcaagactgcgtctcaaaaaaaaaaaaaaaaagaagcaatggactgggtctcacgcctgtaatcccagcacttggggaggccgaggtgggagaactgcttgagcacaagagtttaagaccagcctggacagcatagcaagaccctgtctctacaaaaaaattttaaaattagccaggcgtggcggtgcgtgccttgttgccccagctactgggaggcatagctgggcagatcgcttgagcctagctaggagtttgaggctgaagtgagctatggtctcaccagtgtactccagcctgggcaacagagagactctggtccccctccagaaatgaagcaatggatatgaactgcttaggctatttcctagcccagcaaatgctcagggaaggatagaaatagagctgatagtgctgatgccaagtggtgtcatgggtcctcctgttttctatgtccaaaatgatctaatgaaagggcttttgcacttctttcttgggaaaactttgagagttgttacttggctgccagagtttacgacattcctggggtgctttggttctgagagtacacacagcagggcagtcctggaaaaatctgtggtggtcaccagggccctgcttccctcttccccatctctgcccaggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggtgagcatggagggcagaagattacagggccctgcagctcagagttaatgattttcccccaacaaaggggtgggagtggacaggcctggggagtgtgtccaagatcaatctttggggccacaggtcaattgagcggccagaggaaggacacataaactattcctaagtcttccaaggacagaaagtccagtcacatgagccactgcacccaaccaaatgcagatctcttgacagcaagatagaggttaggcaggagagaactggaaagatgtggtggcctaaggagtgtgggcctggtggagctgctgaacagatagaaagtaccttatgggctaggcgcggtggctcacgcctgtcatcccagcactttgggaggccgaggtgagtggatcacctgaggtcaggaattcaagaccagcctggccaacatggtgaaaccccatctctactaaaaatacaaaaaggtagccaggcatagtggtgcacgcctgtaatcccagctaatcaggaggctgaggcaggagaatcacttgaacccgggaggtggagtttgcagtgagccaagatcacaccattgcactccagcctgagcaacaagagcaaaaatattccgtctcaaaaaaaaaaaaaaaaaagtaccttgtgttcactttgcaaatttgtttctcccatcagcttgaatgttagaaaaaattggttttctctgcaactcccaatcttagccctcccgtgggactgacggctgggcaggggagccagtgagtatgtgattcacagagccctgggcttaatgtgatgctgggcagaaggccaggtcaatgtctttggttgtgtcatgccctcacctgcagagagatgggtcttggtcctgctttggacccttcctgggaaaagttcacgggttataacacctgagcaggtctctctctgtctgctcctgcctcccacctctccatactttgttcctgattcttagttgggaggttgaatactacaggaatgaggcatggggcctcctacactgtgaagggacagggttctcacctcctgtcagtctggcacatggagcatagccacaaatacaggtcaaatcctggtacaggcaactcatgctgaaaatcactgatcaaagaatagattcaaaactctggtttcaaactctgttttacaaacagtatttggggccgggcgcggtggctcatgcctgtatgtaatcccagcactttgggaggccgaggtgggcagatcacttgaggccaggagttcgagatagcctggccaacatagcaaaatctcgtctctactaaaaatacaaaaattagcctggcgtggtggtgcgtacctgtagtcccagctacttgggaggttgaggcaggcaaattgcttgaacctaggaggtggaggttgcagtgagccaagatcacactactgcattccagcctaggcgacagaatgagactctgtctaaagaaaagaatcaggaggttttgccttacagttgtgtggtagtattagacttggactggtagttacccttcttggatttgaatgacttgtttagggagatgggggaaagtacgagcatggccttgtcgaccatctcctggcctttgatccccccactccaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcgtaagtactgtcatcatgggaggtgaacagtggggacactgggccttggcctcatgctgctttgccacagcagggccctagaaggagcccctgagtgtaaaacccagtgctcagggccgttcgggacacactgggttggtttgcccagctgaaggaaactcttaaagctcaaggcaacacgcacttgtttctcctccagggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcggtgagttgttactctcctaaaaaagtgggatggaggccaggcgcggtggcccatgcctgtaatcacagcactatgggaggccaaggcaggtggatcacttgaggtcgggagttggagaccagcctgaccaacatggagaaaccccgtctctactaaaaatacaaaaaaattagccaggcgtggtggtgcatgcctgtaatcccagctactcaggaggctgaggtaggagaattgcttgaacccgggaagtggaggttgtggtgagccgagattgtgccatggcactccagcctgggcaacaagagtgaaactccatctcaaaaaaaaaaaaaaaaaagtgggatggatctactgggtgggtggtgatagtgggggcattaatttatttgggagaatacctaagctttcaactccaacatacaaagctttggatgtgttgacagatgccaaatacaaagcagctattttttccatgttataatacagattgcccttaacagtttttctgtcgttcgcttgcagtatggaaatagcagttgaaatgagatggaaaacttggtaactttggtttcccaaatgaatcttatgggtaaaagggccaaggtcaggttgaggggacatattggtcaccttcggctagataatacctcattccgcagtaacagacaactccaaaaatctcagtggcttaccacagcaaaggtttatgtctcattcacactacatccactgagggtttgctgtgcctgttctctgccatctgtgccgaaggaacagccgccgtctgggatgtgctggcctcacgtcagcaggataacagcaatggcaggaccacgtgcaggctcttaaagccttacatgattcaccttcactcacatttcattggccaccgcaagtcaagtggttatttgtgacatcactggggcaggaagagtgacaatatcaaggcatatctgattgggagagaccagtgggaaaggacagtaaatatttgaaacagtttatatagtctcacacagggccggtcatttctatgtccttatattgtgctttggttagaaaccaaagagcaagagatgaggtcactggcagctgctcagggccttatggggacagctccttagcagatccctttaccctgggctccttggctctgtagctccagcaacctcatttatttggtcactccactggcctaggtggggagtattaacatgaaggtcatgcatgtgattcaggacaccaccttctaggcagccaaacacttggccatctcaggtgatacccagaggttgcttgatgagcaaggaccagctcagaaccaagcagggaaggtgggtggctctgagggacattccatccaggacttgcttgactttgctcagccagccccagctcctgagcatataacaacatgcctatgtacagcacagagcctctttctaagataatgctagacttgcactccacactcactcattcactctttgagctccccgctttctagaggatgtactgacccagctatctcttttgctgagggctgaagttgctttggtattcgatttggtatgtccctagatcatcttcctcccccactgacaggtggttaatttcattcacagcaggtctagagttttccctaaaattttgggaatactttgcctccccacactaaacacgtgtttgtttagtgttgaactttgtcacagcttgagtaggcacagagctggcgggggcatggctggaggctggaacctaagactcttgagttggagagtggttaactttcagacctctgctgctcaacactgtaggacctggccagttccctgaacatctcagggctcagtttcttctttgcaacttaaaagtgagaacctaccaaggttgttttgtgtcccaattgagatatgagaggacttcaaaagccagcctcatggcattagcacaattggtgccacatggaatggtacacgtgggccaggttcctgaatcgccgctgggatatgtccagttctacctacctgtaacacaagtatgaacaaacacatcccagcagtgtgtgagtgttcctctgtaccgttgggttcatttctagataaacaacccagacatgcgagtgcagatcctcaaagattacgtcaggcagcacttccctgccactcctctgctcgattatgcactggaagtagagaagattaccacctcgaaggtaacaaagaaaaaacttcctaattccctcacgttggacaagtttattggaggaaataggagccacgttacattttgattatgcagctaaaagcaaacctagttttctagaaatgttatttttgtttcataactaaatttaacagacatgcactaaatgtcaactaggtgttgggtactttgctagatgctgggaattgaactgagtcagacacagtgtcgaccagtggggctggtagaaggtttttaaatgatggtcacaattcgtagtaatggtagtgacagtggaaaattatgaagaaaaaatgagaaataatgataaatgctttgaatttttttgccttcccagaagccaaatcttatcctgaatgtagatggtctcatcggagtcgcatttgtagacatgcttagaaactgtgggtcctttactcggtgagcattgcagctgttttcttcttcattaagtttgttgatttttgttgtttcctccaaactataaaagtaatgcatactcataatagaatatttgaaaaataaggagaggtataaagaagaaaacaaaaattgcctgtaatgctaccacccagagcaccccttttcttctcattcttgggcagtagtagtactgtctgtggggaggagggcagtcacgtgagccttttaaaactacaagttgatgtgtgttgcagggaggaagctgatgaatatattgacattggagccctcaatggcatctttgtgctgggaaggagtatggggttcattggtgagtccattcgttgttgttttaagtgtttttttttaaaccccacggttcagctacaccacttacccatggggttgagtttctttttctttctttttttttttttttaattttctttttgtggttcagtttctacagaagaaatgtcatatcctcttaatcattgttcttaatctttcctttcttactttaacctttccccttatctttatcattgttcctttgttcttagaaatgattgctagcccaggaaaattttttttttttttttttttgagactgagtcttgctctgtcaccaggctggagtgcagtggcgcggtctcagctcactgcaacctctgcctcccgggttcaagcgattctcctgcctcagcctcccaagcagctgggactacaggcgcatgccaccacgcctggctaattttttgtatttttagtagagacggggtttcaccatgttagccaggatggtctcgatctcccaacctcgtgatctgcccacctcggcctcccaaagtgctgggattacaggcgtgaaccaccgtgcccggcctatttttattatttattttattttattttttccctttaaaattttgttttaatttaaaggaaaatagaatcagatccagcagctcccttgtacaaagtccgcctcatctacctatacagtggatttggactaaacttcccactgctttgtgtctactttttttgtgtgttagaaagatttcccttccttagcctcttcctctcaccaggcttatgaagctctaataaaaaagatgtgtttgcttcattttaggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggagggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaacagtttcagtatatatggttttaaaaatgctcatctacggtcaggcgtggtggctcatgcctgtaatcccagcactttgggaggccgaggcgggtggatcacgaggtcagcagatcgagaccatcctggctaacacggtgaaaccccgtctctattaaaaatacaaaaacttagccaggcatggtggcgggcgcctgtagtcccagctactccggaggctgaggcaggagaatggcgtgaacccgggaggcggaggttgcagtgagccgagacccgcgccactgcactccagcctgggcgacagagcgagactccgtctcaaaaaaaaaaaaaaaaaaaattagcctggagtggtggcgggcgcctgtagtcccagctactcgggaggctgaggcacaagaatcgcttgaacccgggcggcggaggttgcaataagcgaagagcgcgccactgcactccagcctgggcgacagagcgagactccgtctcaaaaaaaaaaaaaaaaaaaattagcctggagtggtggcgggcgcctgtagtcccagctactcgggaggctgaggcacaagaatcgcttgaacccgggcggcggaggttgcaataagcgaagagcgcgccactgcactccagcctgggcgacagagcgagactccgtctcaaaaaaaaaaacaacaaaaaacccaaaacaaaacaaaaacaaaaagaaacaaaaaaaacggataacgagtaactcattcatccctcatccacttagctggggctagatcttataaaaatcctgtattgccactcaaggctttaacaacaggtgatggtctaaggtggctttactcgacaaaatgactgcagagagcatgctacccactaaggaaaggaagcgagccatactcgcaccgacgccctgggggtaggcctggggcgaagtcttctggactgggcgactgttactgacggacctcaccaaggcaggcagagctgctggaggcgaggcggcgctgctggaggcgaggcggcgcatgtgcggccggcgggcgacctggccccgccccgcgcgcactatttaatcccagaatccctctgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgca

SEQ ID NO: 11893 - DNA, 45365 bp, Human
gacagagtctcactctattgcccaggctagagtgcagtggtgtgatctcagctcactgcaacctcagcctcccggattcaagtgattctcctgccccagcctcccaggtagctgggattacaggctcccaccaccacacctggctaatttttgtatttttagtagatatggggtttcaccacattgaccaggctggtctcgaactcctgatctcaagtgatctgcccacctcagcctcccaaagtggtgggattacaggcgtgagccaccatgcccagcctatttgcgcatgtttcctactgccggaagaaggaacagttctcccatataccacattccagggcatcctatgatcacataagaacacaatcctcctgccacaggtaagcgcaatgtaccaggaaacaggttgcgggtaaaccattgttctccctctgccattatgatagaaatatcatgacaggcagctctgcccccaaatcttgcaaaatctcaatgtgcacctcaagtttgtattgttttagcctatgatggaactgacaggttggggaaaatggaaagcaaagttccatcagtctggatcgccttttgtagtgtccccagtgagatcatagctggagaggcaaggatgtaactcactcaaaatttaaggcttatggccaaagttgatgactaataatatagaattgtaggtttgggctttttgctttcttaaaaaactctgtcaggtttggaaagggacctccaatctaattttgagataccacaggtaatgtccaattgtcttaaggtgtgactaaaatttttcttttgtttgttttttgttgttgtttgtttgttttgctgtgttttgagatggagtcttgctctgtcactcaggctggagtgcagtggcacaatctcggctcactgcaacctccacctcctgggttcaagtgactctcctgcctcgcctcccaggtagctgggactataggcatgtgccaccacgccaggctaattttttttttttgtatttttagtagagatggggtttcaccatgctggccaggctggtcttaactcctgacctcaagtgatctgcccacctcggcctcccaaagtgctgggattacagacatgagccaccacgcccagcctaaaatttttcaaaataaacttgctgttacttttcttctttaatttaaaaaatacctctataggctacatgagagtttttgaaaaagtagccatgtttggcatggaaataggccccaaatatgtcaacacctgtatttccttccagatttcagtcctacaactttggactcccaacagattaagaatcactggtctaaggtttctaaagtcagggtagatccctttcccaagtgacagccacaaatccaacgctgtatcataccctatctaaagaaaagataaaagtaaactggcttggcacagtggctcatgcctgtaatctcagcactttgggaggccaaggcaggcggatcatgcggttaggagttggagaccagcctaaccaacatggtgaaaccccgtctctactaaaaatacaaaaattcgccgggtgtggtggtgcacgcctgtaatcccagctactcaggaagactgaagcaggagaattgcttgaacctgggaggcggagtttgcagtgagctgagattgtgccactgtgctccagcctggatgacagagcaagactctgtctcaaaaaaaaaaaacaaaaaacaaagataaaagtaaactgaaaacaaggatagaaatgtctgctaacatgctctgtgaccttgatcaacagctttccccgctcttggccttggtgtcctaacttaaatggggaaactgtgatctctctcagctcaaaatttacatgacattatttacataccaaacctgccctacgcttcctggaaactttactacttatgagtgtggctcctccttccctttcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtaagtagacttttctcattgctttttccttaaaactgtgttcccagcaaagtctgataaggcaagcgtcaggtttcatcttatccttggattgtttcccagagaccaggctctgttcaaactcagaaagtgaataatcaagttttgcaagttcctcttaatgaagacctaacgtgtcctaacaaaaatattttttggtcgctgtttttttaggggttgctttttatttgcttttgctgatgttatttatttacttactttacaactgccttgaattcagattccttttgacagccacaccagtccagaagaaaccacagctggcgctgtttatgtaccaagagctggcttcattcaatttaatcattatttgtttgcaagccaaaaaacagtcattttctgaattaagtagtcctttcacctttgtttatcaggaaattagaacaactatttgtaaacaaccttgaagcataaaagtgaatctaaatttggaattttaggatgattttctgatatatagatttagttgacgattaaaatcattggcacatgtgaccagttatgaaaaaaggtggggggtggctgatgcataatatcaagaaaagaaaatatactgttgacattgtttgaaaatagatggaaagagggtttgcaaagtgaaggggattcatcatgttacctaagagtctgattttctgtttctgtatctttttttccttctgtttcactctttctctgcctctaagcctctaagctgcttcttgcctttcctctctcgttttctttctcttccctacatttttttatttgagatagtgaaagtgggctgataagtaggtaaattttctttctgtcaagaatactcaaaaattatttttataatttgaaggaaagtcactgtttccttaaaaattaaagttcaggcttttttttttttcagcatgggatattcaaagctctttactttctacagaaaatatgatacccatgtgcttatttgaatcattattcttatagtccagtaaatccttactaggtcatgagtcaacaatgacagaaaacccagtgaaacaaactatcaatttatttacaaatgattcaccagctgtcagacttctgtgcagaaaaaaaatatataatactgtgtgccttctttagggaaacccatgtgagctaggcttgtacttctatcagtagttttcttgctaacatgtgcatgaggcaagtttagggactgtagaaattgtactgcatctgccgtgcttgtaatactgtaaacctgtgacaagctggttgagtggcagtcctctgagaaatccaagttactccaagctcactgtacatgatgtattccctcctccatgttttacccaagttagcccaggctaacttcctttgactaccaaattgttgtgggtttcctatattcagggactgcaagttaattctttcctgaggaaagccaaaatacaaagctagctctcttagaactaaaaaaattaacaaatattgcacaaagccagtgttaactattttttcctaccatgatttccttccattaatggtagatgaagggccatttaatacatctttcttggcccttataaaacaacgtccatctaagtacttaagccaataaacatcagtttcttatttttattgactaaagagaatatttgactataagtggttaatttatacaaatgagataactcttagaaaattattaggagaaccagaattgttttaaaagatgcccataactaaagtggtaatattaatgataataaccaatagtcaattgagtgcttactgcaagtacttactgcaattgagtgcttacaaggcactgttctgagtgttcaatatgaattgtatcacataagcctgtcaacaatcctctaaaataaggtcgttaaataaaatatgggatgaccatttgaatttgaacttcagataaatagcaaataattttttagtcccatgcaatatttgggcatcctgtatgtttatttgccaaatctggcaaccattctataaagttttgtaaaacttattattcctattttatagatgaagaaattgaggcacaaaaaggttaagcatcttgcccatggtcacacagatggaatggtggagacagaatttgaacccaggctctctgaccccggatgcctttccctttatcactagacatggtcttttcctgctgtgtgtatataacccagcacatggagctagtctgagatccccctgtaaggtttgctggattagcttgactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacgcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaaccagcttcaaagactatcacccatgcaatcttgtttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggttttttttttttttttgagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataatatgatattcttgatggaagcagcctccaaattctcagcacataatctatatactggaatgggtaacttccacattatggacatgaaggacctcctagctactagggaaggtggagctagaggatcacttgagcacagcagtgtgaggccacattgagctaggatcacaccattgcactccagcctggacaacagggaaaaaccctgtcgcttgggttggcttataaaaagaggtaccagaggctgggtgcagcaactcacacctgtaatcccagcactttggaaagccgaaacagaaggattgcttgaggccaggagtgcaagactccaggctggttaacatagtaagacctcatctctgcaaaaaagaaaaaaaaaaaagatggaccagataaaattccactgaaaagcaaaaatcaggtctcctgcctcagttcacaaacaaccttacatacaatctctctcccttgctgtatggctcctaatcactgtatccaaggaacagccaagctgtctggagaccacaggtttttcaaagacatttgccggaaacagcaccgtgcgctgagagttggtactgagccaggctcagttcagtttgcttacatgagcttctccccagatttatgccaatgcatttcacaaattttcagggtgcatttggccaagacatttcagccaaccaggttattcctgtgggtgcttctcagtatcctaaatgcaaaggaataattaattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataataaatcccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcacccagcaggaccttgacaaagcaggagtttgaacccaggtctaaccaactgaaaacccagaccttttctgatatatcacacatcttctacacaacataatacacagtttttacagcttcccttatttgcaggcctctgtgttcgtcccagtctctggatcaaagtcttattagacttgtcctgattgcttcacggggagtacagaacatattctcatgctgattcctttcaaggtcagccagctttccttctaacctctgaaatgacactcatttacattactcaattatttctgcccaaactattttatttttaattttctttaccaatggatttatttcttaggtcctaaaagaagaaaataaaatagacttctactcatagttatctttgtgcatcacgagattttcacaacttagagtataccctaataaaataataagaagaatttaatgtcaggagataaggttccttttaggacttccagaatcaccccaaagttttatgatgtgtctccaattccaaacctgaaaggagaacatgatggtttatgagacttcaatccagtctggaagcagactcactgttctagaagcaaaggcacaaatgaataggatagagactgctacaatttgaatgtttgtcccctccaaaactcatgttgaaacttaatcccaatgtaacagccttaagaggtggggcctttaagaggtgattgggccatgggggctctactctcctgatggattaatggattaacagattaatggattaataggttatcacagaagtgggtgagttatcatgtcagtgagtctatcataaaaaccattttggctctcagtgtgccccttcttgtcctgtcatgccttctgccatgttatgacacagcacaaggccctcaccagaagctgactagatgcagctgcctgatcttggacttcctaacctctagaattgtgagcaaaataaacctctttcctttataaatttcccagtctcaggtattctgttaaagcaacagaaaatgggctaagacagaggggaaagacaagaagatgaaagaaaggaaaaaaaaaaagcacacatagcacaccttgctgataaataaggatgatgatcaaaaaccctcatgaaatgagaagattggaaagaaatccataatgtacctggaagtactagacccaatccgagattcacctgttcatcagaacaggccttttttgcatattactatgttccaggcactgttttggggttatagcagtgcttgtgacagcaaggcttctgctttcaaggagtttctagggacagggagggagccagattttttttaattttagtaaaaacaaaaaataagaaaacatcaggaatatttatttgaaataaaacagtgagataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacctttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagattcagtggagcaggttcattcatgggggcaccaaaccaaaagtccttttaaaaacagttacctatgatttaaaagtgtgaagtgattgtagtatgatggggaaacagtgggccaactatcatgagaattaggagatctggacagctacatgatctctttgatcatatagttttcttacttgctcagtgcagcagtagtgccaacctgtcctcagacggggatgtaataattaaaagaggtagcaggggaaaattctacaaaccatggagggttgtgcaaatgtaaggaattattatttttttttatttttatttatttattttgagacggagtctcactctgtcaccaggctgaagtgcagtggcacgatctcggcttactgcaacctctgcctcccaggttcaagtgattctcctgcctcagtctcccgagtagctgggactacaggcatgcgccaccacacccagctaatttttgtatttttagtagagatggggtttcaccatgttggccaggatagtcttgatctcctgacctcatgatccgcctgcctcagcctcccaaagtgctgggattataggcatgagccactgtgcctggccaggaattgttattatcttggatgtctttctattacaattaccactactactgcaaaaatcctaattgctaataaagtatttttaggtttttaaaggatttcatagagtatgattgctggactgagcacagaggtaataattggtagagcagcagttaagaagattgctctaccacagaattaaaagaatgtcttcgcatagtccaagaactccagctgaattttgaaactccaaaagctcaaggaacaccagcttcacatttgcctgcgggaggggtgtgtgcacacattttgatttccagccctggaagtggagaatggtttattaagtgtttctccaggacatcccttccaaagggttgacagcatgtttgagcaactaccttggaaacacttaaaacctactgaaatgtaggggagtacaattatttctgaactatgggccagagtgagaaagtttgcccaagtctcatgattatgttccagttctctgctcttcaaaacactctgctaaggtgaccacacttgtttttctctctcaggccattctgtcatttagttgcataacctcagttctattctttcaataatatacatagttcacagtgccttcggggtagtttccgtatcaaggttttggtttcttctgatacaaaacacacacacacacacacacacacacacacacacacacacaccccttccaatcctagaggaaaagagtatactaagtagagttaataaagaagcgttagatcccagaccattcagatttagctggtgggactgtgaggagtgtgatcatacagaaatgaacctctcacaggtggttaagtatgctggagttggaggcacagcctgtgtttgaatatcagctctaccacttcttacatgctgtgtgagtttagacaggtcacttaattaagctaaacttcctcatttgtgaaatggaaataataatagtaactgctttgtggaactgatgagaagattacatctatgagaagcacttagcacagtttccaggacaaagtgagtgttcaaaaaatgttaaggagttaccgttgtggttataggttggtgggaagcaatgtaaattattttattacaatgtctctcacctgacttctctttggctaactcagtggctctcaacttggggtgattttctgcccctatggcagaaaatgtgcctttttcagttgtcacagctggggaatgttactggcatccggtgggtaaaggctagggatgctgctagacattctacaatgcacaggacaacccccacaacaaagaattatctagcccaaaatgtcaacaatgctgaggttgagaagccctagaaactaaaacagtgtggggtttgtaatttattgaaaccatgtaacaactttagttattcaaagacacatttacctgggatataaaaactctaaaatgtacttcaattgtggaaagaggcatcaatgattaaccataatcatttctgatcatgaccaagtcacccctgagactagtaactgcaggtgctcacaaaaaaatatgcagctgtccttcctgccttcaggggatcattcatgaaagtaatttctcacctgaccaaaatgatcgcttaacatttattgcatcattgcccctgtttctgtagactactctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatacaaagattagctgggtgtggtggcgtgtgcctgtaatcccagcttctcgggaggctgaggcatgagaatcacttgaacctgggaggcagaggctacagcgagccaagatggtgccattgcactccagcctagatgacagagcaagactcagtctcgaaaaaaaaaaaaaagttatactagttgggcacggtggctcacacctgtaatcccagcactttggaaggccgaggcaagtggaccacctgaggtcaggagttcaagaccagcctggccaacatggtgaaactccatctctactaaaaataaaaaaattagctgggcgtggtggcaagcgcctgtagtcccagctactcaggcggctgaggcaggagaattgcttgaacctgggattcgccactgcactccagcctgggcaacagagcaagacactgtttcaaaaaaaaaaaaagttataccactattactgtaatcattaagggaagaatacttctcatcagagtttgtctgcagtaaagtactcttgtcagctttgtgttcctttctgtcctatcttatgtacaaaccgatctccattatgtgtcacctgccttctaatggctgatcatcttgattcttacattacctgaaacacagtgaaagtgttagtgaacttagaatagtggttcttaactagagatttacccagggagattttttaaatcctgatgtcctggccacatcccagactaattaaataaaaatcactaaggttgaaagccagtcctcagaatcttttaaaactccttacgtgattacaatgggaagccaaagttaaaaccaatgagttagaaaaaaaaaaactattataatgagcagaagcaaaacacccaagtgacgtttgtaacatcactctctcacatctactttcaggtgtttcggcatggagaccgaagtcccattgacacctttcccactgaccccataaaggaatcctcatggccacaaggatttggccaactcacccaggttggttggacttttagctaaagattgttgatgaagctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgaggtaggagaatcgcttgaacctgggaagtggaggttgcagtgagccaagatcgcaccattgcactccagcctgggcaacaagagtaaaactctatctcaaaaaaaaaaaaaaaaaaaaaaagattcttgatgagtctcaaggggaaatgtatatagaattgtctgttttgatattttttgcccttctggctttatttaaatgtaagagatgtacatgaacaaagactatatgagcttagaaatgctgaagagagccaagtggtaatcataagccaggatttgaatttcttaggcttcacatgagaaagtgaaaaatagtcttgtaatcaataagctgaatcaacagcattgggaaacatgattccccaaagtgctgatatcagaatatgatttcttgtcagctggatatattgggatttgaccttccttataagtggtcagttaaacacagggagccctactttctgaagagcatctaaggagaaggtgaactggggagcaaagccatctttagtcactgttccaaagccctattccctttgcttgtaagattggatgactcttctgtttggagccacaaggccaggtgaattgcttctgtcctgatctgtttaaatatattaattaagaaaatgtcacagaatctttagagtagaatgtctcaaaaactaatgggtcttaatcctgccaaaacattgggattatctggagaggtttaaaaaatatattgatgtctgcctgggaggttcttatttaattggtctagtatgtgtcctgggcattgggatttttagaagctccttggtgatcagttcactctaatgtgtagccgaggctgagaatttctgccctgactatatttcatagaggagaaaactcaggcaggctatttgagaccagcatcttctgtctcccaggtcaaagctcttctcaccatagcctacccatcttctgtccctttgaatgaaagagaggctacaaaaattcagatttgcttgttaatacctatggctctgtatagactcctgttctgttgctatgttttcccattaagaccaaaagattcttctaggctgcaggatctgagttcttcttctgaagaaccttgattacccatcagattctattagggcagtatttctcaagcttccatgtgcaaatgaatcacttgggaatcttgtcaaaatgcagattctaattcagcaggtctgatgtgggacctgcgattctgcatgtctaacatactcccaaggatgacaatggcactggtacatggaccacatttgaagtgacaaggttctagggctcagattcctacccttgtctaggtacttttttttttttttttttttttgagatggagtctcactctgtccccgcaggctggagtgcagtggctcgatctcagctcactgcagcctctgcctcccagattcaagcaattctcgtgcctcagcctcccaagtagctggaactacaggagagcaccaccacgcctggctaattttttatatttttagtagagatggggtttcgccatgttgccaaggctggtctcaaactcctgagctcaggcaatccacccgccttggcctcccaaagtgctagaatttcaggcctgagccaccacacccagccttgtctaggtactttaaatctacataatcataagatgatggctgtctagatcagtgtctaggtacttttaatctgccttgtctaggtatttttaatctgcataatcataagatgatggctgtctagatcagtggtttttaaagtgtggtccctggaccagcagcatcaccatcacgtgggaacttctcagtaatgtaaattcttcacgcaatacccagtgaaccataaactttggaattaaagcccagaagtctgtgttttattgagtcctccaggtgattctgtgcatgctaaagtgtgaaaatcactgcttcatacagacgactatttaaaaagtcagctgtaagaacacaattagacctaaagtacctgcttctccgctactcaggtcacggtatattattcctttcccaccttgtccctatcgtagatgggaagtgattatagtggtggtcaagcaaatgacaagtgtgacaagcaaatgacaagtgggaccaagcagcagccaccgtaacaacctcctctctggctcccaaagctctagtaaggctctggattaaagacaaacttgaatgctgcatttccaaagcatggtgctctactacatgcatctgaatcacttgggagacttgttaaaatgcagatgtcagggccccactcaggaactaatgagctggaatctctgatggagatgctgaggaatctgcatttcaacatgcaccgctggataattttgtttctgatgcacggtaatggttgtggaccactgagctaatgcagtgcatctcagtgattactgtccatcagaagcttgttaaaaaatattcttgagcaccacccccaaaggttctggttcagtaggtcaagggtggggcccaagaatttgatttctataatgcttttaagtgaagccaatacagaccacacttagagtaacatgttctaatttttttatgaaccaggaattaataaactgggcagatagtaaagcattgcccacagaggttgaaagagactttcagattcatcgagtctaatctcatcagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcagggaactgtaactaaagagtacagctcttttgttttcacttaaatatgtgtcattattgtggaactattaaaccacaccattgttcattctacacacataatgaaaaaaaaaatcaacaaatttttatgatagtgtgattcatagaacttactttcattaatttttgcttttatttttttcccatagctgggcatggagcagcattatgaacttggagagtatataagaaagagatatagaaaattcttgaatgagtcctataaacatgaacaggcaagttggggagccaagagtgggaactttgatctttgaaataattaaaataattctgcatatataaaagtgctttgcctgttttccaaggaacttatacaagtcagaggtcttgtttacaaatatattcctctttatgcaaatttttgttccaaaaagtttgtgaatatgagtaatttcaagattttatgaacacctgaataaatactttggcttgacaagtagccactgcttaattgatctcatttgtcaattcaactattggccaaccaggttgctttgtaccatgatcataatattgctcattccttaacaagtattatgattctgatgttagcacaatgtctgtaatatttcactgtgggtgtcctttcctttctctaataccttggcagctctgtagaaaaaaacctcatgctccctttacgttcgcttctgctttgattttcctactctaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggtcagtatactgggaaaaccaggagatttcagatggacctagaatgaggaaggcaggctactcaacagttgtggatttgggagtctggacactccttgagctgtgcagttttaattctttcttaaataaagatacaaaggacaatttaggacatggaaaaccctagctaagagagagtaggaaccaaatttctctttggatctgtatgatccactttgttttgccactcttgcaactcttggcaatttgccccctcatcgtcatacacagagagagagagagagggagagggagatagacaagtcccccagtgttctgccttaattcccaggcttttggtgccccaaacaggtttctccactctccagattatccaaagatatttataccaccaaacactcctccactcatgaaaatccacattcctaggtagagaaaaaaagatttgagtgcataatcattgcctaacattttatgtgaatcattgtgttacctttcataacaactctgaatggacaatattcttgctctccttttatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccgagatcgcaccgttgcactccagcttgggcaacaagagcgaaattccgtctcaaaaataaataaaaaacaaaacaaaacaaagactggatagcagcaccaaaatttagcaaaatgtagaccacaacagctatttaacaattaatcctgaatgatagtaattaagttacacagaaagagaatgcaggtgctagtagaagaggaggaaagaaacagggagagtgagggagagaaagagagaagcaaggaacattatctacctatggcttccatctatctgattcactaaggtcaaaaaaattctctcatatcaactaagaaatctaatgaaaccaatcaacactagcttattcctagcatttagctgtgctgaatgctgtagagaaataggaggcgaagtttttctaatttatagtttgatgaaagcaaattagcatgtgtgaaatgtgtagaagacattataagatggcgggcaataatttcaagtacaagccacatatgctgggtgaagtcagagaatgagacttacgtgcagttaccacagggccgtcgttcaggtcttcataaagagagtgagaacttgaaccagacctcagaggagagggaggaaggagaggaaggcagcacaaaaacacgaccatgagtgaatatgtagaatgccagttcttctgtgcccagagttcatatttagaaagagaatgaaaataaaattgattatattggacacagattagataatccaaatttaatagccaggaggaatcttgagttgaaagaaaggcagtgtgatgttagaaggagggctgaatttgaagttggaaaacctacatccaactaccacttcagatatatgaccttgagtaacctccgtaaacctcagtttcctttctgtaacatgggaaaatagcacccacctaacttcttcttagggatttgtgaaagtcaagttagttaaaaaatggaaaacaccataaactgcaaaattctggacagatgtctcggtgattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacacaaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttataggaaatagatgataaagaagtaaaataaaataatgtcagatggcgatgagttcctggaaagaaatgaaacaggttaatatgatagagactggcccaggatggctagaagaggggtagaagtcaatgggggagtgttcaaggcaggaaacagttttaggcagagctcctaagccagtgccttccgggacagcaagaaggcccaaagtgttgctggagaggagtgacaagggacagtaataggaaaagagggcagtgcagttcctagaggccaactcatgcaaactcttgatgtagtctgtgtggtggtgagttttgattttattttaggtaaaatggaaagccaatgaaggtcatgaaccacaaaatgacatgatctgatcgatactttaaaaagattcatgcttaaaaaataataataggccgggcgcggtggctcacgcctgtaatcccagcactttgggaggccaaggcaggtggatcacgaggtcaggagatcgagaccatcctggctaacacagtgaaaccccgtctctactaaaagtacaaaaaattagccaggcgtggtggcaggcgcctgtagtcccagctactcaggagagtgaggaaggagaatggcgtgaacctgggaagcagagcttgcaatgagccgagatcgcgccactgcactccagcctgggtgacagagcaagactctgtctcaaaacataataataataataaaaggtattagtgtaactgctgtgtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccactagcaaaagcagagaaaattacaaagagggaatggttaaaaatgaagttgaattcattttaatatgatagaggctggggaaggatggctagaagagaagtagaagtcagttggggagtgttcaaggcagggaacagttttatgcagagatcctaagcctatgccttcagggacagcaagaaggcccttgtaacatgtacaagtttagccttgtacatgttaaatttgagggaaaaaaaatgcaaattagttatttctaccaagggctagaaatacaggactagtcacagatggaaagtaagggcaacaaaataaacttgagagccacaaacctgtgggttacagttaaaattataaaacactgtcaaaatttaattaattttaggaagttcactttgtcctcacaacaggtttttgaagtatatttttctaagtatttaatacgtactcttaacagtctgcaaatttgcaaaacctgaagttaatgagtggttaattgacttaagattttttccagaatcaaattcctttctccatacatacatgcgttggggtgtgtgtgtgtgtgtgtgtgtgtgtgtgtgtgtgtacaggtgtgcacctactgcaagaaatgaaagtgattgggaaggaagcaagataacagttattcacgtggaagatcgagaagtgtaaatatttaccaccaacagctcagttatattatggcaagtttatgaatgaaaaaaaggattttcaattctgaatacatatcctactattttaagacctatagatcatttgattctttctccccaattttggaatttccactcagctcaaaacacatttgaatcttttattaaggttgctttgaacctaatgaggcttaaaatattgctgcagcatatttagcaaagtttttctgactcataacagttttatgatttttctcttatcctcagttgctatacctgcctttcaggaactgccctcgttttcaagaacttgagagtgagactttgaaatcagaggaattccagaagaggctgcacccttataaggttaaaagctagttttgtttagtggtacttgttagtttgttagtggtacttgagtgtgagggccaagacacaagatgaagctttggcttcttaaaaagatgggacgaatgcatctgtcagtggctggttacagcaatgggttagaatatttaatgagggaggtcatcactcctgcttcccttccccatacaggggtcacaagccaatagacaagccagtccttttgaatcctttactcatggccttgagaggaaccaggtgtgagtaaatggctggatgagaataaatataagtctaaaatcacctgccttattcaggctaaggggctgggattattgtcttcatatacaaaggatagtcttttttttttgtttctattttgcaaagtacccattttcagcacaatacaaaaggtagatataatgctgtgtactttttaaaataatcttttgaatattatacattcatactgtccaaaaattagaaaatataaaaaggaatacagtggaagcctccatgaccccacaggtaaccactagcattattttctagtagtcttttatgtgtttattttatgcagtcttttatgtattttatgtagtattttatgcagtcttccaatttccttatgcatatacaaacataaaaatatattctgatagtttcttcttttgttacacgaaaatggtatactattcatagggttgggcaccttggttttgttttgtttttttttttccatttaagaaaatatattggaaatatttctatatctgtatgtaaagagtttcctccttttctttcttttccttttttttaacaaatgtgtaatatttatatttatgccataatttatttaaccagcccctattgataggaatatgggtcatttttcaatctttcatttttacaaacagcatgtatgaataacttgtgcatctaaatagtttcacaagaatacctgtgggataatatcctagaagtagacattctgggttaatctgaaatattattaatttaccctccaaagaggttttactactttctacttctatcagcactgcatgcaaatgcccatttctccacaactttgccaacagtatgtggaccactctggggatatttgccaatctggtaagtggaaaataatatcactagaagcatccatctcctctaaaattaggaataagacaaggaagctcactattataactactgtacaacatcgtgctatagtacttttcttcttgtgatgagtgagtttgggtatcttcatctagttaaataccattttttggtttgttttttgatattgtatttcttttttaacttttattttaagttcaggggtacaaatgcaggtttgttatataggtaaacatgtgtcatgggggtttgttgtacagattatttcatcacccaggtataaagcctagtactcattggttatttttcctgaccctttgcctcctcccacccttcaccttccaagaggccccagtgtgtcttcttcccctctatgtgtccgtgtattctcatcagttaaatgccatttatatttccttttatatcaatatcccttgactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataaggaaaaggtcaaggagcttgcctgccttcttcaggaccaccacattccaggaacctctaagtgttcagctctctgaaggctctctgaaccctctccctttgggctttttatggagatttcattgcataggcatgattgattaagccacaggctattggctatcaacttaaattttaactccctcccctccccagaggttctgaagtagggctgaaagtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaaaaaaaagaccaaatatatatttcacaatatcatagataatgaatggcatttttaaaaaaaagtttgtctattaactgcttaccgtgttcttgccatgtaggttctgtatcaatgtattcttatatggcttctatattttgagtcatgtttagaaaagctttccccactcctaggttataaaggaagtctgcaatgctttcttctaattccactctagcttcatttctcatttatatattgaattcatttacagttcatactggtagaaggtatcctgtttaagttttttcctggaagattatctaattgctccatcattgtttattgaatagttcatttttttcctacttattgaagctattatatattaaaattcccataggtgtggggtctatttatgtaatttttattctgtttaattttttattagccaaaacttgggttttaactattaagactttataatatgctttaatatctaaagggctagtcatccctcattgctttttctgagtttccatggctatgttttaattttctttgtgaacttcagagtcagcttgtctagttccaaaagtattttttaatttttagtattttcattaggatcatattaaatttatttaacttagggagaatttgcaacttttcactgtcaaatcttcctaagaatatggtacatgttcctacttgttttatcttaaagattattttagggttttcttcatatatgtctttacattttttgttaagtttgtttcaggtttacagtatctccagttttcaaaaatgtgtatctctgatttcttccttttgcctatttgcactggccactacttacagtataatgttatgggcagtgttggtagcgggtattcttgtcttatttctgattttagaggagttttcctaataagcatacaggcttttgaaccaaaatagacatatttttatgaaattaaggaaatatccacctttcttattttcttgagtgtatttttttaaatcaatattagttgtttaatctcctgaatgattgttttaacattttttaatacaatcaaattatttttctccttggattaattacaatgattgattacattcatagatttaccaatgttgaacaatctttatatttctcaaatcaaacccatttccttttatgtgacattgaattacttcctgttattttacttacaccttttgcattgatatttacaagtggcattgaactaatagttttattttgggggcaatctttgtcagtatcagtgttacacttaattcataagaagtttttgaaagttttctttcatcttctatgctccagaacagttaaaatagcattagaataatttactcttgaaaagcttggtagaattcctctatgacagtcatctggccctggagcttttatgtttgagaagatggcagtaggagctctttaacaataatttctattattttatgaaaatctattgaggttaatattggcaaattgtagttccctagaaatttcatccatcagacagacaatatcttccaaaaaggcttcccagaaatggctgccaatttcagcagtcagatagctgaacattgggtctcattattgcgacattccaagaaacatacagaacctagcgaaagatttgcattccatccaagttttatatgtatagccaaagaccaagccctatttgtgttgcatgttccaggatgctttggcctgaaatatgctttcctttctcacctgggacatatttacacatgagttatactttacccacttctaaaaagaatctgaggcagtacacttcaatccaattccagcacgaaccaggaacatgtggcagtcagccagcatctatctacattttaaatgtaataataaggaataatcaattcgtgtttgtaaaattctttggaatgacattatcgtaaccaatattactggtgcatttttctgtgaagaacagcggttctcaacaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaattgtctggcccaaaatatcaataatgctgaagctgagaaacctgtgtaggaatttttctttctctgtttgtgtttcaggattttatagctaccttgggaaaactttcaggattacatggccaggacctttttggaatttggagtaaagtctacgaccctttatattgtgaggtaaaagaaaaaaaaatcacaggttaacttgcaatctgattttatgatttatgcttattttgaaatagatgaatatcttttctttcacttctttatgaatgtattacttatacttcttttgacattgaaacgtaattcacaacttccttatattaacttgaaaatgctgacttctcttttctctctattattatttatgttttcaccctttagaaaattacaagcaaaattgcttttcttctatgagtttccactttagttttttccccccttggattcagtaggagcttatttattttgcagccactcaaaaatgctgggttcctgtccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctgcctttgaaactgggggactcctaatcaactcttcctaacgggtaataaatattggcacaaggtctcacctgccctgcttgtacttaaccattcatttaacgcatatttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgagctgtgatggccactgcattccagccttggtgacagagcaagacaatgtctctgaaaaaaaaaaaagaaaaaaaaagtcagcaaactagaccttgatgggggtaggggagaatatattactgaaggctccagaaatatattgcctttcctaactggcctctcaggcagcccattcagcttttaaggaaatatcatttaactctgtcaggttcatagaaagatttctaaccctttcataaaggaatgaggtattatttccctactgcacccttactctgcaaaatatgagccacccactgatccagagttaaaccaaaagctatggactgggtaggaatgggtaaattcatttatataagcttttcttctgaaagtcaataccactacttatcacaatatgaagttcttttagaaagaaatggcaggacaagaaagtctggccctactagttcttgtgaggtgaaaaaggataagtcaacaaagaggacagtcatataaatacacatacatttttcttcctttttctttgctacagagtgttcacaatttcactttaccctcctgggccactgaggacaccatgactaagttgagagaattgtcagaattgtccctcctgtccctctatggaattcacaagcagaaagagaaatctaggctccaagggggtaagtattaaaaaatgagaggagcatattggatttgtggttgaatgatccaggtctgagtcattccctccactaatcaactgtgtgatctcagacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgtcatatgttagtataatcataactattactcactcaagcccttagttttctatctggaaaatgaaagctaaagctaaatgatcctttccatcccctccagatcaaaaatcaaggatctgtgtctgagccacatgaaaatcaattgtgtcttgtggcctatatgatgaatttttcaagtgggaggtatgacaaaagtggcctgttttcctgaaaccctgagtggtagtcattgtgaaagccgataaaatatatttttcaggctaattgttatatttttcagaccaattatgtgctgttaaaatatgttgcaattgacaagtttataacacagcttgaaatttttcattgacattgaaagctgttgagatttatttatcagtgatgcctcttcttggttagaactggctcttcgtagcacaggacaccctgtcatatgaaggcagacccaggcaagaggatgctggattcttgtaatcaggataagtggatggaagaaaaaagtcaggaccagcaaagacaaggacagatgttggggcttatgagaaaaactggatgggcaggccaagataccaaatgaggtgtcagacttagatgtggttatcataggtattaaaactagggataaagaagaagagaaagttcatcatgtcaggttgacgtaatgaggaaagtccaagccacaggagatggtccaagtcaggctgacacacatattcaaggcattttgagattaatacaatcacatcatgattccagccattgacagacactattcaccacagcatcaggacaagtccatcaaaatcccaagagaatgcatagaggcaaagcatattagggctggaccagactgggaggttgttcactgaggctacttaactagggaaaaaattcaaatcactgaccagaaaaggaatcaattatagctagaaaagcagggctgcacaccaggtataaagagtgaggcaagctgtaaccaggggaatgaggtatgaaaccaggatggtcaggagcaaattcatgtgagatgaataaagtaggttggggcaaaaaatttaggacagtggccattaacgacatgaggttgttgtagatctgctattacaaaaatcctgattgcatggcacagagacagacttgatagaaatgtgcaagtccttacttcacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagttgcaagccccatcaaatggtggaagcgggactcttgatttatttcccccaacctagttatggtggattcaggcacctagtccctcacgactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagtttatgtcttcaggtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcctcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggataaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagtttaaaaaaaaaaaagtatgtaaatcacattacctagcacagagcagatgctcaataaaattagatctttgcccctcttcttaagtcatggcagggagagtccgcaactatgaagtgacaaaaagctaatgaactaaaatagaagcttatgtttggttcagtttggttattgattcatcttctttaaggtgtcctggtcaatgaaatcctcaatcacatgaagagagcaactcagataccaagctacaaaaaactcatcatgtattctgcggtaagtattttcatcttcatttaacatatgtttgttcaagtgtgtgatctcttgaagcacaggacctcatctttttttaatcttcatttccccatctccttgtacgtggtaggcacttgcacaaagcttttagaattaaatgcatcattctgtcctttaagggatttataatctaaactaacaagaagacaaacataaacactatacaaaatgggatggaaataccatgcaggcaagtgctatggcacctcagaaaatctagccatcccttctgttccaagagggtggagaagagaagcagaaaggcttcctagacaaggcagcacatccaacacatcaaaatgaaaggggttagtaagtgctcctcactagtgtgtaggacaaataaagtaaattattaggacagaagtggaaggccaggaatgttgtgtcgaaaaagtggtaccaaattagtggatgttaactgtgctgctcaatatggaacctagtagccagaagtagctacttacatttaaattaattatgattaagtagaatgaaaaattaagtccctcggttgtattagccacatttcaggtgttcaatagccatatatagccagtggctactgaattggagagcacagatatacaacatctccatcatcatggaaggttttttagatagccctgatatggagtgtcagaagtttatgctggatggcagctgaagggccatgttgtcctgctgcttctttgtttaattgtagaaagaagcaaggaagcaagggagaacccccctgtcagtgtttgctcagggaaggcagggcaggagtgacaggataggagcagcattttggaaattaattattttatagaataactggatgttgggaacaggatatggtgtagaaagcttttgtgatagtctagaaaaatggggatatggcctaaaattagggcagcggcaggagaggaaaagaagtgagccaggttacaagaaaagctgagtgtgcattctcagtgatgaattggaagtgggtggaagacaatgatgtggaaggtgaagccccagatgaagtcaagatttcagttttcagtggcaggaaggaggtggtcttgggccaggcaaatgtactgattaggcaatgggtttgaaatgccacaggggcatcccagcagaaaacttcagatggcaaagagaatagaaggaggaaagggaagaaggactgcaactcaaagttggagctacatttgggagtagaaagaaaagagagcaagagatcttagaaaaggctttcatcttggagaagccagggagagaagagtctgagacgccaaggagagacacagtgtttggggaaaattctgcaattgtattatacattcaaatagctgcccatggagtctgggatgagcagggaaacaggacatagcatgctgactcctttcactcacatctccatgacaaaaggtttctcagctgtggctggagaaagaaagtcatgttttcattcatgcaagaaggtgaaagaggtgactgaagatgccaggaagtttgtttattatcaggagccctaaatggtatagactagggaaataggcctgggcaggagcagagtgcttcctggagagagataggcctgaaattagtcatttctgccaattttcgtagtgtctaatctgatttctagttttaacttgtggtgtgacttccagcatgtcatatccgtagctcctttttttttttctctattagattacttctaacgccttttgaatatgtgcacgctgccatacagtttaggcagccaaatgttatcccaattttgcagatatggaagttgaggactgcctaagattagatagctaatcagtggcagaaagggggttgaaaaccactcccctataccttccagccactctggggtaaacatttagctttacaattattttaaattgcatcctatacttccttgtattttatcttccctaaacatttaaacctcatatattcttccacaactttaaatcacagatgatgctaatctatagaaaaatataatctagcattaatgtgtttcaaaatatttcaaaaaggcacagcacttaaggaggcttgattcaaatttactttcttccatttggggttatatgacattaagcaagttgcttaatttccctgggtctcaatttcttcatcttttattattatttttaaaattattttattttatcgagatggagtcccgctctgtcaccttctgagtgcagtggcacgatcttggctcactgcaacctctgcctcccgggttcaagcgattctcctgcctcagcctcccaagtagctggatttacaggcccatgccaccacacccagcttttttttttttttttagtagggatggggtttcaccatgttggtcatgctggtctcgaactcctgacctcaagtgatccacctgcctcgggctcccaaagtgctgggattacaggcatgagctaccacgcccagccaatttcttcatcttttaaatgaaaataatgatacatatctaaatcatactgcctagcacaccgctaatgctcaaccaaaatctttccttctctacttattaagtcattgtgggcgtatgggaaatttaattgaatcagaagccatcatggtgctgtacaagtgcttcatacctattgaatgtgaatctgaacaggcgataaaattgatttcaatctctgtagcatgacactactgtgagtggcctacagatggcgctagatgtttacaacggactccttcctccctatgcttcttgccacttgacggaattgtactttgagaaggggtaagtgactaagtgcttttcaaaatcagtatcactggaccttgggtttcattattattattttgggttaagggttgtgtgcctgtttgtctttgatttggttttatattcagagggaagaatggtggtaacaagatctttgctagtcatgtctcttttttctttttcatgaagacttttactggaaaataatatacacagtagatgaaaaaattgggaaatagcctatgtaacagaaattacatttttaaaaaaattaaggtattctaagaagtaggcatgtattgtatatatacttggcaagagaaaaatttcttgatggttatataataatattttttcaattaaagaattcaaacatattcattcagcttctgatgattcatatccacaagtcaagattcttaaagtacaatttctaactggtgtctacctctgtgtgacctggtgtggccctccccagatgaccacagcttagcttgaacccattagaagggtcaaagttagcgtagccaaatgtcccagttcaccagaattgacccatgaaatctggtgttctcagaacatgtgaatttcattgttaaaaccagaaatgtcctggaaaaactggggaagaattgattatcacaccaaggtcataccaaaaatatttatctgctgtgacaacgacattctcattgggaggagaagaaggaggtatttggaacaagtcaccagacttcatgggatattattagtgaaataagagcaaggaaagggctgagttaaggcagtgaccccagagtttgttttgggattagtcagggagatctattttgcccttccctcaaggcattcacaatagctgcacaccaacctgactgtgcagttacatggggacctggctcaaaagagcccatgcttgttttaatgatctgctgtggccatctttaaattgtaataatgtttaaacaatgggccctgtatttcatcttgcaaattttgtagtcttggatgtagctttctggcccctgaatttgtagagtaagaaagtaacagcacagagacttcattctcaaccaatatcttcactgcttacaaagaagtgagttctgcacagttagggacaggtagatacattctttattgaacctctaactgagtgtcaggcacaatgaactagaactaaaatgtggtcttagttaaccttgctctcaaatatctagagtcagcatggagaggtaagacccacaaaatggagactggccaaatagaacagaaaatgggaatgaaacgactagagacataaaaccctctcttaataacaagcccggcacaagtctgcccatcagaaggccagctctgggcacagagttaataaatccaaccaaattccaggatcagcttcaggagcaggcaccatctcctttgggataagacaagagaagctactgactctactcgtacctccctgttctctggtttctggaccccagtggtccagagcttgctttctcagtgcacagaagcattttctcccactgaattgccttgttttacgaccctgagttaaatctatattacaaatcaagtgtggagtattttttcaactgaaaggcagtgacatacagaaaaaattaaccaagggccacgtaaaggtcaagtccaatttgttgttgtattaggattttttttattggcactccagggaaatatcaaaggtgaaacgtgattgcttttaaattaggatcaaggaggcttcgagttaacgaattctgtctaagcctgcttattaggtgatcctgactgtgaagtgatctcacattttcttatgagaagatacggagagagacagaaagagagagtattttagattttcaaccatcttaaatacgtaaacttttcaggttgtagaaaaggtagctaaaaatattcttaaaagatttaattttgggttagatacagagatttaaaatcatagactatataaaataattcattaagttaatattgctttgtttcacttttacattttataaaatgattttatctaaactctttgtactcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggaggcagcaacccgcttatcaaccacgtcagccttttaaaggggacacatatcatttctgctcactttctactggctaaattagtgacttggtcctacctaggtacaacgtagtcttggcaatgtggtcacttctgagccataattcaattctatggaaagagaataacagagtttgatggagtattggtcatctaggccatatcatcttaagacagaagatgctgttactgaaaaagttattccaagatataagtacccattcataatacatattagggaggtttttgtaagttttatagacatcttattttattttatcttattttattttattttattttattttatttttattttattttattttatttttgagatggagtctcgctctgttgcccaggctagagtgtagtggcgtgatctcggctaactgcaacctccacctcccaggttcaagtgattctcccgccccagcctcccaaatagctgggactataggcatgtgccaccacacccagctaatttttgtatttttagtagagacggggtttcaccgtgttagccaggatggtctcgatctcctgacctcgtgatccacccgcctcgacctcccaaagtgctgggattacaggcgtgagccactgcgcccagccttatagacataagtgaatatttgctgttactatgtttatatggctttttaaagtgatgttttaaaaggcttgtttataatgacaaccaaaagtagccattgtaaggttacaccaaaagaaggatctctaaatccttcttgagttcccctcctgactccttgattagcaaatggcttccataagcaactcacgctggtttaactcaggttagtttacaccattggaccttcccaaatagtacattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagaggggagatacattcagaaagaggactgaaagaaatactcaagtaggaaaacagaaaaagaaaaaaaggagcaaatgagaagcctaaaaagaagggaggaggagaaggaaaacccaacacccccacctgcctcccacttcttatccaaaggctcaaagtcccacccagctccctgcaaccatcacttctcaccacctcctctgatttagcatcctggtgcctacctcctatgtccctgttcatctaacaaaccagccctcccatttccaccctgcaaatctctcccgcctgccccagtctccccatttacacacctaaattggctaaaatctccccataagtttttccattagtccctcaactggcatgtaatagtccaagtggaaagaaattcagtggcagttcaacaacacagaactaacagagctctctcctctgcctttgtctgccagggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctccctttgtgtttggggtttttgttttagtataacaagatggaaaatattaatataaagtaaaatgatttgactggcttaaatgaacattttacattgaaaatatagtttggactttaccacttcagataaaggtgaagctgtggatggctctgcctcatctatttaagatggaatttgctaaggaaacaccctcaggaagtgcacaatatactagggaagtaaagagatacatactgtacaacatggaaaaaccagggctatgtcttatgactacacagattactgtgggaacaagagttatccagatttggagtaggggaagtaaggaaggtcaggaaaggctttctgcagaaggtagcaactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttgcagtgagccgagatcgcgccactgcactccagcctgggcaacagagcgagactctgtctaaataaataaataaataaataaataaatttgttaccttttcccctgaccctactcttgtctatcttgatgagcagcaatacctggtaacttaggagttattttttaccctaccctctccttcattctccatagtctctcacctcctcttgtaaatctacctgtggtatgtttgcagaattctttccctcaaaacacaaataacaatatgcaggtagagtgaaatatgattaagcagcaaaaaatgttaatagaaagaaaaatgtaagggttgatgtgctgcagcccgctcatacagatctcaagagtggaatgtgtccatcagttcccaactctcagttcaaccacttcacctgggcagctccaatgtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatctagcaaataaaagtacaggatgccgagataaatttgacaaaaggctgtaactgccaagtttttgtaattcattggaaaaaaaaaaaaaaaacaatacaggacacttaggatgttctgaaaaagccgatacaggaagcaggacaaaatcattaaatataggatatgtcctatatatgcaagatactttgcaaccctactccttagagtaggggtttccacccattaaattctatccataactataagcagtgtttttagctagtgccagtaggctcacttaaccagattccagatcgtatcaattaaattcaccagagtctttgctggaaaattcacaagtctaaggccatagcacattgcttgaaaataataaaatttgtcaaactgcttctttaattccaacattttactaacacattcagactttcttcactagtgctctcccacccccatctcaatgtccaactctaattatttcacaagaaggagacttactagtgagaagtcccagttttc

SEQ ID NO: 11894 - DNA, 154605 bp, Human
tatgtggccttttttgtttggcttctttcactagcataacgtttcccgggttcctccacactgcagcatgcatcggtgctccattcctttttgtagccgaataatattccattgcatggacagatcacattttacttttattttctaattcaacagtgagacctggtgtgggccccggcgctgggcctgggaggcgagggaggggatggaagagagccccgtgactggcaggaggcactgtggagtgtggggagaaggggtcgggatctgcatgctagagagaataggattttatttacacgtggcaatgtttatggaggccaatgcacaactgccattatgggacgcggactcctttgaaagtctcatttgtgtaaaaggaaaagcagtagttcatgaggagggggagaagggctcaaggacagcaaggtaaactacccctggggcaggggaacgtggtcgtcggtgggcccagctttggaggctaggcccgtgaaggtcgccccgtgagcaggtccagggcaggccgagtgccccggggcccgcattcattgcttacagagcaaggggagcctcccgggagggaaatccaacggttggaaacttcgatttatcccaaaggcgtgccgagtgggaaggcaacattttgatttcccaaacgttgcggccagcggcttcttccacggcaggcgccttcaggtctctccgcagggtcgggaccccgggcggcgcgcggcctctgggacgccgagggaggccgggcccacagcgcccggagcgcggacagcggccacagcccgccgcctagaagcggcgccgcccggggcggggggcggagccgagcgcgcgccccgccccgccccgccccgccccgcagccccagcccagcgcgcgcaccaaggcggggcggcgcgcgggcccgtgcgcgtgtccggggccaggaggcggtggcggcgagcgcgggccgcgcgtgcgcgctgcggctgggcgaggggcggcgcgggcgcgcgtctgtcagtgacagcgggcggggcaggggccggagatggtggcggcggcagctcttccgacatgaggcagcggccgcgggggacacggcggcgggcgcggcggcggccgcatctctagctcggggaggcggcccccggcgtgggcgcgggcgggcgggcgtcccggccggcgtcgcgggagcccggctctgcggcagcgtctgcaccgccgcccggcgaggggcccgcgtccgtggttccacgcgctcggtcccgggacagctgcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccggggccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtccgtcccgagcggttctcgtgcgcctcgaaggtgggggcggtgggggcggtgggagcaccgctgagccgggaaccacaggaacagatggtgcctgtccaggtcgcgtgctggagccgccccttaggacaggagcaggtcccgggcctctaggcgtgcatgcctaggtgggagcgccgctaactctccccgttttgctggcaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtatgtgcactgctttacctcggcatcccccctccctgatcctgattgtattaaattaaaaaaaaaagcttccagcctcagtgtctgcagacagctcaggtatctcagaatgccttaccatggggggatctcagggtcagtgtgacttttctttcagcgggtcaaatatcacagatctgttcacactgcagaaagggacgctgtgcagagatgacctagacgcgacctttagaaggaaggagaactttgaacgtgcataaccactggttggctgaaatgtgggggcacgtccggtgaatgtaagggtatggagcccttcagcattcagcactgtttagcacttaaggaaattgcctttgcattcatttggtcaccctgaagtcccatccaaatgtttctctctgccctttttgcgaaaacgtggagaataaaatctttctcctctctaggcctcactttgcttatcctcaaaatagggataggaagtcggcgcagtcctgcaggtctctggagaattagacggagttacttacctctgagtacacactgtcttttatctaggtcttttttttttttaaaaaaaagtttgcattttcagctttcagccatcatttgtttaaggatattttattatcatagtatttgccttaagtgaagagcttcatattgagcttctccagccaccaggtgatttggaagggagaaacgtacctgccggagagctggtattcccctccctcatcctctcaggtttggatctggtgcctggtccctggtttgaagctccttactgctattcttgatgtttttactgggctgcttgttttttctaatataggacaaaagtctttgagatctggaaaatgatattaaaataagtaggacgaaaaagaaagattttaagtaatctgctacatttcttcccccacttcctcctttttaaacagtccttatgttttactaaaatcttcaggattgaggggaacatctattgtggaagtatgtagagaaaataacactgattttttttaaaagcctgcttttgtgaagctgtattgtattttgtggtccccacacactgcatacttaaacagttaaaagcctcaggaaagggaatcctcggaagaagtaattaatagttccaatcagagatggcagaagtaatagtttcaatcagagacggcagaagtaatagtgtcagtcagagacgtccagtggttgaggtagggcctgcataggtcgttggtgtgagatcatcctatgtgtccagttggcattctctttctctggcttgtgatctgagctcctgtatcttttatgtatttgttctctggcaagggaacatcatctttcttctgatttttctttattttactaactttgctgttgaagattttatggatgtagacgaaaactattttcacccgagaattcccctaacctagagcactttaaggactatgttaacaaggtcagaaactacactttctgttcacttgaaagatgctgccgtgatgagtgtctttccgtttagggcggtggcactcgctcttgagtctgaaggtctcagtggacggggctgtgggtgtaaccccctgcttgccaccttggcatttttagggcccaggtgttgtgagctctgtccttggagactgtgggacggtggagctgggcggcagtacgttaaattaaatatgttggcccacaggacaatgagaacgttttgtaagctgtactttgtatgctgtattactcgaatttcaaaaatgaagagggtgtaattattaaatatgtttggaaattgccaagtcattgaatacctattttgtgaatttatgagtagttttatttttaagtttgtagatcaggggtctcagacacagagccaaaaaaaaaaaatgctagagtgagtttgtgtttttttttttttaaacctcaaatagtgtaaatttggtaagttaacttttcttgacatttgtgtacattgtatatttataaaagttttagtactgtagggagtagggaagatagaaggcttagcttagctgctgattttttaaaagtgatattctttcctttagctctttctctgagaccacgattttgttttcttgagctcattttacaaacctttgtggataggactccaggaatagagtatgtctacacaacttcctggcccttttggaaactgtccttacaaagctaaattgagatgacagcacagtttgtagaagaccctttcacacacatagttaagcttatctacatgtaagatcgattttagcctctgcctttgggctggtggcagatgttttctctatacaatattgggtattacgggaggctgaggcaggagaattgtttgaacccgggaagagaaggttgtagtgagccgaggctgcgccactgcacaccagcctgggcgacagagcaactctgtcttaaaaaacaacaacaacaaaaacaaaaaaaaccccaatactgggtgtattagcctttccctcttacccccttttctgatcccagggttaaaaagcagccagtagcggccctgcaggaatgggcatccatagaatgagaaggggcttctagaactagcctgggagcacagaaggaagctcctctcattcaaatttatccgaacaggctttgcagaagggtagtttcatgatttctgcacattccttcactctgaaatctgtgtcgtgcccctggcactgactgtgcacctggcactgtggatgtggagcaggatccgtgatcgtggagcaggatccgtgatcgtgaggtaggaggtgggactcgactccagaggcggggttcagatgccagaccgaattgaggactagctgatacagggatggggcagaagcagcgttctgcaaggcacgcccaccagtgtgccttgttagtttactgtcgccatggccacacccggagttactgcctctttccatggccgtgacctgacaacccaaaagccaccacccttttcctagaagtgtctgcctaagcctacctttactctacaggaaattaaaagtaggtataaggtaaggctgggcgcagtggctcatgcctgtaatcccagcactttgggaggccaaggcgggtggatcacctgtggtcatgagttggagaccagtgtggccaatatagtgaaaccccgtctctactaaaaatacaaaaattagcctggtgtggtggtgcgcgcctgtaatcccaggtgctcgggaggctgaggcagaagaatcgcttgaacccaggaggtggaggttgcagtgagctgtgatcatgtccactgcactccagcctgggcgacagcctaggcgagactgcgtctcaaaaaaaaaaaaaaaaaaaaaaaaaagtaggtataagtatgattgcaaaactgccctgagctgctactttccgcctttgggaaagcccagctctgcaggagcagtcatggagccgtataacactgcctgcctcttcaataaaggtgttttctttcctgccaccggctcacccttgaattatttcctgggcaaagccaagaaccctcttgggctcggccccactttggggcgcgtctgacctgcgttaatagttcccaacctccgtgagctcacagttaaaaatgttgtggagtatgttcgggagtggggagcgctttagagggggctcctgctggagctgggtcctgagatcaggctgtggctctccaggtggacagaagagcaccagggcagagcggagaggtgggtatggctgggccctgtgcttctctgtgggggcggacgattgttagttgttcatcaggacaaggaaggccatgggtagcgtgggaaggagtttgcatttgaccccataggtgtcagggaaccactcaacagggggcttaggtgatctgacttgcagttttagaaagttcactctttcagagctagtgagtgtgggttggaaagagattaatgaggtgtcgagtaaatcccaggtaggggtgatggtggcccaatccaaagttacagtagcagtgatggaggtgatgggatctgagtggcattaggaagagcagcttgatgggactgcaagccagatttaaacaaacgactggcaggaggggaagggcttgaccatgtgaatgggaaatggcattttaagtttctggaagtgacttggcgacaatgtggagtcaggaatgggtgaggggcctttgaagttgctatggtatgaatggagaatgcaggatggacttgcagagtacagaggcccggaacccctggcttgcttactcattcagcaaatcatttactccgtgccaggcacggttctgggttctggcaatacagccgtaaacaaaacagacaacaattcctgctcttgtaataggggacaagaatttttaagtcaataatataggaggatcgctggagcccacgaggtcgaggttgcagagagccgtgattgcaccactgcattccagcctgggcgacagagtgagaccctgtctctaagaaacaaaaaccaggccttcaaataggggagatctaatagaggggacaacaggggagtcaaaccataaataagtaaaatagaaaaagtgttttgtgaacaaacataaagcaggaaggggatacagcagatggggtgtacgagtgtgagaaatcttatctagggtggccagtcactgggagaaggttgcaggaatttttagcatactgctaggattttggaaataatctaaaaagtgaggggccaggcatggtggctcatgcctgtaatctcaacactttgggaggccgaggtaggcggatcacctgaggtcaggagtttgagaccagcctggccaacgtggtgaaaccccatatttactaaaaatacaaaaattaaccaggtgtggtggcaggtacctgtaatcccagctactcgggatgctgaggcaggagaattgcttgaacctgggagacggaggttgcagtgagccaagattgcaccattgcactccagcctgggcgacaagaatgagaccctgtctcaaaaaaaaaaaaaaaaagtgtgagggacagttattaaagatatggagaaatgggccgggcgtggtggctcatgcctgtaatcccagcactttgggagaccgaggtgggcagatcaggaggtcaggagtttgagaccagcctgaccaacatggtgaaaccctgtctctactgaaaatgcaaaaattggctgggtgtggtcgcaggcgcctttagtcccagccacttgggaagctgaggcaggagaatcgttcgaacccaggaggtggagtttgcagtgagccgagatcgtgccattgcactccagcctgggcgatagggcgagactttgtcgccaaaaaaaaaaaaaaaaaaaaaaaaaaatgaagaaacggtctgattaaggtgagggaccttccacagcatttgggatgaaaccgctaggcctgagggaaccgtggctgttgtattctgccttgggccacaagcaaaaaatggtgagacgtgttatctcgagctgttggcttttcctgtcatagatacagggtcacaaagacagaaaatgaaactgttagaaaatatctacaggcatcttcttttcccgtgtaaatattaggaagacagaatgaagatgctcctccgctctcatccacacccatggtcatatctctgaagaggggaataccagggagtgatcacattgtcagatgcagaaattaaaaaagcttttttccccagccaaactttatgcttgtggagcaacttggggaggagacccgctggtatgcatttgggcagattgtcacctgttggccacctctgtgatcgagacctttgccttagaggagttcctatgtagaccctgtctggtgggccgacagaccgacagtggacggaggcattctgtatgcgttagcctctgcaaacaaacacctgtctcatgccggaaatctgggcgccccattaaccctgagcacgggcctgccagctgacagaaccctagccaggtgttggtttggggttcagttgcatgctcaggtgttcccctttcttcccccgttagcttgtccccacctaagcctgcaacccttgccactgggatgctaacccgttagcagagctcagtctccttgcttggaaattctgtgttgacctgcactgcattcttttttttttttttttgagacagagtctggctgtgtcacccaggctggaatgccatggcgtgatctcagcttactgcaacctctgcctcccaggttcaagcggttctcctgcctcagcctcccaaatagctgggattacaggtgtgcgccaccacgcccggctaatttttgtatttttagtagagatggggtttcaccatgtaggccaggccggtcttgaactcctgacctcaggtgatccaccagcctcagcctcccaaagggctgggattacaggcgtgagccaccacgcccagccttgacctgcattcttgagcaggatctgttatgcacgtggaaatacagcctctcagatagcaaatggcagagatgagatgaggcacacagttcccctccacagctggggtgggagacagaaaacagcagtagagtcgacactcaagctgcccccagtgaccatttgttcaggctctttgagacctggcttacagtgacaaggacacagctgttaattctgaagacaagctttcgagtagaagtaacctctggtaaagcaagagaaggttaaggtttgctgaattgccaatgggatgaagaaggaagggagggctgtcttttcaggtagaatgcctaaggaagggaaacatggagaaggaacaattagagcaagtcaagaagtttcaagatttttgtcttctggccagcttggttagatagtaattatgtttctgcatattggtcagcgttgcctatgtactttgctgtggaatagtaatcttggaaaaaaaccaaccaaccaacccacattaatctgtccatgtctgggcacagagtgtgcagaagcctgcgtgggccgtaagtctcgtctttgtcttggttggtgattttagtattggtgtttttgctggaattccaaaactgtaagagtgtaatcattcaccattagaattctgcaggtcccctcctgactctggactagctgagcttaggggcctgtcatccatctggccctgggcatatcatttgtactttgcctgtgacacacctcaagaccttttccaacaggaactagcatccctggagggaattttgtgaagagatgagagtttttgaaacaggaagggaactggcaagggaagtggccgggcaccggtgctgccgcggaacagaagggaagggactgggctgcatcagagggtggatgtggggccgccatccgtggtgtgggccaagggtagggtggtcctcccctgggaagactgcagacagcagtgatattcttgtagtcttgtggatgtacccagtgaaccacaccagccaagccaacccgtggctaaattttagtcaacttcagcgaagaagactgccccttgtaaaacttgtctgctcttggaaatcaggttttttgtctcattttccccagcctttgctagcattgcacttgtaaaaaattcctggcatcctttctgcggagttaagtgggaaggctcaatgttctgggataggtgggaacatcaaacccgctagaggctgctggtggcagtggaggcagaatgagttgtagcagtagtggtggcagtagtgtgacctagagggcagaagctgggaaacagggtgaaatgctgggccccgacagtcagggatagctgcacctagcttatatgccttcctctaatccagtagaaattgttgtttctgtaggttttttttcttttctttttgagacagggtcttcctctgttgcccaggctggagtacagtgtgcagtcacagttcactgcagcctcgacctcctgcactcagatgatccttccatgtcagcctcttcagtagctaggacacaggcgcatgccaccacatccaactaattttttttttttttttttttgagacggagtctcactcttgcccaggctggagagcagtggtgtgatcttaacttactgcaacctctgcctcctgggtgcaaggaattctcgtgtctcagtctcccgtgtggctgggattacagatgcatgccaccatgcccggccaatttttttttttttgtatttttagtagaaatggtgtttgaccatgttggccaggctggtgtcaaaatcttggcctcaagtgatctgcccgcctcagcctctcaaagtgctgggattataggtgtgagccaccatgcccggcctaattttaaaaattatttgtagagatgacgtctccctatgtttcccaggcttatgtgcattatttatataggttgtctattgatatttacagtattagaaattgaaacaaactgagaagcttaaaaatcttttctaaatttatttcaaaatagtaattcatttcacccattgcatgttaatgtaagtaacatttttataaaagtaactatattttgtaaaatgaaaaaatttgatgagaagggtggcactgccatacatttttgcaaatctctttaatgtctggattaataaacggttgaagttttttgttttttttttggtggattttttccctcttgttgcccacattggagtgcagtggcacgatctcggcttactgcaacctctgcctcctgggttcaagcgattctcctgcctcagcctctcgagtagctgggattacaggcacgcaccaccacacccggctaattttttgtatttttagtagaaacagggtttcagcatgttagccactgcgcccgacccacggctgaggttttttgagtgataaaatgtacacaacagaaatctaccgtgttaaaacacttttaagtgtgttcgctgaattttcttaaccgctttggcattcaatttgttgcaatatgttgaaaaatgtgtagaaaatctggctttagttggaagagcattttcatagcctttttatgtgattctggatatttttctttgattctgtagaaacattcaacaagtgagtagtagtttctttttctttttctgagatggggtcctactctgtcacccaggctggagtgcagtggtgctaccatagctcactccagccttgacctcctgtgctcaagtgatccttctgccttggcctaccaagtagctgggactacaggcatgcaccaccacaccccgctgattttttattttgagtggtagtttcttaaatgttagttgcaatatggaatctgaaattttattatctttttttgtacactattatattaaatgctgttgggtttttacccaggtgtgattttataacgtcatgcactagtcatttggaaaatattggtctcttgaatgatgcagctcttccacatgttgacgtcagtaaagtctaatagtctgaagatgttgagttcatcacagtggctgatgtaagttttccaaaactctacttgaaaactggaattttttatcattggcggcaaatactgtcagttattttccttgaagcgacagactcattcatattcccaggaatggtctgcccgtactcaagcctgaacgaccgtggtttgtctgtaggtcacgtgtaaataatgtgctaccaaaaaggtggccagttcagcttgcaatccaaacagctgcacagctgcttttctccaggaccgctgtgctttgatgggcagcagcgtcgtcgtaggcgtgcttctcatttcatcactcagactattcagaagacacctactcaagcttgcgatttaaccaatcattcatgttgacagcttcatctgggacattcttttttttcttttttctgtttttgtgacagagtctcgctctgtcgcccgggctggagtgcagtggtgtgatcttggctcactgcaacctccgcctcctgggttcaagtgattctcctgcctcagcctcccaagtagctgggatttacagatgtgtgccaccacgcccggctaatttttgtctttatggtagagacggggtttcgccatattggccaggctggtcttgaactcctgacctcaggtgatctccctacctcggcctcacaaaatgctgggattacaggcgtgagccactatgcccggcccatcagggacattcttaagtgaagctgtctgcctttcctttcgtaagtgtggggtagtgaaggacaagctgagggctagtgcagtttggtttccctgcatcgggacctgctcaggcactagcagtttcacccatggcttcttctgcactgtcactgcaaatgtcaacactgaagaaggcaaatgctgtcttagtgtcattgtgcaaatagtttagactccacagatgccttgcaaaggcctcaaggacctctagggatctgcggatcacactttgagtactgcttcgctagctgggctgcaagatgggaagactgagggttttgtatgtgccacccaaacacgcattctcatgtgtgtgaaacaacgccaattggagttgtcacacccattacatgttgcctgtggaaatagcaagtgaccttagttcatacattgaccttttcttacaaaatccttaaaaatcttttgtgattctggtaaatctttgttgctcatgttcaaagtgtgtgataaagaccatcaacttcgagctggccatggctcgtgcctgtaataccagcgctttgggaggccgaggtgggtggatcacctgaggtcaagagttggagaccagcctggccaacacggtgaagctccgtctctcctaaaaatactataattagccaggcgtggtggtgggcacctgtaatcccagctactcaggaggttgaggcaggagaatcacttgaacctgggaggcggaggctgcagtgagccgagatggcaccactgcattccagcctgggcgacagagcgagactctgcctcaaaaaacaaacacatggctgggcgcagtgagtcacgcctgtaatcccagtactttgggaggccgaggcgggcggatcacctgaggtcgggagttcgagaccagcctgaccaacatggagaaaccccgtctctactaaaaacacaaaattagccaggcatggtggcacatgcctgtggtcccagctactcgggcggctgaggtaggagaattgcttgaatccaggaggcggaggttgcggtgagctgagatcatgccactgctctctagcctgggcaacaagagcgaaactccatctcaaaaacaaacaaacaaacaaagaaacaaccatcaactttgtttctgtaaattttttttggaagggctcacccttgaatggttgggtgcttggattttgatttctgatacattcgggcttaattctgggttgtatggtttcctaactgtgggactttgggcaagctacctaggggcgctgcaatttataggaatgatggtgtctctgtcagagggtcgttgggagaatcaactgggataatgcaagaaaagcacgtatttgcatagtgactcgatggtggacagccattccatcaataactaacgctccccgctggctgagtcacatttcgtattgcactaaagggtgtttctttcttcctgcgctcaatctggcgcacatcttgtgtcgttcagtaccgaaacctagaacacactagggactgtgattgtgtcagtttctcgtactaaaaagggcaagtgtccaaaatacaaaatactgatagctcgccctggttaaactctagctgccgaacttggcagcctctttactgaaaaccctcgggggttcagcaggctcgttcctaggctgcttcagttccccagagcctggaggttcttaagatgatgggcccctcgatggttgaggaattataagcagatcttcagctgtgcaactccagctattggccgtggtttgaactagagtggtttttttcaactgtactgtatcctactgtaaactcatttgtttattcattaaatattgaatgggttcctaccattggcaaggcgaggactaggttctggagatagaggggtggcccctgccctcttggggcatgacgcctagaaagggaagtagacagtgatcaaatagtctgtacaggccaggtgcagtggtcatgtctataatcccagcactttggaaggccaaggtaggaggatcgcttgagtccaggagctcgagaccagtctgggcaacatagtgagaccctgtctctaaaaataataaataattagccgtgcatggtggcatgtgcctgtattccaagctacttggcagactgagatgggaggatcgtttgagcccaggtggtcgaggctgcagtgagctgtgattgcaccactgtactcagcctgggtgacagagcaagactctgtctcaaaaaaaaaaaaaaaaaatcacctgaacaaatattgtactagacttcctgactgtattacagatagggttgagatgatctctattttatagatgagaagactgaagcacagagaggttaggtaacttgtgatgatcacacagccagaaagggatactaaatggtggagccagtatttaaacccaaaggctgtattagaaaacactagtacccatctcacagaattgctgcgaggattaaatgagaaaatacaagttcttagaaaagttcttggcacataatacctgtcagtagagaagagctagtgttactgaaagttggaataattttcttagcagtggcagcaacagccaaaacaacgatacctgtctttagctctctgcatttaccctgctgtcatgtaccctgccctcacgtatcctgctgtctcagccactgtgaaatcctaggatcctgggagccgtgtgtgtttagatgcttttatttgcttggttctttccctttctataccatttacagactgagtttgtttttttcttttctttttttttttttttttgagacaagagtctcactcctttgcccaggttggagtgcagtggcataatctcggctcactgtagcttccacctgtatcagaccattctaacactgctataaagttgctacctgaggccaggtgcatggctcacgcctgtaatcccagcactttcggaggctgaggcgggcggatcacttgagctcaggagttcgagaccagcctgtccgacatggcaaaaccccgtgtctactaaaaatacaaaaaattagccaggcgtggtggcatacgcctctaatttcagctacttgggaggctgaggcaggagaatcgctggaacctagaaggtggaggttgcagtgagcccagatcgcgccactgtactccagcctgggcaacagagtgagaccccatctcagaaacaaacaaacaaaaaagatgctacctgagactgagtaatttataaagaaagcaggtttaattggcacagttctgcatggctggggaggcgtcaggaaacttacaatcatggcagaagatgaaggagaaacaaggcgcatcttaaatggtgtcaggagagagagagagtgagagagagagcatgcgaagggggaactgccacttttaaaccatcaggtctcgtgagaactccctcactctcacgagaacagcatgggggaaaccacccccatgatctagtcccctcccaccaggtccctccctcgacacatggggattacaattcaagatgagatttgggtggggacacagagctaaactatatcaacctcccagggtcaagtgctcctcgtacctcagcctccctgtgactgcacatgtgcaccaccacgcccagctgattttttcaaatttttgagagagacagggtcttgccatgttgcctaggctggtctcaaactcctgggctcaagccatcctcctgccttggcctcccgaagtgttgggattacaggcgtgagccaaggcacccagctgagttggtttcttaacgtcctccaaaggtgatttttttcaagaatcaatataaactcttggattttagcttatttgatgtatttcattccattacagatacatgatttttgatgctcagattgtcccatttggggcccatgggagcccctttaagttggctgctgagtcctcttcatgcaaccccagtggtctttgataactttcatacccttttagtaacctttttaaagagttgagaaattataggtattaaaatctcattaattctgtttgtctgatatgtttattcagagagactgagctaaagtttaccctcatcttttttgaaaagaaaatgaatagtatatgcatgtttctatgaggaaataatgccacccaagaaacggtttgtgcatcttcgagttccttggaagctttaatttgcattcctacaattgagagcaatgtagaatttctttctgtatcttcccactaatgcctgttgaggggcaggtgtctgtgaatgtaggtaaatcgtgataaaaaaacaataaaaaggccgggcgtggtggttcacgtctgtaatcccagcactttgggaagctgaggcgggtggatcacttgaggtcaggagtttgagaccagcctggccaacatggtgaaaccctgtctgtactggaaatacaaaaattagccgggtgtcgtggcgcacacctgtaatcccagctactcgggaaactgaggcaggagaattgtttcaacctgggaggcagaggttgcagtgagctgagatcacaccactgcactccagcctgggtgacacggtgagaactctgtctccaaaaacaaaacaaagcaaaacaaaacaaaaccaaaacaataaaaaaaaatcccaaaccaaaatgtagatgacctgtttgcagactgaggagtcctgcagcaaactccatcccccaggacagctgcggaatgttctagaaggcccaactctaggaaatcccttagtaggagccttgctctcaacagtgcctcctggaacgatgggccggccactctcttttccatcttgcatcatatgtatttgacttattttgtttataacctgtttccacgccactggaatgtatcttaagagcaggaattttccatgttttacttcctgctgtgttcctagtgctgggaatatagccaggcatataatacatgcctgataatattggctgaatgaatgaatgaataaatgaatgaatattacaggccagacacagtggctcatgcctgtaatcccagcactttggaaggccgaggcgggcggatcacctgaggtcgggagtttgagaccaacctggccaacatagtgaaaccccatctctactaaaaatacaaaaattagccgggcttggtggcgtgcacctgtagtcccagctactcgggaaattgagacaggagaatcacttgaacccgggaggcagaggttgctgagattgcaccactacattccagcctgggtgacagagtgagattctgtctcaaaaaaaaaaaccaaaaaccaaaacaaaacaaaacaaaaaatcccaaaccaaaacgtagatgacatgtttgcagactgaggagtcctcccccagcccagcaaaccccatccctcaggaccgctgtggaacattccagaaggcccaactccaggaattcccttagtaggagccttgctttcaacagtgcctcctggagctatgggccagccactctcttttccagcttgcatcatatgtatttgacttaattttgtttataatctgtttccacgccactggaatgcatcttaagagcaggaattttccatgttttacttcctgctgtgttcctagcgctgggaatatagccaggcatataatatatgtgtgataatatttgctgataaatgaatgaataaataagtaaatataagcctggtatggtggctcatgcctgtaatcccagcactttgggaggccaaggcaggcagatcagctgaggtcaggagttcaagaacagcctggccaacgtggagaaatgccatctctactaaaaatacaaaaatcagctgggcatggtggtgggcacctgtaatcccagctactcgggaagctgaggcaggagaatctcttgaacccaggagatggaggttgctgagattgcgcccctgcactccagcctggatgacagagcaagactctgtcttaaaaaaaaaaaaaaaaaaaaaaatatatatatatatatatatatgtacatatgtatttatacatatatatagtgtgtgtgtgtgtgtgtgtatgtatatatatatatatatatatatatatatatgtaactccacatgtgagtaccctgttatgtgtgaaaccacaccccaaacatctacacagaacaagcctccaggtagaggaaaggcagtaaccgctttgctggaatgactgagtggttcattaaatagaggctccggagggtcttgataggctctagcaaaggtggtggccgagagggctgaccagcgcatggtgcctgggaatgtgaatgggcccaggggcgccagagtgtggacagcttgggactgtgggctccgaggtgctgcgctgagggcgtggggcgcagggcagaaacacagaggactgagtgcttaggggaggcccaggaaatgtggggttgaacggcctagttctggcaattgtttttaagctttgtaagatggagatttcaagaagtatatttatcttaataatattgtagctcctggtaattcttatttgattaccatttatacacatggaaaaccagcatgcctgtttctggcaaagctccagggtagtctttgtgcataatttccaggatttttatgtaatgctattaaaatctgttcttttttttttcccccttccaaagcggggaaaaagcagcttttgaatcatttattttcgtgtttgagttgtttgggaaatattaactacattttctaacactctagcctggagaaaggaagaaaccccacatgcgtgtgatttatttccttgtgtatggatattaaatgcaatataccattaaggctatgacactttaagtgaaagtgttcattgcatgttgattcagttagttcgtaccctattgtgttactatttaaagtgtggattgcatcgcattctggaacttcataaatgagttctttttcccataaggaaaggccactgcttctgatgttcattaatgtgatttttgtgtgtgtgaatgagctgcctaaaaactgggtgtggtgagggtggtttctgaaagggaagcacttttatagcatgatcttatttgaaaatttaatttgtttttgtaaattagcttttggtcttaatacatttcctccactaacaagcacttttgggcaaataatttaatctctctggttctgcttttttcatattggtaaaatataaagtttgagatagatatgcttaaaatctccaccattgtctaagtatagctgagattctcacgtgattgggacatagtgctcattcttaatttgaaaagtgtttttttctttgtcctcttgtttcaactacgaactctcatttagacacatttagcatagggaagctccgatttatagagccactaaattgcagggcgtgtgtgagatttgtaacttcataaaagattctttacttcctttaaatataaatacgtaagattgagttctagaagtataatttacacatggtttcctgaggatcacgtttcctgaataaagcagggtatcgttagaggaaccccatttgatttttttttttttttttttttttgagatagagtcttgctctgtcacccagggtagagtgcagtggcgtgatctcagctcactgcaaactccgcctcctgggttcaagtgagtcttgtgcctcagcctctcgagtagctgggactatagtcatgcaacatcatgcccgtctaatttttgtgtattttgtagagatggggtttcatcatgttgcccaggctggtcttgaactcctgagctcaagcaatccagctgccttggcctcctaaagtgctgtgattacaggcgtgacccatggtgcctggtctgggaatcctgtttgattttgaaagtctgagaaacacttttgaaatggcttggagaaaatgtgaagtgaataattattatttttttaatgtgcttcagttcccatgtgaacattattttagagagagattggaaggttagttgccagtaaaatgaatttcactgtgttggcaagtttttcactcgtaggactgagtgaatcctggactgacagtgttcttaccgatgattctgttgaggaaggacttgcttgctcttgttgctcttgacggtgagcttctggatctactggccctatattgagtgtgcaaggggacgtgttagtcctctagttgtcccccacattaatgcatctggaaagtgtctaccttagatgttgtaattagaaattagagggctgggcgcggtggctcacgcctgtaatcgcagcactttgggaggctgaggcatgtggatcacctgagatcaggagttcgagatcagcctggccaacgtggcgaaaccctgtctctactaaaaatacaaaaattagccgggcatggtggtgcgcacctgtaatcccagttactcagaggctgagacaggagaatcgcttgaacctggtaagtagaggttgcagtgagctgagattgcgccattgcactccagcctaggtgacagagactgtctcaaaaaaaaaaaaaaaaaattaaatgtcatcaacattgaaaggaaactcttggattttgtcaaagatttataaaaagttttgaatgattttatttttttcattcagaagcataatttccctcttaaaatccctgatgtggatcatttggttccctgtcatttccattttctttgttcagagtgtctcttctggatctcctgagtttctgtgtgtgtgttcttcctttttgctcaaatgatgagcacacatgaaagcttttcctcctttgcctgggtgaggcggtgttccaggtgtgatctgcagtgcctgattattatattgtattaatctcctcaattttattttctggcttgtctgcatttttccttttctttcttctcccttttttttttcttattagagatgggggtcttgctgtgttgcggggcctcgagcgatcgtcccactttggcctcccaaagtgctaggattacgggcgtgagccacagcgcctggcctccttttctttatagtaatttgaatgtggtgattttaatcctccatggttttcttatccttcctcaacaaacagcaaagaggctgctggaaagccacatgacatttgctgtgatttgcacggctgatgggaaaacactacttggttctgaaggacagggttgtcattggatacctttgccctctgacccgagtgagaatctcacctggacaaagacccgagttgtgaaatcacacagagaaagtgtgattccgaacctgctgctgtcctgtgcttcctgaggacaagtgagtgactgactccgtgtgccaggaactgcaggaggttaaaaactttcagaactaccatgcaaataagaaatttcaaaggacttttctctaacacacatttcatagtgaacgtctcagctggattaacataattaacgctgtgttctttctggctcctgaaagaaattgtgattaggaacactttcagggctgatgagtctaaggtatcaactttgtcccttctgccacttgaagttcaaatggaaatgtttgctttcatagctccagtcatgatgttactgtatttagtagctattaagtttccaattccatagactcctgggagaagttccagttcgcactaaggcttctgttgcatttagcaccactgcctatggtgtgtggagctttcctgaacaagtaatagcagcaaggttcttagcttagtaataattttaagctattctttgattttttaaacaattaattaattaattattttgagacagcgtctggctctgtcgcccaggctggagtgcagtgacgtgatctcagctcattgcagcctccgcctcctgggctcaagtgatattctccagcttcagcctcctgagtagctgggactgcaggcgcatgccaacacgactgactaatttttgtattttttgtagagacaaaaatactttttttatgtagagacaaaaaaaaagttgaatgataaaatcttttattacttaataatatactttgattgagatttagccatttcattttcactagtgtccagacgttttcctgaaaggcgtgattccatgagatttaatactgaattataatttgatgtaaatgttttatataatcagttgtttgtttttaaacagtagcctcttttctaggcctgctctaggttgattaaatattaagttttctgatcagccagatccttaatagagagcttcggggacagcaaatggttgaatatgaaaccaacctcatttgccatgttgttagatataaatgtcagtgatagcactttctggatggttgagttttctgaagagcagaggattttctcttttagtcaatcagataattttctgttttaaccaattcaaacatttgattttatgtttctgaaatagataaagcactttcataaaaatggactgtgccaaataagaggtaattttcttgatgactcagttatttttgcctcttatttggcttttactaatatagcaatttctctataaaaataggaatctttgcttttttaaaaaaactgagatcattctgtttttccagttcttacattttaaaaaataatttttttggcttcttttgctatccatgtatgtagctgttggtgtgctttcctgtatcacatttgctcctggtttttacttcgttacattaaaaaaccaaaccaacaagtaattaagctcgttcagcctgcagatatcgtttgatggaaagggctaaggagtcagcctttgtgcaggtttttagttgtcagctatagtctgagtaagtgaggttgctaggtacaggcgttcaggatgtgtaagatgttattacagttatttttagtgtattattaagggggaggaggagaaagagaaatttgaatcaaatttgtgtcttattaaataggacacgttttccataagaccaaaagggcatttcttttgcttatgtactagaaatagaaaatggaaattagatattagattgtataatcgaaagtcaattagaattaatgaacaattctataactagttatactgtaagctaaaatgtgaatgttaaattagggaagtattgatttttatgaaaatttaccagaatttcaggaaaggactttgcttactttcccaagaaacgtctggtaggagtcactgtagaaatttggtgtgttctgtacaacactgcccaggaggaactggccacatttcttcctacttggttcttttgtttgtttgttttttgagacagggtcttgctctgttgcctagaccggagtgcagtggcacgatctcagctcactgcaacctccgtttcctggattcaggcaattctcgtgcctcagcctcccaagtaccggtgattacaggcacccgccaccacacctgtctaattttttgtatttttagtagagacagggtttcaccatgttggccaggctggccttgtactcctggcttcagatgatctgcccgcctcggcctcccggagtgctgggattacaggcgtgagccacagtacccagcctgctttatttttaattgaagctaaattcacataacttaatgatttttaaggtgaacagttcagtggcatatcgcacattcacagtgttgtgcaaccatcccctgggtctaattccgaagcgttttcatcacccctagaaggaaaccctacacccactaagcagccacttcccagctcccaagccctagcacctggcagccgctgtgctgcactttgcatctgcaggatttaccgagtctgggcgtttcttatacttggaatcgtaggatacgtggctttgtgtgtctggattctctcgctcagcatgtttccaaggttcattcatgttgtggcatggagtagtacctcctttttgttatgggtgcataaaattccattgtatggataaaccacattttgtttttccattcttccattgatggacattagggttgtttctgcctcttggctattgtggatggtgctgctgggaacactcgtgtacacgtttttgtttgagtatctgttttctcagttctttggggcacatacctgggcatggagttgctgggtcacgcggtaactctgtttaactttttgacaaacctctgccacttttaaaatgaggaacttgggctgggtgcagtggctcacgcctgtaatcccaacactttgggaggctgaggcaggaggatcacttgaggtcaggagttcgagaccagcctggccaacagggtgaaaccccgtgtctactaaaaatagaaaaatcagctgcgcatcatggcgcgtgcttataatcccagctactcgggaggctgaggcaggagaatcgcttgaacctggaaggcagaggttgcagtgagccgaggtcatgccactgcgctccagcctgggtgacagagtgagactctgtctcaaaaaataataaaataaaataaaataataaaataggaacttatatgaagaccctgtaaaaagttacctgtggcagtccgatgttttggaaaacatctgaaagcttaggtcaatttggtcatagatgtggctggccattatgtttcttgattgaaataattactttgttcactaccattcggaatagttttgtgattaggataaaaattataatgtagatataagagcctagagactctttttatatgaatgcataagttttggctgttcccttcaaattggcatgaggcttggcaacactggaattgtgtgttagataaacagttggtatctagggcaagcttgaaaaaaaagtagtatttaaacattgaccaaaaaaaaaaaatctcaacaactctaggaacttccttgttcaaatgaatccacaccgtctaaatacagcgtgataaaattaggcttccctctggtttccgtggggtcgagtgagccctgagcgtctcgtgcccagccaggactctgcctgctggctggcttcggagcacagggaggtgggacggtttccacggccagcagtgttcccacagcacttccttaatatagaacgtttttaaaagcagcgttggccacagaaaaagctcaactcccaaacactgtcatcagttcatagttcatttttattttgttttcatgttgttaaaacaagaaatagcatgtaaacatgtctgcattaccgaacatcagtagtgtttaggatagaagaggaacacattgagtttctaagtagaaaaaaaatctgttcatccttaaaggcaaaggaaggggcaaggtccctccttgaacaactgggtgaggttggacgcctccagctgtatttgctaagttgggcttggaagtatccatagggcgtggggggcctgctccagggctgacctcagctggagtcccctccaagtcaggggtatcgctcggcacacatttgtatgagttcacctgaaaagtgcccttgttgggggagcttggaatggcctgtagggcagctgggtcacagtggctgccggggatgcctgccaagctgttaagcagccctcgggcccacggagtcccagcaagtgtggtttactgtttgttaggatgtaattcaagcctgtgggtaggtaaaactacccaggattaaggggggttggcttttccagggaacaaaaggatcccaccagggagaggactgttctgggaagtgccctggtcccctgtggccaggcttgatttgctctctctttggaagccaccttggcacgcaggcactggtggaaaattttggagtacctgctggaggttgaagatgtgagcacgaagaaaccatggtcttgtctcgggagcctcccagactttcccctttacggctggtgagaacgtgaaatggttcacttgctgcagaagacagtctggcaggtccccaaaaggttaagcacggagctaccgtagggcccagccatgccactcctgggtttgtgcctaagaggtgaaaaacacacatccacacaaaaacttataggaatgttcatagcaacattatccacaattgccaaaaagtggaaacagcccaaatgcctgtctgctgatgaacacataaacaaaacaagtaacacatcaacaaaacgtagcacctctgtaggatagcatacgattcagccttaaaaaggaatggagttctgatacatgtgacaacgtggacgaatactgaaaacatgcccagtgaaaaaagccagaccacaaaggccacgtttcgatcgcttgagcccaggagttcgagaccagcctgggcaacatgtcaaaatcctgtcaactcaaaaattagccaggcatggtggcatgcacctgtggtcccagcccctcgggaggctgaggcgggaggatcacctgagcccaggaggtggaggttgcagtgagctgagattgcctgggtgacagagcaatctctgtctcaaaacaaaacaaaacaaaaacccaaatgccacgttttatatgattccatttctaggaactctagaactacaggcaaatccatacacacaaagtagattagtgatggccagggctggggaaactgaagggaaatgggaggtgaccgccgatgggtatggatggggtttcctttcggggtgatgaaaatgttctcgaatgggctatggtgatggttgcacaactctgtgtgcgaaacctccctgaattataaactataaacgagagaattacacagtatatgaattctctctatataaagctgttatgaaaagcgaacctaccagaccaacattaacaattagagtatattgtagtacaagacagttgtagattggcaagataagattggacatagagattttgtagattgtggagcggagagggatgaggtggacggtgctgttacagcctcttaggagggacagagatcctgaggtgatcaccgagcttcaggatcttgttcataattttgagattaagaatcttggtttggaatcccatgcctgtcatcccagcacttcgggaggccaaggtgggcagatcgcttgagctcaggagttcaagaccagcctggttcacatggtgaaatcctgtcgctgcaaaatgcaaaaactagatgggaatggtggcacgtgcctgtagtcccaactactctggaggctgaggtgggagggtcgcttgagcctgggaagttgaggctacagtgagctgagatcatgctgctgcactccagcctgggcagcacagcaagaccctatctaaaacaaagacaaaaacaaaccagaatcttcatttccatcagtcttcagaactgtgtgagtttaggagttgtgattcatgctgaccatgagaccgatgtataaagcaggtgccagtgtattaagttactttggggaatatgatgtacttttccagtggctggaatattaatatctacttcccaaggcagttcctccatgagatcaaggtatctgtgaggcctcattaatagtaacaagttagccgggcatggtggcacatacctgtagtctcagctactggggaggttgaggcaggagcattgcttgagctcacactgctgcacaccagcctgggtgacagagtgagactctgtcgcaaaaaaacaaaaaaaaagaagaagaaaggaagaaagaaacgaaagaaagggagaaagagagggagagagcgagagagacagaaacaaagagaaacaaagaaaagagaaagaaggaaggaaggaagagagagagagaaagaaagaaaataaatagtaacaggattgcttcaggactgtagtatccgagcaaatagtaacaggattgcttcaggactgtagtatccgagcaaatagtaacaggattgcttcaggactgtagtatctgagcaaaggatctgatttgatccagcacatcccacgagggactgagtgtttatgcccacagactcagtgccctccctgaactgtgcagagtaaactctgccaaactcttagctgttgttgttcttctttttttttttttttttttatctttttgagatggaatctcgctctgttgcccaggctggagtgcagcaatgtgatcatagctcactacagcatccacctcttgggttcaaacaattctcatgtctcggcctcccaagaagctgggattacaggcatgtgccaccacatgtggctaattttttgtatttttaatagagacagggttttgctgtgttggccaggctggtctcgaactcctggtctcaaccagtctgcctgcctcagcctcccaaagtgctgggatgacagacgtgagccaccgtgcccggccttccttgttcttaaagaaggagatgttacagaacaaacgaatctccatacaaaacaaaacctcaccataaaagaggaaactccctgcttcatgaggggtgcaggtaaatgtagaaacgctcaccaagaaagccagagtggatttcacattaatagaatgcaggtaaaagacataacttgttgggatgtagggcgcagtatcagaatggaatagggttcaggtgagctcctaggatggcaggatttgaagaaggagcagcaccttgattaggggagaatgaagaagctttggagggctgggcgtggtggctcacgcctgtaattccagcactctgggaggcctaggtgggcggatcacctgaggtcaggggtttgagatcagcttgggaaacatggtgaaaccccatctctactaaaaatacaaaaattagccgggcgtggtggcgcatgcctgtaattccagctactagagaggctgaggcaggaggatcgtttgaacccaggaggcagaggttgcagtgagccaagatcatgccattgcacttcagcctgggtgacagagtaagaccctgtcttaaaaaaattaataaaaataaaaaacacagtccaatttttttgagctaattatggaagtattaatggataaaatctacattttgtactggtgctgagagtgagctgtcccctaagtagattatgtttcatgattctgtgtcaactttctctgggctgatgggccctctttggacactgacgtctcctcacgtccatgatccctcctgggtccgtgccagctgcgcgtgtcatcagagcggagcgtgcgcttgtccttcatcgcaggcctgggtgatgtgtggctgacatgcgtcacatgggataggctctccgatctcagggctcgggctgccacccctgccacgtagtacatggcatgtggctgattctccacttgcttgcaatggaccctctgtggaaggcaccggagaggcggtttccctgtctcttctcctcctgtgttgccctcctccccctcgatagatgtgacctcccttccagctttgtgccagtgtctggcagcacttgattttttttctccttgtccttcatctgttttcattgcgtcgccaccttccccacccccaagcagcatccttctgccccttggtgctctccgcgcggccgtctgcctacctgtgagtacgctgaccagggctggttgactgcctacacattagcggagtctttctcattttttagggcacagtagatactcagcgagtgttgttttttttttaataattatgcaataaatgaatggatgtccgcacaccaccctgaacaccagcacccactggtcatccctggacacgcatgggtggaaggaccacactggttgtccctggaagagtagctcactctcgagcctgcaccgatgtcatctgagtcaaaacacagacgtctgggccccaccctagagagtctggctcagcgggtccagggtggggcaagaatgtgcattcctgcaagttcccaggtgatactgaggcggctgctggggggataccatttcaagaagcactgcttggaggcaacgcagacctctccctcttcgacgaggtcctgttcacttccatgtaaccagtcagggttggaatcccacatggagttcccctcctttggtgaccctctgctacagctcttgggagcctcccctttagatgagttcctccctgctctgaccaggagttgctttttctataccacctcagctgatggtgttcacacacacattcatttaacacacatttacggagggctcctgggggctgggtgcacacacttggtgcggctctcttttggaacctggtgccttctctctctccttcatttttgaggcagagtcttgctctgtcgcccaggctggagtgcagtggtgcgatctcggctcatggcaatctccgcgtcccaggcttaagtgattcttccacctcagcttcccaagtagctgggattataggtatgcgccaccatgccccgctaatttttgtatttttagtagagacagggtttggccatgttggccaggctggtctcgaactcctgacctcaagcgatctgcccaccttgacctcccaaagtgctgggattacaggcgtgagccactgcgtccagcttccagtgtcctccctttcagcctctgggtgttgccagccagtgccaccactcagcactgtttatacctaaggcaccaatgggtaaatggagagacaggcgtctgaagacttttaaaaatgtgtactttatttggctgtagctaaaccagttagaaggccgggagttgaagttgatatgagtatcataaatgcgcaagttaagtagttacttaagaagtcacaggaatatgggtcgttccttgttgggtttctgataactagcaggcggctcagtttggctatgttaataacagaaacacagagattgccactgattctatcacatttcctgtttgtttgtttttgtttttgtttttgagacagtctcactctgtcatccaggctggagtgcagtggtgcaatcatggctcactgaagcctcgaccacccaggctcaagtgatccttccacctcagcctcctgagtagctggagctagaggtgtgcaccacctaatttttaaactttctgaattttttgtagagatggggtctcactgtgttgtccagtctggtttcaatctcctggcctcaagcaatacccccaccttggcctcccagagtgttgagattacaggtgtgagccaccgtgcccagccaacatttcattttttaaaaaatgctttattgaggctgggcccggtggctcatgcctgtaaacccagcactttgggaggctgaggcaggcagatcacttgaggtcaggagttcgagaccagcctggccaacatggtaaaaccctgtctctactaaaaatataaaaattagctgggcgtggtggtgggtgcctgtaatcccagctacttgggaggctgaggcaggagaatcacttgaacccaggaggcggaggttgctgtgagccgagattgtgccactgcattccagcctgggtgacagggtgagaccctgtgtcaaaaacaaaaacaaaacaaaacaaacaaaagaaagctttattgagatgtaattcacctgtcacccagcctgggtgacagggtgagaccctgtgtcaaaaagaaaaacacaaaacaaacaaaagaaagctttattgagatgtaattcacatgtcacacaattcagcagtttaagtgtacagttcctatactttgacatccatcactacagacaatttggggacgttttcttcactcgacagagaagcccggcacacccgagctgccacccccagtgctcccagcccctggcagcccctaagctgctttctgtctctttgcatttgcctgttctggacatttcataaaaatggaatcacatcatatgtggcccttcatgactggcttctctcactgagcctaatgttttctgggttcacccatggtgtagcatgtattagtgctttcttccttttcatggctgaataatattccattgcgttttgtttatctttgttgattatccattcctcagttgatggatatttgggttgtttcactttttgactatgatgaatagtgtttctatgaatgttggcagacacgttttcctgtggacatatgttttcatttctcttgggtatgtacctaggagtggaattgctgggtcatatggtaactctgtttaactttttgaggaatgtctggagtttgttttaaagtggctatgccattttctcttcccaccagagtgtgtgcgggccctgatttccccacgtctccataaacacttgctgctgttcgtcttttttattatagccacactagtggaaagacacttttgtatcccacacaaacagaaaacttatgtataggtgatttttctaaaaaaaagactttatgttttgataaaataagcatgttatattggttaagatggtttttgttgtgagttaacgaaaacctaactaaaattacctaaaacaaacaaacaaaaaaacgcatttactatctcatgtaacaagaagtatggcagttccagggttgattaattcagaggtgtgatgacatttccaggaccccaggtgcttttcatctttgctctctgctgtctttgccacgtgggagatgtcttcccttgtggcacaaagtggctgcagccattccgaatgacacagtgatatctagtaaagaagaggggcttttccaatcctgcatgtcttattttactagcatggaaactaagcagacatctctcagctccctttggccaaggcggggccatgtgccacatcctccttagttactggaaaggggagggaagccccattggggtgaacttaccctgctccagctacttactgcgggtgggctgtatgtgcgcatgcatggtgtgtgtgcgtgtgcgtccatgcgtgggtgtgcatgtgtgtgcgtgcgtgcatgcgtgggtgtgcatatatgtgtgcatgcatgcatgggtgtgcatgggtgtgcatatatgtgtgcgtgcatgcgtgggtgtgcctgcatgtgtgtgtgcgtgcttgcatgggtgtgcctgtgtgcatgcatgcatgtgtgtgtgtgcgtgtgtgcatctccttcctaagcaggtagaagggagataccccaagcagaatcaggcttctgctggtaaggaaggtaggtgtgtgggaacggggaggacatgaagaaagaaaatgattcttagggatgcaatgcattagtggctgtgactttagttaaaacatagaattttgtttgttttttttcttttgagacagggtcctgttctgttgccctggctggtgtgcagtggcaatagtggctcactgtagccttgatctcctgggctctagccatcctcctgcctcagcctcttgagtatctgggaatacagtcgtgtaccaccatgcctggctaattttcaattttttttttgtagagacagggtctcgctatgttgccgaggctggtctttaactcctggtgtcaagtgacactcttgcctcagtctcccaaagtgctgggattacaggtgtgagccactgcccaaccttcatgcagcattttaaaaaatgaaaatgtagctgcttgttctaggagaaacttgtgaaattggatcatttaaccaactctgcctgtgcgtgacttgccttcagttctccagcttggcctcaatccctttttcttgctgcttggaacccacatcaccaccagtgacctcacaaggcagtgcccctccgcacccctcccttctccaagactcccccgccgccccctttcttgctcttacccacacgccactgcagacacagcgccctcctcccctgctgcccccctcttgctcttacccacacgcccctgcagacacagcaccctccccccacccaccgttacaccctctcttgcttttacccacacgcccctgcagacacagcgccctcctcccctcctgcaccctgggggctccccgcatgtgctgtgatgttgaacatgtgggtgtcaggatgaaaggaagaaatctagatttgatgtggtgggaggtaaaagcactctcgaaggctttcgagctgggctatgactgtcaggatgaatgtggttttaatatgtggaagagatttatttctttaatagtcacctgttaagagtcttagatatcactgatgtgtcttgttaagaaaccttataacaaacgtatttcttaaacttacatctggagctctgcaaagcattagctgttctgcaggaatgacagagggtctcctgtgcggccagctcctctggagtcagggagccatggagccactgctggttctgaggatggtgacagcaggaggtggagatggcttcatgatctgctgtgagcaacgtgcaaccttctccctgctgttaagtgactagaattcccaggtgccgcctgctgattagttccagtttgtgttccacgagagcagatgtgtgtgaggtgcagggaatgccccgctgcgggagatggttttctcctgccaccgtccctccccaggccacaccatccacacacatgagcacgctcgtcttcctttctcataaagcacagacctagaaatatttctcggtttaaaaatagtgttttccctacctcgagtcaaggttcagttctcatctctctaattttagttccttgtttttatgaactttgaaatgttttccttaaccagaaaacagaaaaaagcaatcccagagacaagggaaatttcttgctccatttccctgtagtaaaggcatttctatgtgagattttctttttatcctgagcaggttatcagaaaccaaaattttgaattaggagtttaaagaagaggcaagggggaaaaagtgctctctacgggaccttggttgccatgtggaatgtttttggagcataaaattgatatttttacaaaaaaaaaaaaacgaaaaaaatgtttctggtagaggcctggagaacgccgtcatgattctgaaggtgtatatattttttattgtttctgtcaaactaattttatataagacattaatggaaaggtcaaaacacataattctctgaagcctattagaaaaatttcttccgttgggctgggaacggtgggtcatgcctgaaatcccagcactttgggaggttgaggcgggaggatcactcttgaggccaagagtttgagactagcctggccaacgtggcaaaaccccatctctatcaaaaaatgtatatatatatacaaaaattaatcgggtgtggtggcgcacgcctgtagtctcagctactcgggaggctaaggcaggagaatcacttgagcctgggagatggaggttgcagtgaaccaagagcatgccactgcactagagcctgggcaacagagcaagactgtctcaaaaaaaaagtaaagaaaagaaaaattacctctgttaacttctttaaattcttaggtacaggtggtaatttttttctttgttaaaattgatgttggtcattttgtgtttgagttttctgttgctatttcatggggattttcctgtgcatctacataatatagtatttctttgaattaatatgccatagtttaatcatttcctgtttgagctttttagattgcttgaaggtttttctttcctttgtaaatactgcagctttaaggaatgtgtgacttttgaagctctctgtttaggcagatggcaaagggggtgaccatcttatttttattaattttttattataaaagtaaaacatgtttttggtgttttagaaaagacagataagcaaaaagaagattaaaaaaacatttaccaactagagatagccattttgaatgtttcaacatgaggtttttagactttttcagtgcatatacgatatatatcaaatatttattcaaaatcaaatatatatcaatgcatataaatatatatagatataatggtgtcatatgaaacaccattaacaccattaaacaccattaacaccattaaacaccattaacaccattaaacaccattcatggatcatgaatacctttccacttaaatctgtatgtacatctttgtttattttattttattttatttttttgagacagagtcttgctctgtcatccaggctgaagtgcaggggcatgatctcggctcactgcaacctctgcctcccgggttcaagagattctcctgcctcagactccccagtagctgggactacaggcgtccgccaccacacccagctaatttttgtatttttagtagagacggggtttcaacatgttggccaggatggtctccaactcctgacctcaggtgatccacccaccttggcctcccaaagtgctgggattacatgcgtgagccaccatgcctggccaagtctgtacatacatctgtatcatcattttaaatgacttagattttattctggggatgtactataatttattcaggaaatatctcttgttggaaatgtagattgtttccagctttgaatcattgtatatcacaatatgaaactgttaataatccagccatccctcacatcaggatgcattgtataatttaatggtatgtcatagtttaattggcagcactttgcattatattttaatagaacaaaaagtaatgaaacatcatcattggcatcttagactcgatgaaatataatattgtcaattataacagtgtgatgaatatccttatttgccgttgtctttgcccacgataattagtagtggggccaaatctctttttcatatgtgtgttgcccttttgtatttcttcatgagttgcttgtgaattggttgtcttttccttattgatttgtgaaagttctttatttatgtaagtatcttaaatctttgtcttccatatatgttgtaaaatgcctcccattttctaatttgtctttcaatcgtgatatttcttgatatgtggaaatttaaaatctttatgttggtcttatctatcaatcattgtttatggtttctacctttagtatcatggttagaaaagccttccccacctgagaactatgtaaaatattaacctatattttcttctaatacttttatgtttttttttttttttttttttctttttttgagacagggtctcactctaggcaggctggagtgcagtggtgtgatctcactgcagctttgacctcctaggcttaggtgatcttcccacctcagcctcccaagtagctgggactacaggtgtacaccaccacacctggctaatttttaagtattttgtagagatggaggtctcattatattgcccagtctggtctcaaacttctgagttcaagcaatcctcccaccttggcctcccaaagtgttgggataacaagcatgaaccattgtgcctggactggatataccaccattttaaaaaatcagtttatcagttgatgaatatttgagttgcttgcagttcttggctattatgaatagagttgctgtgaacattcacaagtcttccgtggatgtatatttttatttgtttcggttaaatgcataggagtggagtgactgggttgtatgatgagtgtgtttaactttataagaaactatgaagctgaacatgttatttttctttgtaactggacacttaattgaatgcttattgtgtctgaatttttttttttttttctgaagcagagtctcactttattgcccaggctggagtgcagtggcaccatcttggctcactaccacctctgcctcctgggttcaagcaattctgccgaagactcccaagtactaggattacaggtgtgcaccaccacgcctggctaatttcttttgtatttttagtagagatggcgttttgccatgctggccaggctggtctcaaactcctgacctcaagtaatccacccacctcagccttccaaagtgttgggattacaggtgtgagtcaccgcgcctggcctgtgtctgatttttaaaaatcagatagccttagatttttcttggcagaaaatcatataaatttaaaatcccctccttttcagtttttatatctcattttaaaaaattggactgaaaggtaaaggccaaaaatatgcctattctctgcttaggagttacagtaacttttgatgtgtgtgtgtgcatatacctgtgtgcgtgtgtgtgggtgttttcccgctgtaagaaaagaaggcatgatgtaatgtgcaggaaataatcataataaagagaatgctggcgtacttcttgagtgctcattgttgctaaattggtcatttactcctaaaggacgttggggaagggtgtgtttgatctctctacagccagaaagaccacctgaaaaccctcctgggcctcgtgaatctgctcatctctccagatgtcacaggaagtgtcctcggagggggacaaggctgtgctgttccatgcaggcatggtctcaggctgttcccaattgtgagtgagttttgaacaaaactgtaacttccctgtatagggcttacagttggcctcatcttacaccctgtagtccagtgagtccgcatgctagctgtggaaagcgtgtacagaaaggaggctgattcttttttttttttttttgagacgaagtctcaaccttgtcccccaggctggaatgcaatggcgtgatctcggctcactgcaacgtccacctctgaggttcaagcgattctccttcttcagtcccctgagtagctgggattacaggtgcctgccaccatgcccggctaatttttgtatttttagtagagacggggtttcaccatgttggccaagctggtctcggactcctcacctcaggtgatcctcctcccttggcctcccaaagtgctgggattacaggcgtgagccaccgcccccagccaggaggctgattcttaattattgatgcactgcagcctgggcaacagagcaagaccttgtctaaaaaaaaaattattgatgccatttggttctctttgaaactaattaatggctccttaatttgtcagtgcatcttctagcgatcacagttgctgtttgggtgctcttgtcagtttttggtaaccatttctggtattttcttttcaaatccccagcctcactttgtgctggttatcacaagatccacttagaccttagaggtgagagcttgggaatatttcatctgcaagaaaaatcattcgtctgtctttgtgtgggacgagttaggttatgtaagctgatggaacacgaaacagaaaactggagcctttttctttgggcacacaaaaatgcaaaaatctaaatctcttattttgttgaatttttaagtggaaggagttgtagatttgccaccatcagtcctggagctgacttgaatttttcttttaggctcttgttagcttttctaacagagatgtcacagattagcaactaggcataaacctgagaaattgggcactaattttgttttgcatttttgttttgtaagacgggggtcttgctgtgttgcacaggctgcagtacagtggctgttcacaggtgtgatggtagcgcactgcagcctcgaactcgtgggctcaagtgatcctcccacctcagcctcccaagtagctgggaccacaggcatgtgctacgccacccagctgttattttgcatttgctctgtcatcacgttgtgcttttgtgcctgccttttctcctcattaactagatatctgtcacttaaagaaataacagcgatgcatttcaggataatagaacccctatgaactcttccagacttaaaatttatctgtttctccaaaaaacactgcctgcatttttcccaaataagccagatactctcattagccaggtatctgtgcaggttggacccctgcccaccttacaagatccagtagcatctccgttggaaagcttttcctgagccctcccgcctggcccccccgctgccccagccgccattccttgccaggtctctttttacctccttttgcgttaatgggtctttggagttgtgtctccccttcactgagctctccaggacacattttgcaacatttttgtgtccctggtgtatggtgtttagcagacgctcagtatttacatgttgacagattgcacacatgggaccgggtacatttcttgccagtacatccagttttcccttacctcttctgctgtaaattaatgttcctctggggtttaaaaaattaatttagtggttaatttagtaagagattaaaattaggcactggccaggcacggtggctcatgcctgtaatcccagcactttgggaggctgatgtggacagatcaccagaggtcaggagttcgagactagcctggccaacatggcaaaaccccatctctactaaaaatacaaaaattatctgggcgtggtggcacatgcctgtaatcccagctacttgggaggctgggacaggagaattgcttgaacccgggaggcggaggttgcagtgagccaagatggtgccactgcactccatatatatatagtaacaggtctcaccttgtcacccaggctggagtggagtggcatgatcacagctcactgtagcctcagcttcctgggctgaagtgatcctcctacctcagcttcctgagtagctgggactacaggcatgcaccaccatagctggctaatttttctatttttttgtggagacggggtctcaccatgttgcccaggctggccttgaactcctgggctcaagcgatcctcctgcctcagcctctcaaaagtattgggattacaggtgtgagccactatacccggccataaagtagtacttaaaagtgtaacaactttcaataaatctttgtgagattcagaacaaccttttgaattgtctatgtaaagaaataccgaactgcttttttttcccctcgatcactttttaaccttccactttgtagacaatttgctagtgtgttttctatttttttttttttttttttttgccactgggtattgccctgtcatccagactggggtacaatggcatgatcgtagctcactgaagcctcgacctcctgggctcaagcgacccacccgcctctgtcgcccaagtagctgggaatataggcatacaccaccatgcccggctaattgtttttttaatttaaattttgtttttttttttttgcggaggcagatcctcactatgttgcccagcgtggtcttgaactcctggcctcaagtgctcctcccacctctacctcccaaagtgctgggattacaggcatgagccactgtgcccagccagatttttgtcatgattctatttttatctcttctatcgatttatttcttatatattttttctcacttattttaagtgattgcccgaaatttacaaagtacattttttatcagtatgcctccaaatattataccatttattatataagaacctcgtaagaattcttcataactgtaagttactacaaggttctatgagaaccttgtaaatgtttatgatgctaatagtgtcataataatgtattttatatatattataaacctcataacatgttatttttacagaaaattaccttttagagcaatgccgtttgatgaaacttcctgcaatgatggaaatgttttatatctagactatacaatatggtagctactatccatgtgtgaccattgagtacctgaaaacaactgaattttaaataaactagtttaatttaagtaatttaaatttaagcggctgccatatagacagtgtagttttagaacaatggaagattttcaaaatacttttgaaaattattttgaaaatctttcttctttttaggccacttcaggaactcttcgtttctttgtgtagatctataggtttctgtctcatctcccgactgaaaaacttcctttaacattttttatgctacaggtcttctgggaataaatgatctcagcctttgtctgtctgaaaaagtttttatttccctcccattagaaaatgtttttaggccgggcacaatggctcatgcctgttattcccagcactttgggaagccgaggtaggtggatcacctgcagtcaggagttcaagaccagcctggccaacatggcaaaaccctgtctctactaaaaatacaaaaattagctggatatggtggtgagagcctgtcatcccagctacttgggaggctgaggcaggagagtcatttgaacccaggaggtggaggttgcagtgagctgagatcgcgccattgcattccagtctgggcaactgagtgagacttttgtctcaaaaaaaaaaaaaagtttttaaagagggctgggtgcggtgactcatgcttgtaattccagcactttgggaggctgaggagagttgatcacctgaggccaggagttggagacctgcctggctgacaaggcgaaaccccgtctctaccaaaaattagctgggcatggtggcgcatgcctgtagttccagctacttgggaggccgaggcaggagaattacttgaacccaggaggcggaggttgcagagagctgagatcacgtcactgcattccagcctgggcaatagagtgagactctttctgaaaaaaaagaaaatgtttaaagaaaaatttcataccaaggagatccaagagacactcatttttaagagtcggttttttcttttttttggttttgtttgtttctttttttttttttttttcttttaggatatgaaggtttgtgttgaaaaattttttttgcaacttattcttttagtactttaaagatatcacaccactgccttctggcttttgttgttttggtgagaagtctgctataattcttttctttgttcctctgaatgtaatatgtttcccaattcccactgtcaccccggcagcttttaagattttctctttatttttagttttcgacaatttggacatgatgttgttttggtatttctcttttttggagtcctctaaacttcttggatctgtgctttgatgtcttttattatgtttaaaaaattattggccattatctcttcaaatatttccttctatcctttctttcttcttcaagcattttcttttttcttagaaacatttaataggggcttatgcacagaagctatgtctgttctcaagcttctgttcattagtctgtgaactggggctgcagcgagaagagacagtggatccctgcaccattatcccctggtcccagggcttgtataccgtagggaaggggtgattcagagggatgtgtaggtcagtgtgagtacaataacatcaaagttgtttgacctaaggtcaggctttatggtaagttcttggtcttacacgaggaacagcgcataagctggaaatctcagagggtttcctggaactggggttaatcagaagccacatggcggagtagcatccacgatggagctacttcagcctccacagtccactcttgtaatccagctcttgtaatctcacatgccctcttcttccttcatggtccctgagcctttaaggagggtgcttgatactgtatagctttagcagcagtgccttggtcatggaaaacagatcgggcccagtgggattccaaacaagggagattcacaggcttttaaatcgtcttcagtcttcagaatgcagtggctttggttctgtcagaataggcaaaacaatgtgagatatataacatcgatcactcggatagtagaattctgtgcacacagagattgcaatagaaagagaatcgcctgtaatcccagctactcaggaggctgaggcgcgagaatcgcttgaacccgggaggtggaggttgcagggagccgagaccgcaccaccgcactcccgcctggatgacagtgagactctgtctcaaaaaccaaacaaaaaaaccccagaattcgtgggccagaacaacaatgaaaaaagaacgtattctgttaagaagccaactaaaatgcatcatgatgaaaattaaaactcggttcttctttagagacttgttgcagccaggaaatggttcaggattagcccaaattgtaggcagataataaaaactcacaaacaatggttaaggctagaatctaaatttttctttctccagtttccccatttctaccagggataaattatatatataatagtaagaccaatttatttgcaaaacaaattttagttgctttatacttggcctgaagatttgcatcaaatgtagcaagaattgtgatccaccatacggaccctttttaagttggctttgcaggaacctttataaggaattttggatttgactttttaaaagcctcaatgccagatattgatctgttttcaacttttttgattttttttttttttttttttttttttttttttggagactgagtttcgcttttgttgcccaggctggagtgcaagtagcaccatctctgctcactgcaacctccgcttcccgggttcaattgattctcccgcctcagcctcccgagtagctaggattacagacatggatcaccatggctggctgatttttgtatttttaggagagatgggatattaccatattggccaggctggcctcgaactcctggcctcaagtgatctgcccacctgggcctcccaaagtgccgggattacaggtgtgagccaccacgcctggctactacttggttactttgtaaccccgcctctttgatgggtcaagaaaagttgtggttatattatttatcttggtttttattattattattattttattttttgagacggagactctctctgttgccaagactggagtgcagtggtctgatcatggctcactgaagccttgaccttctgggctcaaagtaatcctcccatctcagactcctgagtagctaggactacatgcatgcatcatcacacccagctcatttttatgtatttttgtgtgtagatggggtcttatgttactcaggctggtctggaactcctggggtcaagtagtcctcctgcctcggcctcccaaagtgataggattacaggtgtgagccactgcacttcgcttttttctttttaaagagaaaggatctctctatgttgcccaggctggacttgaactcctggactcaagcgatcctcctgccttggtcttcgaaagcactgggattacaggtgtgagccaccaggcccagccagttttaatttctgttaggtggaatgacattccaggtttctaaaaataacttctacttggttatttttcaaaagttttgttgagttcagtaattatataaggtttataacataatattatttgaaactttcatccacatcctattctttactggtagagaaaagccacatataagaaatacatgtgtgtttgtcttttataaatatatgttacccagttttccagttactagctgcaagttttttttccaggtcataatttggagaaaaatatatgcgtgaaaattataacgataaagcttattttctatacaacaaacagtgagtgatatggaaatgtatgtccttactagtaattttaaaagtacaaaagagaatgccttaaaagtacacacacacacacacacacacacatacacacacatacatatttttttgagacagagtctcactctgttgccgaggctggagtgcagtagcgcaatcttaactcactgcaacctttgcctcccgggttcaagcaattcttgtgcctcaccctcctgagtggctgggattacaggcatgtgccaccacgcctggctaatttttttgtacttttagtagagacagggtttcaccatcttgggcagactggtctcaaactcctgccctcaagtgatccacctgcctcagcctcccaaagtgctgggattacaagtgtgagccaccatgcctggccgcattatatactttttaaggcagagaaaattttctaaaacttgatgggtggcctgttgttgctggttcacttcttctaaagaacagaagtaagaactgtaacactgtccgaatcctgggagagtcgccttagaagatggtcctgtagatacaagagaataatttactcaatgatacgaatataattgagaatagcaaaaattgaacagcagccaaattggtgatgagtgaggtaactctggtaagtcaccctgatagaatatattccatttattcattgttcatagaatatattctatttattcgttgttcttccaacctttgttgaagccccactctgtcagactcggcaccaagtgtctgagatgccttcgctcattacatcttcacggctcccccgagaagtagatgttactttcattatctgcattttacaaccaaggaaccgggatattaaattacttctctaggtcatgcagctagtgtgcggtgggctaaatgtacaatccccctaataataataataataataataataataataataacttacaacaacagcatattgaaataagaataaaaatttgaaaaatctctttgattcgtaaagatgaaaaaattgattctagttgttggtggtgagaggaaagggaacgcaggccctctgaaacactgttggtgggactacgaattgcagaaacctttttgaggacattttgcatatcttcagaatttcacatgtcatgccatttgaccaagtcctttcacttttagggatttaccctatggcaatatttgcacaagtacaaaaatgtatgtatgagaatcttggttactgtctttcttgtaatagcagaaagtgggaaatcacttgaacatctattaggtggaaattatggtctgtccttatggtggaatagttgtaaccatttgtaagaatgagatagatctgcgtgtacccatatgtgcaaaagagccaccgtgaattgtttttttttttttttgagatggagtctcgctttgtcactcatgctggagtgcagtggctcgatcttggctcactgcaagctccgcctcctgggttcacaccattctcctgcctcagcctcctgagtagctgggactacaggcgcccgccaccatgcccagctaatttttttttgtatttttagtagagacggggtttcaccgtgttagccaggatggtctcgatctcctgacctcatgatccgctcatctaggcctcccaaagtgccgggattacaggtgtgagccaccgtgcccggccatgaactgtgaattgaaaaaagcaagcaactgtaccatatgtaaaacatgatctcattttccataaaatagcgtgtttaataatgtgggtctagagagataataatacatgcattgaaggatatatacaaatttatatatagcgcgtgttctttacagtgggattagaggaacttgtactaatattttttttgctttgttttttttttgcaacagatatgattttattattagaaaaaccagatttaaaaaaagccattatatgagttttcctagttggcaaaaattcattatatgagttatcctagttggcaaaaaaggcacttaagtgaggaaaggagatgcaaaatcatccttgactgtaaaggggtgcaggtgggatatgagcttgtctgggtatgagaatatcatgttctatgcattttttatttcctaaactgcttaaattataaatcattaatggtaattattaaaagactttgttttccctacaattagaaaaacttatttgaagacctcaaatcccaaaagtgaaagaggaaaaaaaaaattattgccacggtttttcccttaacccatttaattaaagaattaattaaattctatgttgcagtttttcaccaaaagtgcaacatagagttagttcagtcaccacaaaaagattcagagattggattttgctgacttagtgaagctactaagatacaaattcacaaagtaaatgtttgcacacattagctacagtggcaaagtgtttgggaggttgcagtccacctcccggtgagggagatccatccttttggtcagcaaatgccctgaattgaccctctcccgagggtcagctgcaggctgtgctgatctcggaacttctctgggggtccagttctgtttaggacagaccataaaatacatctctctggggtgggtagagctaccccagtacttaccctggaaatggactcagctgtccctggagggtgactcagttgaggcagaattgtcttaatttggtaactctcctaatttgaagcagaagtcctgggtttgacccagacccatcttggtctggagtggagttgtggtgtgtctaatgctgccagatcatgttcactgttagaagcctggggaagggaaggaacttgctcagccaactcagaagcaggcatagcgcaagagggaggattttaagaattagtattttactatccttgtgagctggtgttattgacaaacattatttcaatctgtttaacgattttaagaattagtattttactacccttgtgagctggtgttgtttctaaatattatttcaatctgtttaacaattccattttttaaaaaccctgcactttgggcaggagttcgtatttctaatttaggatgaattttttctcatctccccccattctgtgattctaattttttttaagttatttcagttcttaaaactctttcatagagctgggcatcagccgcaattttctctaaatctgtctcagatgagcacttgcagtctaattgtataaaagatcaggaaatttagtattgaagttgcacttgctttgatgtaatgatgaatgtttccttcatctgaagagcatttgaaatttatggaaaagtaaatctttttgaattatatgtaaatgaaaacgttgggatgaaccaggttatgtttaactgggcagttttgaaattctaatagctcctacaagcgggaatcttttaaagctaattttgtgatatgaattgtttattattctaaagaataatattcacttttttttcatggatctcatgtaaatgttactggacaatatgacccatctctttaaaaagtgaaattgttagtgggaagctgtggctcacacttataattccagcactttgggaggctgaggcgggaggatcacctgagcccaggcatttgagaccagcctgggcaacagcgagacctcatttctacaaataataaaaacattagctgggtgtggtgacatgcatctttggtccaagctactctggaggctgaggtaggaggattgtttgaacctgagaggtggagcctgcagtgagccctgatcgtgcccctgcactccagcctgggcaacagagtgagacctccatctctaaataaataggtaaaggtaaaatcactgctcagtcactagagagaggagagagaaaagtaaatatactcaaggagtgggaaaagctttgaagtggcatatcaaaatgagaaaaataagtgttttttagagagaaaagatttgtggagaattatatattagaactatttaagacttcttaaaacttcacgattatatggttttgtaaggtttttggggattttcataatgagatgtagatggaacgtccccattgcccatcatagactattcaggcaagttcatacccattcctagaatggagaaccgtctcctctgcggtgaagaagcgcccctgttccttaagaggcagcagcaggaggtggaaaacaacatcccgcttgctaaagtcatgggccttagtccaggcgcggaggctcacgcctgtaatcccagcactttgggaggccaaggcgggcagatcacctgaggtcaggagttcgagaccagcctgtccaacatggtgagacccagtctctactaaaaatacaaaactgagccgggtgtggcagtgggcgcctgtaatcccaggactttgggaggccgaggcgggcagatcacctgaggtcaggagttcgagatcagcctggccaacatggcgaaaccccgcctctactaaaaatacaaaaattagccaggtgtggtggctcatgcctgtaatcccagctgttcgggaggctgaggcagaattgcttaaatccgggaggtggaggttgcagtgagccaaaatagcgccattgccctgcagcctgggtgacagagtgagactccgtctcaataaataaataaatacataaaaataaagccatgggcctcgatgggaggctgtacattgacgtgcgacattcgacttctgccattatttcagatttcgcacctgcccttctggcaacatggtgttgctgtgaggatcttgagaggagatgaatgatgctttccaagtagtaagtattattccattagggaaaataggaataaaattggaaagcatcaagtatttgaaaggaaacgaaaacagggcttactttccctttcggccagcgttagaagggtgcagtttggaattgaaagtgaaaggagcatgcacgtgttcggggcaggttgcggggagagtgaagatcattttaaagaccctggtgctttgatcttagagcaccactcatttgtactcagttcagatctaagtgaattactgtgcaaacgacatgacgagagaggggcattttccaatagtagcttctggtctggcacatgagccagttagagattgacacacgcagtcatgtagctgctataaattgaagcctggtgatggacgtactacaggcatggctgcagcgaatgcctatgacctttcacttctcctccctctgtcactctgtgtattcgctctctccattttcctccctcacctattcaccagccatgaatcaggagtggactgggcaaggatcagcctgtagggaaatgatgtgggccgagggtaaagagtgaggaataattaaggcagcccttgaattagttgtacatttttttcttttgtgtagtcttcttttttttttgtaagcaaacaaaaaccacgttgctggccaaatgtagtggctcatgcctgtgatcccagcactttgggaggtccaggtgggaggattgcttgagtccaggagtttgagaccagcctgggcaacatggtgagaccctgtctctataaacaaataaattaaaaaaattagctgggcatagtggtacccacctggagtcccagctaatggggagactgaggtgggaggattgcttgagcccaggaaactgaggctgcagtgagctctgattgtgccattgtactccagcccgagtgacagagtgagaccctgtctctcaaaaacaaaaaacaacactttattatggatgatttcaaacataaacaaaagtgaagagagtagtataatcaactctcaggtacacgttacccagcttcagttacccactcataacctttcttgttaatttctacaaaaagcttgctgggtcttgttgaatctgttgatcaatttgggaagaaatgccatcttaacaatactgagtccttcaatccaagaacctggtatctccttacatttatttagatattatttaatgtatcaacaaagttttgtaattttaacttactaattttgatgctattacaaatggaattatttcttaattttgtttttggattgttcattgctggtatacacaaaacagttgatttcctgatattgattttgtatcttatgaacatgttaaacttgcttattagttctagtagttttttgtagactcctgaagattttctatatatagagctagtgaatatgaagagttttacttgttttccaatctgtgtcttttaaatttctttttcctgccttattgttctggatagcacctccagtacaatgttgagtagaaatggtgagagtagacatccttgttttgtttctgaacaaagaaccaacttttggtttcatcagttttctctattactttccctaattcattgatttctggtctagtatttattattgccttccttctgctttttttgggatttagtttactctcctttttatagtttcttaaggtggaaactcaggtttgtgttttttttttttgagacatgatctcgccccgtggcccaggctggagtgcagtggtgcgatactggctcactgcagcttccaccttccaggctcaagagattctctcacctcagccccccaaggagctgaggctacaggtgtgtaccattgggccagctaatttttatttttattttttgtagacacagggtctcactatattaccaaggctcttcttcaactcctgggcttgagcgatcgtcccagcttggccttccaaagtgttgagattacaggtgtgagccactgttccctgctgatgctcagtttattaacttgagacttttcttttttttttcctgatacaggcttttaacattataaatttctccctaagtacttctcatagctgcatcctaaattttgatctgctgtgtttttcttttcatccagtttgaagtatttttaaacttcccttgtgatttcttctttgacctttgaatcctttagatatgttttctaatttctaagtagttggggagtccacaaatttatttctgttcttgatttttaaaaatttcattttggtagagaacatgctttatatgattttaattcttttaaatttattgatacttgttttatgacctagcccatgattcattctagacaatgcgatatgtacacttgaaaagaatatatattctatttgttgttgcttgacatggtctacagatgttagttacgtcaggttggttgacaatgctgttcaaagtctgtatatccttgctgattttctgtttaactattatgtcaattattgagagtgggatattgaagtctccaaacattattgtgaattgcctatttctccctttggttcagtcagtgtttgctttattgtattttgtgctctgctattaagtgcttatgtatttatgtttttatatattcctcatgagttgacccttttattgttacaaaatttctttttctcttataacttttttgtcttaaagtttattcagtctgtgggatttttttgtgtttttgtttgtttgttttgagacagggtatcactctgtcacccaggctggagtgcagtggcacaatcatagctcactataaccttgaattcctgtactcaagcaatccacctgccacagcctcccatacttactttgatattattatagccactgcaactttcttatggttttgtttgcatagtacatttttctccatctgcatctcttgcagacagcacatggttagaacttctaaaaaatttaatctgacagtcttcaccttttattggagtgtttaatccatttacatttaatgcaattattgatatgcttggattacatctaacattttgctatgttttctctgtctcacatctttttgttctgtttctccttactgttttcttttgtgttaaatagatattttctagtgttctgttttcatctgtttggtgaggtttttaatattttttggttatatttttagtggttactctaaggattgcaatatgcatctcatcacagtctactttttaaagatctatatatagcttttaaaaagtagagatggggttttgccatgttgcccaggctggtttcaaactcctggattcaagtgatccttccatctcagcctcccaaagtgctgggattacaggcatgagccactgtgcctagagctcacagtctactgtagattaatgctaattcattttcaataaaatatagaaactttgttccattaaatgtctatgtctatctacctcctctgtggtattatgtcatgtatatgatatctttgtatgtcataagcccagtagtaaaagtctgtagttattgttatatgtacttgtcttttaaatcagttaagtgtaaaaaagagactatttataaatctgctgtatatttgcctatgtaattagtattactagcattctttatttcttcatgtggattcaggatataatctggtgtttttttctttcatcttgaagggcttcctttagtatttcttgtaagtagggtctgccagtaacaaattttctgtctttgtttatctaggaatatctttatttctacttgttagttttggggtatggttttgatggatatggaattcttgattggaagtttttctttcagtgctttgaatatgtcattttactgttttctggtctctgttaatttctaacgtgaagtcagctgttaatcttatggtagtgctccttttcatgaagaaccattttgtcttcatgcagtcaagattttctctttgtttttggcttccagcagtttggctatgatgtgtcatggtggctcactttattgagttggagttttttgagcttactttgagtttgttggatgtgaacattaattttttaaaatcaaatgtgagaagtttatgccattagtttttcaaaaatttttttctgcttccttttgcttcgttttcttttgaaacttcctttatatatatgttggcatgcttgatggtatccctgtgtttctgaggttctttttatttttctttatgcttttttatttcttcttcagattggataattttaagttcactgattctttcttctcccatgtcaactctgttgttgagcccctctagtgaacttttcattacagttattatacttttgaactctagaatttctgtttggtttctttttataatttctgtctctttattagtattctctatttgatgagtcattgttacatactttcctttagttctttaaacatgaattccttcagttccattcttacagtagtttcttataactttgaaatctttgttaagtccaatatctgggcccccttagagtttccagttatgactcttgcctgagtataattcacaatactttatgtttctttgcatgtcttatattttatttttttaagctctgtattttagttaatacgttgtagcaactctggattatgatcacctttggcaaaatgcaggtttgttgtttatttctttttgtttgtgacttgcctggattaattctgtgaagtctgtctctgtagcagctgctgatgatcctgctcattttttttttcttatttttaaaatgtgtttaagcctggctttgcaggggttaacccaggtcagcatagcttagtggtcaggcaatgattattcagaggtgtgctgaaacaccttgagctactaatgcttttcacagtttgcggtggatatgtgtgtacgtttagggacatgttcagaattcaggcatatattatacgagcctgtcttggtttttcctttttgccaggccttttctggcctcctttgtgcgtggggtaggcctcactttagccaaggatgagtggataaccagggccctcttcagtctttcctgcctgtgtgcagccttccagagcacgaagaatgtgtgggacttcagggactttaccactgcccgtgatagctcccttattctctgtatcttccggctaggtttttggctggtctcctgatctgttggttgccacaaccggcattgcaggctcagggtggctgagatgttgaccttctgtacatttcctgttgtttacaggaaatcaccgtggtttatgtcagtgcctttgggcatgtgctctcctccaaatcaagtcaacccctccagcagtggagccaccaattttcacagctcgtcccaccctggtagatgtagcagcatgggtgagctgaggggaaggaggggagcccctcaagccaaagcatcacagaacaccaccgctctaactcaagatttggtcatttttcttcttcattttattttttaattcttgagatgaggccttcctctgtcactcaagctggcgtgcagtggcacaatcatagttcactgtaacctcaagctcccaggctcaagagattttcccacctcagcctcctgagtggctgagactacaggtgtgcatcaccacgccaggctgacttttttgtttttcgttgagacggggtcttgatatgttgcccaggctggtctctgactcccagcctcaagcaatcctcctgcctcggcctcccaaagtgctacaattgcaggtgggagccaccatgcccagctgcgtagtttttcttgaataaacatttttcaattttttgtatgtctttggttgatttccaaccctgtggtggttgtttttgaccgacttgtctagttttgttgttactttttgaggagaggttttgccaagcttctcacttcattattccagaagttcttcccctctccccaggtcatctttttggttttttcttctaactttctttccttctttttttttctttttttttttttttgcgatggattctcgctgtgtcgcccaggctggagtgcagtggcatgatctcggctcactgcagcctctgccttccaggttctagcacttctcctgcctcagcctcccaggttgctgggattacaggcacccgccaccagctaatttttgtattttttagtagagatggagtttcatcatgttggccaggctggtctcgaactcctgacctcaggtgatctgcccacctcggcctcccagagtgctgggattaaaggcgtgagccatcgtgcacggccggtttttcttccaactttctaagtactataagcttgttgtaaaatttggcaatatagaaatgtataaaatggaaatgaaaatctttactaatcccatcccttaaagatagccactgttaataagttagtgacttgctttccaagctttaatcatctttctttaatcatcatatttttgattatatcctcttaccaaaattcctttacccctcaccacaaaggtttctaattcagagacttcctttagctcccttgattcaaggagataaagttaattagcaatcaggagatgaggagccctttcctggcaaggacagaattctaagacggagggatttttagctcctcggtggactcagttccgctgcaccttttgcagcatcttgcctgctgggtctcctctctgcagttttcttgttccctggccttttatcctcctgatcacacataccttcccaggttctccaggaaagtagtggatcagtcacttccccctgcaacgtcattgtaggcatgattacatcttggagtgttctctcaacaagagtcagtgtagcatggggttccgggcctgagctctggtgtcacattgcttggagttcaaatttcaattcttcttcttttttttttttttttcttggagacaagagtttctctgtttcccaggctggagtgcagtggggcgatcttggctcactgcaacctctgcctcccaggttcaagtgattctcctgcctcagcctcctgagtagctggtactacaggtgcacgccaccatgcctggctaatttttgtatttttagtagagacgggggttttaccgtgttggccagggtggttttgaacccctgacctcaagtgatcttgccaccttggcctcccaaagtgttgggattacaggcatgagccactgcgcccagcctcaactctctttttttttttttttagacagagtctcactctgtcactcaggctggagtgcagtggcacgatctcggctcactgcaacctccacctcctgggttcaagcgattcttctgcctcgacctcccaagtagctgggattacaggtgcccaccaccacgcctggctaatttttgtatttttagtagagatggggtttcactatgttggccaggctggtctcgaactcttgacctgaagcgatctgcccaccttggcctcccaaagtgctgggattactcaactctccttcttagagtcctttgtgaccttgggttccctgggccttggttttctcatctctgaagtggggctgggagcaactcttggagcactgggttggaacgtgctggccacagtgctcacacatcgagaacacgccgtaaatgctccccgggcctccgcttcctggtgtcgtcatccttattcagaatgaacaagaaatcactccttcagagtaatgtttcagacagaggagagagctttgtgggggccctctggcgtgctcacagaagctttggtattcgtcaaccactgtaggagccaagcatttcctacagaatgcagggagcagggctggcggggagatagtgcgtgaaaagagaggctggtgttgggaaagaaacagagacagaacggtggccggcggacaaacgacaataagccaggatgatggtgtcactgcagccgggtgcggagtttctttctggggtgatgaaagtgttctaggttgatggtggtgatggttgcacagccctgtgtgaatatgctagacaccactgaattgtaccctggaaacagatgaattgtacggtatgtgaattatatctcaataaagctgttattaaaaaaaagatggacagtcccagctactcaggaagctgaggcaggagtattgcttgaggccaggggttggaggctgcagtgagccgagattgcaccacggcactccagcctaggcaacagaaccagacgcttctctttaaacaaaaacctaaacaattgtagatttttttaaaatgaggctttttgttttttttatgccaaaacccttcatagacatgaaataacagaagagtaagattggcgggggtgggggggggtttcatcagtacaggttacctgaaagaactgagttgttggtctgacctctgctaggactcgccatgtgtcatggcaggcctggcacctgaaggagagctttagcaatttgcactcacatcatcctggacctcagcctgggtgatggtcactgtcttgagacagcttcagaacaggcaacctgggtgtggccgccttgtcaaccagagataataaaaacacaggtaaacctctgcacctccatcgtcactccgaattataacaacagcacatatttgttgaagtcttactatgcactaggcacagtgctgagtgcccatgatgcagaggggaatttgagagtgtcagtcatttctgccccttcggatcacgcactgctttccagtgttcccaggagaccagttttgaggttagaattctgcttcttacagtgaggactgattctgactcctaggaggacgaaagccccttttaaatttactttggctgggtgtggtggctcacggctgtaatcccagcactctgggaggccgaggtgggtggatcacttgaggtcagcattttcagaccagcctggccaacatggtgaaacaccatctctactaaaaatacaaaaattacctaagtgtggtggtgcacgcctatcgtcccagctacttgggaggctgaggcaggagaatccctggagcccgggagcggaggttacagtgagctgagattgcatcactgcactccagcctggatgacagagtgagactcgtctcaaaaacaaaacaaaacacaacaaaacattactttgaagccacagcattttgcacaggtaggaaaactgctgggcctggagatcttctataaatatgttgagagctgatgttgaagagattattgaagaatcctgatgtcacagaattttctatagacaacctccttgcggggagggcgcagctttcgggttctgtatcgcacaacaccggctgggagctccctgcatgtgtgtttccagcactgcctgtctatgggagctaaggaagtggcttcaaaaccgcttgccagagacgcgcagtcacccagtcgttgcagcgcttgtacttgtgggagctgtcttgcaggctcaggcatctttgataaggaattcctcatacttagaagtggcacctttgttctgctggggaattgttcccaaaaggtatctttttttttttttgaaacggatcctcgctctgtcgcccacgctggagtgcagtggcaccatctcggctcactgcaagctctgccttctgggttcatgccgttctcctgcctcagcctcccaagtagctgggactacaggcgcccggcgccacgcctggctaatttttttgtatttttagtagagacggggtttcaccgtgttagccgggatggtctcgatctcctgacctcgtgatccccccaccccggcctcccaaagtgctgggattgtaggtgtgagccaccgcgtctggcctttttttttttcctttttgagacagagtcttgctctgctgcccaggctggagtacaatggcctgatcttgactcactgcaacctctacctcctgggttcaagcaattctcctgtctcagcctcccgagtagctgggattataggtgtgtgccactatgcccagctaattttttgtatgtttagtagagacagggtttcaccatgttggccaggttggtcttgaactcctgacctcaagtgatctgctcgcctcagcctcccaaagtactgggattacaggtgtaagccaccacgcctgaccccaaaagacatctaaaaaggctttttcacttgtgaaatctgctgaatagagctggcttcctgaggcctgggggcccttcccggtgtggaagaatggctctgctgttggctaccacagtgctggggcctgtactcccacctcctctgcctctgtctgccttgtgtgcctccccttccgcgggggccctgctctctgcctctttctgaccttccagagtttttgaggtgtgagtgtgttgttgaatttcatttacataataattaaagagtcagggtttcatgatctactgatgtaaaacccgcaaaaaccctaaaatctcgagtggtgttgtacagcatgtgggattcttttgtataacttgatgattttcaaaatatccatttcggctgggcacagtggctcacacctgtaatcccagcactttgggaggtcgaggcaggtggatcacgaggtcaggagatttagaccatcctggctaacacagtgaaacccgtctctactaacaatacaaaattagccgggcatggtggcgggcacctgtagtcccagctactcgggaggctgaagcaggagaattgcttgaacccgggaggcggagcttgcagtgagccgagattgtgccactgcactccagcctgggtgacagagcgagagtccgtctcaaaaaaaaaaaaagaaaaaaatccatttaatcagagccatacttgttgattactacaggtgcttcccgtatctaatacctccagcaagaaggtttgcgaaatgggcagagagtaataggaagagtttcaggaagatggtttgagtgaaaatcatttcagaaccgagccctgcgaagtcttggtttctgcaatccaccacagtttgggaaaatcgggaattttgtttagtccatttctatttttgtgcaccacaaatatgtaaacaaagctgggatcttcgtcgggggcggggggaagggcgacagaaccctgacatctaatactggtcatcggtatttccatgtgtttcctgatcccattgtctctgctatttaaattaattaattccacaagtatgcactcagtaaatattgtgagccaggcactattctcggctctgtggttgcatcagtgaacaaaacagacgctaatcctgctttcgtgagccatctataatagaatgggcgagtcaagaaattgacacatgcattagaaaaatatgtagcgtgtcgctggtaagtgcttgagagctcatcagggaagggcaggagtttgtggagtgggggtgagggatgtggggtggggcggggcaagggtggcaagaggcctggggctgctggttgcaactgtaaccagagtggccagggaaatccttgctcctctgggtaatgccctatccagaagacccttgcaaatttctaaaatgctgtgttttattaccgagaaagagtcgtctgggagctctccgaggcaaataacttttgaagttggcatgagcaggatattgtgcaatggggctcactggctgcgtcccaggcctccgcatctgatgtgaaccacagctttgcaatcggtccccgtgccatccaaaaatattttgtgaccttgccggttggcagttttttaaaaatgttattttcagtctccaaaaaagggaaacatcaaagtgcaggctgtccactcctgcccttcttgatagacacagacagctgggccacacaatcagccattgtggcgacaagtgcccaactgttataaatagacggcgggctcgcacgtgaagcgctccagaggaagggcaagtgctctggggacactgccaactgctgtttccgtcgagagctcttctcaaagatcaatattattttatgtctcagtgactgaatttgaaaaaacgactgtgaaagcacctggtaacttaactgtctccaggattccattccaaacgcatcttctctcttcactgttaatcttagatgtttcccatgcttatttagtaatcattgcctgacggcccacttcactgcgatttacagtctcttgcggctcacttgaaatggtagagttatggataaccgcgctggtgtatgtgcgtgtgatgcgtggccggaagcgcatgcccattgaataatcacgttcgtcccacatcttagcccctcttccaagacatgtttactatcgtttacgtgtgacatgtcaaaacatcttaaaactatgccacgcatgtaataggctctcagtgattaaaaaatcagtttgtctcttaaggagaaaagaataacagcatgtgactcttgtgagtccctgacaaagaatctgttgttccccgtgcacttgaagagccgctcatgtcaagaagcaacttgtgattatgcaatgtgtgacttaaggcattgtcagatgcgttcggctgaaacgggaccccgccccagcagtttgccttactaagttaacatggtaggtcagattttagtattgtagaaaaagccacattcaatattctttgagtagcatatttatttcctagggctactgtaccaaagtacctcaaaccaggtggcttcaaacaacagagttacacgctagttgatatctagtgattcaaagaacagaattccacactagttgttatctaggaatgcggagtgagtgatagagggggttttggtggcgttatattctaattttgaagtaagtttaaatttacagagatgctcccaaacagtataaagaattcccaaatactcttcacccagattccctgaattaacattccgacatgtttgtctgtctgtctctccacatacacacatcccttttttccggaataatttgagaatagactgcagagagtgcctctagattctcctgtgtgggtttcctaaaaacaaggacgctgtcccggatagcctgcaccgacctgcccaaatcaggacgtgggcactgtcacaccatgccaccaaatgcagaggccccggagcccgcccaggaccacaggcgccgtctgtgtcaatggctctcgagtctccttcaatctggggctgttccttcgtctctgtctttcacgaccttgacatttttttaagagaacaggccagttactttgtagaatgtccctcggtttgggctggtctcatattccttcatgatgagaatcaggtggtaggttcctggcaggagagtccctgcagggttgtcacgacaggaacgcacacaggtctgatcagtcccatttctggagaagttaacttatcatttggttgaggtggtgtctaccaggtttctccactgtaaaattaatttgttggtattttgtaattatcagttaaaaagtactgtttctggtggggagattttttggggactcggaaaatatcctgtttctcattaagctttttgcccatttgttttagcatcctgggatgattcttgcctgagggaattagtatgagcattgccaaatggtgatgtttctagttgcattgtttcttttgcattgattagttggcattccactgcaagctggagcttgcctgctgtctttctctccttcctatcaatacactcatagactcctattttacccattgggttataattcattaccattatcatttgcttcgatacccagattgtcccagatttggccaaaagcagcgcctccaagctggcccctgtgttcttttgatgtgttcatgtcattctttgagcacatctttacttcttcttcttttttttttttttttagatggagtcttgctctgttgcccaggtgggagttcagtggcgtgatctctgctcattgcaagctccgcctcccgggttcacgccattctcccgcctcagtctcccgagtagctgggactacaggcgcccgccaccacgcccggctaatttttgtatttttagtagagacggggtttcactgtgttaaccaggatggtctcaatcccctgacctcgtgatctgcctgcctcagcctcccaaagtgttgggattacaggtgagagccaccatgcctggccaggttttttcgtttttgtttttgttttttttgagatggaatctcactctgttgccccggctggagtgcaatggcgtgatcatggctcactgaaacctctgcctcctgggtccatgcaattctcctgcctcagcctcccatgtagctgggattacaggcgtgcgccaccacacccagctaatttttgtatatttagtagagatggggtttcaccatgttggccaggctgatctccaacttctaacctcaggtgatctgcctgcctcgtcctcccaaagtgctgggatgacaggtgtgagccactgctcccggccacatgtttagttcttggttctaggctcacccggaactttccttgctccagccctggaatcagccatttctccaataagccctggttccttttagtagaaagtggtttttagaaaccaggatctaagtattaggtgtgttcacgctactgggctattacggctacaaggacttctcaagcagcgtagttaggaatttttttttttttttttttttttttgagacggagtttcactcttgttgccaagactggcatgcagtggcaggaacttggctcaccgcaacctctgcctcccggttcaagcagttctcctgcctcagcctccctagtagctgggattacaggcatgcgccaccacgtccggctaattttgtatttttagtagagacggggtttcaccatgttggtcaggctgggtctcaaactcctgacctcaggtgacccatccatcttggcttcccagagtgctgggattacaggcatgagccaccgcgcctggcatagctaggaaattaaacatatgcatgtacttccctacacgtacacatatgtttgtacatacacacacgggcacacatgcgtttgtagttctttgtatccatctgtcccgctcgtatctatgtatccattcatctcatataaaaatcatgataccatccaagtcaaatggtttgtttcagctttctcccctttccttggctgtgcccctcttttctaacaataacagtaacagctcttatcatattaactgtttttatttattgacccttgtatgtcaccagtcttctgacatgcaggccatccagtccatgttcctggcccaggaacatggcagccaagggtccccacccccacttcggcccccaacagtggactctcgggatagttctttttttttttttgagacacagtctcactctgtcacccaggctggagtatagtggtgtgatctcggctcactgcagccactaactcctgggttcaagcagtcctcccaccctagcttcctgagtagcagggactacaggtgtacaccatcatgcccgtctacttttgtattttttgtagaaacagggtcggtcttaccttgttgcccaggctggtggatagttctttatagcagtagcctaaacagaaaaacatatacaacataagctaagaaaaaggcctcccttatcgatatttctgggttaatctgaaagattttgaagtctggaagaatcagctggttgttggtaaagggacggtggacatgaaggatgcggaagggatgggttggaggcgggaggtgagtttcatgtggtgtttttgactcagagggtcacttttattgttctgccttgtagtcagaagaaaaatcttttcacgtggtttcggctcagaagtatgttagaaagtagactacagagactgaaggtgacattccagagactttttaaggataatctggccaaaggtgtttactatttgattagccagcatccttgggctcggctagggtcttggtctggtctgagaacatgttgggggattgtgccagtgtcggtggtgggtgcctgtgcctggtcatctatgggcagctaggggtgggtgctgccccttccgactttctctccactgcagagacgaagccttcagcagcatttccctggaccctcttctctctggtcccaggtcaggttctgtacagcaatggaaagcaggggagaggatgcccacgctgtgcgtggccgtttggagcagactcagggaccagtgggacctcctcttctgggtgagcttggcaaccactcttttaggaattccagtttgtaatgccttccgggtgagccctgtgagtcgcttgctcttagtagtgtcctttgctgccccagccttctgcttccctgtatttaaaacctttctgagccaggattacgatttcctgataccatgactgacccttggtcgttatgagtcctgatggtcccaggagcttttccttcatttgcttgggttttgagttgtgagctggagaccaggggttttgcttgatggggacattcctggctcttctcctggggagtgaccatgggccctgcctaggtgagatcctctggattgtgaggagggacttgagcagccctactagagtgccgtctatgggaaccctcagcatcgcctgtccaagccagcatctagtggacgctcacgctgtgtgagacactgagcttatccagcaagggcagaaatggcagctcttgggaaagaagggagtggggcatcgctgtgtctcctattatttgccattgtggcctccctctccaggtgcaccgaggggcctatctgtgtgattcttgcaggggtactgacgtccgtttcatctcacccgtgtccctctacaagtgcaggagttgtagggctatgttattcttaggtagcttaatggatccattttcataataaactccattttattttgtttgccattgtactgccatttgcggaacaaagagaagttatataaaccacagaagggggagaatgtgacccaggaataaactgttgtgtttcacagtaagtgtatggaactaatttagaatgatttttcattgtcaaacaaagaacaaatggaaatttgaacaatgcatggttacttttaacaaagacttcattttaatgttattagtgttttctcattttaaaatggcagtgcaaatataaccttaaaatagggtttatgactaattacatttcttttttgtatgtctgacaatttccaattattgggtgtttgtgttccccagcccaccctcccccaaaaatgacagggaacagaaaccagtgaaaagatctctctttggcgcccttcccagactaggacctgttttgttcagggtgagcacagaggagaactgggtcctcttgtcaggctgaaggggacgtcacagaagccccaagtgggtcacggcagagcgtcagccagaacctccagggctcactcccaggcctcagtcaccagatgcttcgtggctacctgggtaagggagggttcagggcaagttagggactgcaatgagaaaacaacacactctggccggatgcggtggctcacgcctgtaatcccagcactttgggaggccgaggcgggcggatcacctgaggtcaggagttcgagatcagcctggccaacgtggatttcaaccaaggacctgcttggtcatagatttcaaccgaaggacctgattggtcatggatttcaaccaaaggacctgattggtcatggatttcaaccaaaggacctgattggtcatgcagacagaactttgaaggctgtcatgggttgtgtccatgttgtttggttttccatcttgaacgaataccagtgtgcgtctaacagctcacacagaagcccattggttacaaaggaattgcaattgtcaatccaattgccccccagggagaactgaagatttttttaaataatgtcttcgtaacagctgtgtaagtcccccaggcccttaactagagaaaccacatcacagaattttatttactttataaattctaatattttagaattaagataatttgtagtttagatgatttttgctaagctagctctctctttctttttatctcttcctttctctcttttctttctttctttgatggagtctcaaaaaaaggagaagggtgtccaaacatcctggatgaaaatggctccatgctatcatagaattttatttactttataaatcctaatattttagaacttaaaaaagatactttgtagtttagatggttatagttaagctatttcattttttttaaaaaacgaagaaattagcattcaatgtctgcctagaaacaatcttatatacagtccttatgtacaaatcttttttgtggaatatgttttcgtagttttttgttttttgttttagattgggtcttgctctgttgaccaggctggagtccagtggcgtacttatagcttactgcagcctcgacctccagagctcagtcagtcctcctacctcagcctcccaagtagctgggactgcaggtgcatgccagcacacttggataatttaaaaaaaaaactttttttttgttgttttgttgagacggggtctcacttatgttgcccaggctggtctcgaacttctgggctctagcgaagctctttcattttagaaaaggatcatgtcacctcgatatgtgaggtctgtggaaaatcttgctttaagatgatctgcgtgaactagtagcttagattattgagtcttattttcttcagaactctgataggcacaattactagatttaagttaaagggctgtaaaacagcctcagtactttttcatgaagtagacaagtttcacagtgctttggaaatgactactaagctactcccagcctgctcattgagaactcacgatttcctctggatgagtgggaatgttgttggttctgcatttgtcatcagtgcttaggacacacacacacaagcaacgtgtgctggcccatgcagtttttccttatttacaaagctcatgtgagaattgtgactctgcccattcgtggatctgcacaacatatggtgacgaatataagttcgggggcgtggggggaatgcgcatgtgctatggttcagtgctgggcactgggtgttgtggttcagtgctgggcactgtgtgccgtggttcagtgctgggcactgtgctgattgcttctgcgactccggacagatacttaaggctcagctcaggttcgtcattaacacgaatcacaaattcagacctggtgccgtggctcacacctgtgatcccagcactttgggaggccgaggcaggagtatcacttgagcccaggatttggaggccagcccgggaaacataggaagacccccaactctacaaaaaatatgaaaaaaagtttagccaggtgtggtggtatgcaactgtagtcccagctactggggaggctgaaatgggaggatcgcttgagcctaggagttcaagaccagcctgggcaacatgatgaaacctcatctctacaaaaaaaaaaaaaaaaaaaaagaaagaaaaaaagcatggtggtgcatgtctgtagtcccagctactcgggcggctgaggtgaaaggatcacttgagccaaggaggtcgaggctgcagtgagccaagatcgcgccactgtactgcagcctgggcaacagagtgagaccctatctcaaaaaattcacaagggttttcaaagctagttactgcctgagaccatcttcccctcttggatggatgcagcaaattgggaggcaaaattatttggctcttttttttttttttttttaaggcagagtcttgctctgttgcccaggctggagtgcagtggtccgatctcagctcactgcaacctcagcctcctggattcaagcaattctcctgcctcagcctcctgagtagctgggattacaggtacacgccaccacacctggctaatttttgtatttttagtagagacagggtttcaccatgttagtcaggctggtcgcgaactcctgaccttgtgatctgcccgtcttggcctctgaaagtgctgggattacaggcgtgaaccaccgtgcccagccgcgtttggctccttcctaactaaacagagattaaactgtttattcttacctgggctttcattttttcatagcagtcactttattttcatctctttgtcctcagcttcccctcaaatatttgtcaagtgtctaccaaggctgggaatgatagtaaaaggagtttaaaaaacaaaagaggctctaaaaatggtactagactcttccattcaggactttgtccaaagcctcactttataatgcttttgtgatttatcctcattcccataaactcagatgatacgaatttatacgagtttgcattaataaatatttcttgcatgcttgtcttatcaaccataccgagccagcacagcctcatctcgtaaagagttggcagtcacgtgcgggagccgggagcccgttgctgtgaggccgggaagtggattgttggtctggggaaagatttattttctgggggcaaaagaggcggggtggagagtccctccgcctgcctggagtgctgatgtggcctcagagctaggtcctgaaaaattgctgggatttagatgcaggctctacatgtagagagattgtttaaatgtataatggttcagaagtgacactctcttgctatgtttctctgaaaatagatcagccttctctgttgggatctatgaagctccagagataaaactgatatacattaaagtggctcgtggttaaaggaagtatgtttgttaatattaaaccgaggtttctctggtaactagattttaaatgatttgattccataggtttataatggagaaatccagatctccaaaatgtaagttttactatatgggaagccttttttttatttcctttgctgtgtttggtaaatagcctggaagaaaatggctccgtcctatcacagaattttattatttacttcataaacctagtgttttagaattttttttttgtttttttgtttttttgttttttttgagatggagtctcactctgttgctcaggatggagtgcagtggtgcgatctcagcccactgcaacctccgcctcctgggttcaagcgattctcctgcttcagcctccggagtagctgggattacaggcacacaccaccacacctggctaatttttgtatttttagtagagatggggttgcaccatgttggctagactggtgtcgaactcctgatctcaggtgatccgcccacctgggtctcccaaagtgctgggattacaggcatgagccaccgtgcctggcctagaattttaaaaagattctttgtagtttagatggttctagttaagctatttcatttttttaaaaaggaagaaactagcattcaatgtctgcctagaaaacaaaaataaaaaaacaacaaaaaaggaagaaactgaggtctgtggcacttaagtgccccactcaaggttgcagagttcctagtgatgttattttttaatgaacttttcttctccttctcttttttgttaaattttggcagactgttttaccaaagcctaactgtacttttcttaattaactttggaatgaattctggatatactcattccagcaatgcacagaaaattctaggcaaagaataaaagactccacattgtttattattattatttttgagatgtagtcttgctctgttgctcaggttggaatgcagtggcggaatcttggttcactgcaacctctgcctctcatgttcaagtgagtctcctgcctcggcctcccaagtagatgagattacgggcagctgagattacaggcacgtgccaccatgcctggctaatttttgtatttttagtagagatggggtttcaccatgttggccaggctggtctcgaactcctgacctcaagtgatcctcctgcctcggcttcccaaagtgctgggattataggtgtgagccaccgcgccgggccagactccacattgtgaaaaaacgagggaaccgcttctgattttgctccagtggtgtattcctctgtcttgttataatgctttatgtttacatataacacattatacgatttttaaagcaaccccacagggaagagttttaattttttgtttgtttgtttttgagacagagtcttgctctgtcgcccaggctggagtgcagtggcgccatctgggctcactgcaagctccgcctcccgggttcacgccattctcctgcctcagcctcccaagtagctgggacttcagtcgcccgccaccacgcccggctaattttttgtatttttagtacagatgaggtttcagcgtgttagtcaggatggtctcgatctcctgacctcgtgatctgcccgcctcggcctcccaaagtgctgggattacaggcgtgagccactgcgcccggccgagttttaatatttttagtcctgttttacaaaggggagaaacgaagcacagagaagtttaggaacttgcccaaatcatacagttgataagttagcagaccaaaaccggaatcgtccaaacggagtggcagccagaaagcattttataggtaaagtcacatcctacactgtaaataaaaacctcttggaacacagagttcgccaggtggctgttggattttcatgtcagcgctggtctagctccgttttgcaggattttttgttgttgttatcacagtatattctaaaaataactatatgttcatttccactctttcagataattaatatttataaatcctagtcactaggaaatatagttcaaccaacaattgaatggaatgcaggtcctctgggaacttatctaaaattaaatcctattttaacagaattagctagattaaggtcatggtgtaaaaactgatttttcagaaggaaataaaaatgcaaaatatcctaagaattcattttgtaaataattgaatcaaataacaatggggcggggaagaagccatatatttttcctctctttttagaaatgaattgaaggccagacatgctggttcacatgtaatcccagcactttgagaggccaagcgggagaattgcttaagcccaagagtttgagaccagcctgtgcaacataggaaaaccctgtctctacaaaagaatttaaaaacagctgagtcagctgggcgccgtggctcacgcttgtaatcccagcactttcggaggctgaggtggatggatcataaggtcaggagttcgagaccagcctggccaacatggtgaaacccccgtctctgctaaaaaaacaaaaattagccaggagtggtggcggacgcctgtagtcccagctactcaggaggatgaggcaggagatctgcttgaacccgggaggcagaggttgcagtgagtcgaaatcacaccagtacacttcagcctgggcgacagagcaagactccgtctcaaaaaaaaaaaaaaaaaaaaaacttagctgggggcagtggcacatccctgaggtcccagctacttgggaggccgaggtgggaagatggcttgggcccaggtgatcgaggctttagtgagctgtgattactccaccgtactccagcatgggcaacacggtgaaaccttgtctcaaaaaaaaaaaaaacaaaaaaaatcagataaataaaaacaaaaaattgtttagactcatgaatcatcaactttttctttttctttgcccattttcttttttaagtattagcttggcattaaagcagtagtatatgaagatggaatttgctagtactttatttgtgattccagagttaaatgctactgcaatcaagtcttccttgaatttagcaatagatttaaaagtttagaaagagcctctttttttttttttttttttttggttttaatacggggccttgctttgtcgcccttgctcgatcgcccagtgatctcagctcactgcaacttctgcctcctgggtttaagtgatcctcctgcttcaggctcccaagtagctgggatgacaggcgtaaaccactacgcccagctacattttgtgtttttagtagagacggaggtgtcaccatattggccaggctggtctcaaactcctgacctcaggtgatccacctgccttggcctcccacagtgctgggattacaggcgtgagccaccatgcccagcccaagtctagctctttagaaggaaaaaataagggtagaaattcagagaaggatgagtgtggagtggcttccttgctctatttctagaacatgccatttcttgggaagtcttatgaccctgctggtctttaatgtcccctatatgattttcctccctgggctttgattctctgccttatctcctgtggtcttttccatccagaaattttgaaggggtatttaccttcaacttaaaactgactactacaggtaagtagtggccctgctgtttccaccctcccatgtctactggaagcagaattgtttcacctgtctcgttggaaaatcaaatgaggtaatggaaatgaaaagtactacacaagtgtgattattaaagacagttcagtcaataggtgaaaagactcgtgtagatactttatttaacctggaatcaatgtcttatactcagtagacactccttagatgtgagtttaaagatgtcattactcctataataccagcactgtgggaggccaaggcgggtggatcacctgaggtcaggagttcgagaccagtctggccaacatggtgaaatctcgtctctactaaaaatacaaaaattaaccaggtgtggtggcggctgcctgtaatcctagctactcgggaggccgaagtgggaggatcgcatgaacccaggaggtggagattgcagtgagccgagattgcgccactgcactctagcttgggtgacagagcgagactctatctcaaaaaaaaaaaaaaaattaagaagatgtcattttaatgagcagttctttgttaagtaaagaagaagaggaaaccaggaaatatgatagtgcttggccacctcaccaagtgtttgtcttaaaagaagctttcttgattaagtaaaaatttaaaaggaaggaaagaaaaacccaacctcaccgcaacaaactaccctagtctgaggtaattgtgtagtgtaatgtccctacacctgaatttttcatgcacctgcagatttaggggctctgcctatctttgagtataaatgtccactgaattattagcaaaatgatttgttctcagaaaccaaaattttagcctagatgaatgccgccattggagttatttatatgaaaaggcgtgttaagctcaatggtcttctcttctcttctcttgttttcttttcttttggatttgagacagggttttgctctgccacccagcctggagtgcagtggtgcaatcatgggtcaccgcagcccctacctcctgggctcaggtgatcctcccacttcagcctcccaagtagctgggactacaggtgtgcaccatcatgcccagctaatttttgcatttttcgtagagatgggatctcactatgttacccaggctggtcttgaacacccgagctcaaacgatccgcctgcctcgacctcccaaagggctgggattacaggcgtgagtccctgcacctgacctcaattgttcctttcagcaaaagtaaaattttaactttcaagggtgcaatcctgcttttttttttttttttttttttgagacagagtttcactcttgttgcccaggctggaatgaaatggtgcgatctcggctcactgcaacctctgcctcccaggttcaagtgattctcctatctcagcgtcccgagtagttgagattacagatacatgccaccgtgcctggctaatttttgtatttttagtagagatggagtttcatcttattggtcaggctggcctcgaactcctgacctcagaacatctgcctgcctcagcctcccaaagtgctgggattacaggcgtgagccaccgcacctggcctgcaatcctgcatttaaagcatttttaaagtgtcgttggaacacttaaaaagacaagaattaaaacagtagcagaacacctaaaatggcaaggaaacggcatgagggcgtgtaacacagaaaggggtgggtgtttgagaaacagcaccgcaagtacgtggggaagcagcaaagatggaggacatgggagatgggggtggaaaggggcttggggcctggtagtgaaagactttgcatgccacgttagagtctctgctctgttctgttagcaggagtttgtagtagtacctattcacagactggtgcgggttaactgtgagggtagtgcgtgtaaggtgcttagaacagtgtttgacacataatccgtattctctaaatcttagttgtaggagatgttgttgctattatttttataaaagggcaagcattacgagtttcagagcaaggcttatggggtgataatataatggaggatgaattggaagaggagaaactggaagcctggagaatggtttggaagctctttgctggggcccgagagacattcagggttcaggcagtgggagtggaaggaaagtagtggattccacagcgagacttggcagggcttgatggtgagggaaaggaaggagaagaaagtgacctggaggcttctggtttggatggttggggagtgatgaccccgagagaagagaggagagaaacagggttgtgaggatgagacccaactactctgttcctcttttctcaactgaaaccatgctgacttcatactgcaaagagtgtacagcgacacggtatctcagtccgttttactgctgcaacaaaatacctgcaactgggtgatttccaaacaatagaaatttatttcttacagttctggaggcagttctggaggccgagaagtccaggatcgaggccttggcattgggtgtctggtgccatgtcctcacatgacagaagagcaaaggctacggactcgttccctcaggcctttcatgcggttgctcacccctaagccctctcgtattagggtcttcatcccatttgagaaggtggagcactcatgacttcttccttacctcctaaagaccccactgcctttttttttttttttgagacagaatcgtactctgtcgcccaagctggagtgcaggggtgcaatcacggctcactgcagcctggacctcctgggctcaggcgatcctcccacctcagcctcccttgtagctgagaccacaggcgtgtgccaccacgtctggctcattaaaaacaattttgtttttgtagagacggagtcttcgctgtgttgcctaggctggtcttggactcctggactcaagtgattcttccacctcagcctcccaaactgttgggattacaggtgttgagccactgtgccagtaagaccccacttaatactatcccttcgtgatgaagtttaaacacgtcaattttgggggacatttagaccatagcacataggtttcaaaaatgagtcaaagccttaaatggattgtctcttttctagtaccagctgataggcctcacgtctgttcactgccttctgatgctcctccttaaccctgtgtaggactctgtagtacaggtctccgctcaaagacagttgtaaacgtggcacagttagtcaagagcattacaataaaaaatgctcagcatcactcatcacagagaaatgcaaatcaaaaccagaaggaaatatcaccttatgccagtcagaatggctattagaattatatgagaataatattaagaagtggggtcttactgggcacaatggctattattaatcccactactagatatctacccagaggaaaagaaatcgatctatcaaagggatacctgcacttgtatgttcatcacagcaatgttggcaatagcaaaggtatggaatcaatgtggccatcatcgaatggatgggtaaagaaactgtggtatatgtatatgcagtgggatactgtccagccatcaaggggaacaaaaccctgttatttacaataacatggatggaactgaaggtcattattattatgattattttttatttttattttttagagaagagtcttgctctgttgcccaggttagagtgcagtggcacaatcatagctcactgcagccttgacctcctgggctcaaatgatcctcccacctcagccacacgagtagttgggaccacaggcatgtaccaccatgcctgtctaattttgtttattttttgtagacatggggtctcactatgttgcccaggctggtcttgaactcctggggctcaagcgattgtcccaccttggcctctcgaagttctggagttacaggcatgagccaccatgcccagcttggaagtcattaagtgaaggaagccagacacaaaagacatattgcatgttcttatatgtgggacctaaaaggtttgatcacatggaggtagagagtggcaagaagggtaacagaggctgggaagggtgagtggcggggaggagaagggtcaagagaagtcggttaaagggtacaatcatgcagtaacgtagaaggaataagttcaaggcttgagagcagagtaatattattctaatattatatatattctcacctaacaaaaaatgtattgtggctgggcatggtggctcccgcctataatcccagcactttgggaggccaagacaggcagatcacctgaggtcaggagttcgagaccagcctggccaacatggcgaaaccctttctctactaaaaatacaaaaattagccgggtggttggtgggtgcctgtaatcccagctactctggaggctgaggcaggagaattgcttgaacctgggaggcggaggttgcagtgagccgagattgcaccactgcactccagcctgggtgacagagcgagattgtctcaaaaaaaaaaaaaaaaaaaacaaacaaaccccaaaaccaaaatgtattgtatttgagtgatgggcaccctgaatgccctgacttcatcactgcgcattatatacatgccataaaatttctcacataccctccaagtttgtataaataaaaagggggtgttgaatacagactttcaaagaaaaagcattctgctcaaaactcataaggggacgtggtgtgtgtgtgagttctgaaagaagtttgaaggaccagggttgaccacatgatcacgggaaacagcagctcctgggttgcttcaaggtgctgtggctgttggtggatgaaatcagcctactaggagataggaagatacaaggagcttctccagtgtactggaagatcacagctctggcatcatgggatctaaggagctggcttgtctttagtgaagggaggggggctggggccccttggaatcttttttttttttttttttttttttttttggagatggagtttcactcatttgcccaggctggagtgcaatggcacgatttgggctcaccacaacctccgccttccgggttcaagtgattctccaccctcagcctcccaagtagctgggattacaatcatgtgccaccacgcctgtctaattttgtatttttagtagagacggggtttttccatgttggtcaggctggtctcaaaactcccgacctcaggtgatccgcctgcctcggcatcccaaagtgctgggattccaggtgtgagccaccgtgcccggcccccttggaatctttaaggccaagacctgggaggctggaggtcgagcatgaaacaaagcgaaatttccctgagaaggaagaaagaagtgaggattccctgaaaccaagaagcagctctgtgttcccatctttcctcgtgtgtgtcattggcttcccatgcatataggctttgcgaggcaatctaagcatgtgtgcacgtgtgttttgtgtttttgtgtataattgagtatggctgacttttgagtgggcacccataatcactctgtatggcaattacacttatattaactttaatccatttcagagtaatgactcataatatttaatacccacatatcattgtgtattatatattaagtaattattaagatataatagctgtcctgtggttctttctgcagttctgcaatgcataagtaaatatatatctacttagcacctggcagaattctgacactggttccctggagtgagggctgttgtggtagcaaaggccaagtggaagctgccagaactgcctctgtctaccaaaatagtcaacccaaagcaattatcacattcctgggaggatggcagagattagtgccaccatcagggacttgaaagatgcaagggtggtgatcgtgtcacatctccgtttaatccatatttggcttgtctagaagacggatggatcttagagaatgacagcaggttgtcataaacttaaactaggcggtgactgcagttacagctgctgtgccagatgtgtttttgttgctggaacaaatcaacacatttcctggtacctggtatgcggtgagtgtcttctccttctctacctggtagtaaagatgaccagaagggtcttgcttccagccggcaaggtccacagcccgccttcatagttacacttcaggggtctgtcagctaccagccttatgttatcacttcagtctccttcttcattccatggggtgccaacggataaccactcagatagaatgtaaaaggactttgggccaggtgcagtggctcatgcctgtaatcccagcgctttgggaggctgaggtaggcagatcacttgaggtcaggagtttgacaccagcctggccaatatggtgaaaccccatctaataaacccctactaataatacaaaaattagctgggcctggtggcaggtgcctgtaatcccagctactcaggaggctgaggcaggagaaactcttgaacctgggaggcggaggttgcagtgagccgaaatcgtaccagtgcactccagcctgggtgacagagtgagaccttgtctcaaaaaaagttcataaaaggactttggctcctcttctggggagagggttagcatggttttggttgtaagacggatagtagcattatatggcatggaagcctagttgctatttacttgatttggaagttaagtacggttgaaaagaggagtagatatggacaccaagttgacaaggggtacgtgtagtgagttcgttttgcgtcaccttggctaagttggagctctgtatgtaacttgagccacaagagaccatttgtgtaagaccgagaaggcagaggggacacagcagccacatgcactgtggctcatgcacgtggtctctgatctgcaggctcaccttgttggcgcacggcagccatcaggcctgtacctcttctgaaacccaccaaatctttcgttgttcccctcatctgcgtatgtggcagacagtttttctatgttttcaggcaattgttgagcaaataataatagaatttttgaacaggccagcatcggtgctaatatgtgccaggcacagatctgagccctttagagtatttactcatttaatcctcaaaaccctgtaaagtcactgatgttgccataatctgtcagactcagaaactgaggcacaaagaggttaagtaattgcttaagccttcacaggaattgggatctgaacccaggcattttggtgtcgagtccatgaactgacgaagaacatagataactgttgtcagcttgtcaaggctcatgcctgtaatcccagcactttgggaggccgaggcgggtggatcacaaggtcaggagattgagaccatcctggccaccatggtgaaaccctatctctactaaatcataaaaaattagcgtctgtagtcccagctactcaggaggctgaggcaggggagtcgcttgaacctcggtggtggaagttgcagtgagccaagattacaccactgcactctggcctggcgacagagcaagactccgtctcaaaaaaaaaaaaaaaaaattacttcaaggagagactgctgagggttcctctgtctcctgtgtggatggaatttggcctccatttggaatcgggaatcttgcatatttagttctgcagtattacgtgaatctacggaagcaactcatttggaattagattccaagccgttataaataataaattttttgtctctgtcatttttgtagtaacagcaagagaaaagaatttaggaccaaaacttatgagagttttaaatattttttgctaagtgcttatatgtgatttatgggaaaatcataatttttaccctggaaggcagccttactcataaagaatggccatcttgtagcacctccaggacatcagtctgaagtctaagttaggtgtgtttgcacagcaaccaaatggtgagagcatttagcagctgggggacggcggcattgttgtgattgggttgccacgtggtggggcgggtgagggacggcagcagagccttggcagagcggagctgtgtggccgacggcttcctctttcttcctccagcgtgcgattataacttgttgctcatgcaccggcatgcagctctgtttgctcagtctgtttttctgtaaagtctctttttaaaaaagtatatgatacaggctgggcacggtggctcatgcctgtaatccgagcactttgggaagccaaggcaggtggatcacttgaggtcaggagttcaagaccagcctggccaacatggtgaaacctcacctgtactaaaaatacaaaaaattagccgggcatggtggtgggcacctgtaatcccagctacatgggaggctgaggcacgagaatctcttgaaccagggaggcagaggttgcagtgagccgagatctcaccattgcactccagcctgggcaacaagagcaaaactccatctcaaaaaaaaaaaaaaattgtgtgatatagatggaagaccacgtaaaataaatgtacaatctgattgttataaggtgaccgcctttgcatatctaccaggcaggttgcaggagagcacagccagccacccagcagccgtcctgccctccacctgccgcagggggccagatcttgccattcctggtggtcccgtctctgctcttcttggttttctttctttcgttctttctttttttttttgagatggagtcttgctctgttgcccaggctggagtgcagtggtgccatctctgctcaccacaacctccacctgctgggttcaagcaattctattgcctcagcctcccgagtagctgggattacaggcacgggccaccatgcctggctaatttttgtatttttagtagagatggggtttcaccatgttggccaggctggtctcgaactcctgaccctgtgatctgcccggctcggcctcccaaagtgctggggaggtgtgagccactgcgcccggactttttggttttcttatccaactgtgagtccttcaacacttggcgtcgggtgtttggcttgtctgttttttggcttgcttttgcttttttctccaacttttaatttaattttaattaattaattttatttatttattgagacagggtctcagtctgtcactcaggctggagtgtagtggcacgatgatggctcacctctgcctcgacctcccaggctcagatgatcctctcacctctgccccctgaggaactggaactacaggtgtgcaccaccatgcctgattaatttttgtattagccagtggtttcgccatgttacccaggctggtctcaaactcctgggctcaaacaatccacccgcctcggcctcccaaagtgctgcgattccaggtgtgagctactgtgcctggccttcgcaacttttcattttgataaatttcaaacctacagaaaagttgaaataatagtataatgaacactaatatcccacttcacctgattgacccgtggttaacattttgccaaatttctttggctgtctcagtgtaggtgtgtatatatgtatgtgtgaatataattatacacacatttgtgcaagaaccctgaatgggatataatacagtacacacatatgtatgtgcatatgtgtatgtgtgtgtatctatatttgtcctcttttttctttgctgagccattgaaccgttaactgactaaattgcagacattgtggccctgcacccttaaattcttcagcatgtatctcctatgaacaaggacattctcctgtacagacaaaacaaattatcctactcaagaaatataacattgacagaatactcttataaaatatatagttcatgttcaaatttccccagcatctaacagtatcctttagagcttttatggtgttcatccaggatccaatcagggatgatcttttcctaaaagaggacactcaagatctagatctagaacagttccgcacatttttttttctttactgctattggcatttttgaagagtttggtttcctgtttcttaaaataaattttgcattgaagtgtaatatgcatgcataaaatgcataagtgtacagtttgaagaattatcacaaaaggaacacatccactaaaccagcacccagatgaaacagaatatcccagaagcctccctcgtgtccctcccaacgctacccacttcctccttctaaaggtaaccatgtcctgacttctggcaccataaattgcgtttgcctgtgtttgaatttcgtacaaatggaacctgcagtgtgtattctttttttttttttgagaccgagttttgctgttgttgcccaggctggagcgcgatgccatgacctcgactcactgcaacctccacctcccaggttcaagtgattctcctgcctcagcttcctgaggagctgggactacaggcacccaccaccatgcctggctgattttttgtatttttagtagagacggggtttcaccatgttggccaggttggtctcaaactcctgacctcaggtaatccacccgcctaggcctcccaaagtgctgggattacggacttgagccactgcccctggtcagtatatattcttttgtggctgcctctgtcactcagtgtaaagtttgtgagcttcattcctgttgcctgttgcttacgctggggttccttcatcgtcactgctgttgtgccttctcggtcatatcacaacgtatccatcgatcctcctcttgatggatacatgggttgtttctgggctttgacttttacaataatccctgtgaatacttacgtactgtatcctggtgcacacttgcatgcatttctttggccgaaatcaatgtctagaaggggaattattgagccatagagtgtgagtgtcttcaacttccatcggtaataccgacttgttttacaaatggtgataacaaatggtgataacattgttatcacctcatacccgtcagcagagtatgagggttcctgtgggtggctctgcatcctcaccagcgcttgtcactctgttgaattgcagccactctggtgggtgggtgcagtttcttttggtaattttcatttgtgattctgtatttgatttgcagttccctggctgagtgtcttttcatatgtctgctggccacctgggttggctcttcagtgaagtgcctgttcagctttgttacacatttttctactgagtggtctggttttgttttcttattgttgggcttgttttgttttgttttgtattgtcttgagacagagtctcactctgtcgcccaggctggagtgcagtggcacaatctcggctcattgcaacctccacctcccgggttcaacattcttttgcctcagtctccccagtagctgggattacaggcacgtgccacctcacccagctaatttttgtatttttagtagagatggggtttcaccatgttggccaggctgctcttcaactcccgacctcgggtggtccaccaaccttggcctcctaaagtgctgagattacatgtgtgagcccccgggcctggcctcttactgattttgaggagttctttatattcaggctaccagccctttgtcagttatatgtgaggcaaataccttctcccactctagttttgcctttttactacgaaattgccatttttgtagatcgaaatggtcaaatattggcaattggcatatggttcagcctaccataaaattgatccactttttttctttgttaggtgaggactttttttgtcctatttctctacttctgaggtcatgaaactataatattatttcctagatactctattgtttcacttttcagatttatgtctataatccacgtgaaatgtgaactgatattttttgtgtacactatgaggtagggatcaagttttactttaaaaaatatatagctaggccgggcgcagtggctcacgtctgtaatcccagcactttgggaggccgaggagggtggatcacgaggtgaggagttcgagaccagcctgaccaagatggtgaaaccccgtctctactaaaaatacgaaaattagccgcgtgcagtggcaggtgcctgtagtcctagctactcaagagactgaggcaggagaattgcttgaacccgggaggcagaggttgcagtgagccgagatcgcgccactgcactctagcttgggtgacagagcaagactccatctcaaagaaaaaaaaaagaaaaaaagaaaatagataacgaattgagcactttttattaaagaaagttttactaaggtatcatttgcacactatgaagctcagctgtgaaaagtatacaattttatttttagaaaatttagggtatcatctggttttagaacatttccatcatcccatgaggtccatcatatctggtttcaggcaatacctgcttccagtcccaaaccacaaatctactttctgtgtctatagatttgctttttctagacatttcatataattggaatcatgcactattgtagtcttttgtagctgacttctcaattagcttattgtttttgaggttcttctgtattgtagcacagatcaagtatttaggtcctttttcgtgagttaaattcggtggtgtggatatatcacagtgtgtccatccattcaccagctgctggacacgtggattattcccacgtcttggctgtaataaacagagctgctctgaacatcgcttgcaagtcttagttgtttccatttctcgtgagtagaggcttggattggaattgcaagattgtatggtaacgtataattttattttgctaattatcatttgtgaactgacttttttctcttgctatacggttctaaggatcataacacatgtataggttttgtagccaccagtacaatcaggatacagaacagtttaatcaccccccaaaaatctttcccaagggttgaccttttaatatgatttggctgtgtccccacccaaatctcatcttgaattgtgactcccacaattcccacatgttgtgggagggacccagtgggaggtaattgaatcgtgggggcaggtcattcccatgctgttctcgtgatagtgaataagtctcacgagatctgatgggttttttttcttttttttttttttgaaacggaattttgctcttgtcacccaggctggagtgcaatggcatgatcttggctcaccgcaacctctgcctcctgggttcaagcgattctcctgcctcagcctcccaagtagctgggattacaggcatggaccaccacacccagctaatttttgttttactagtagagatggggtttcaccatgttggccaggctggtctcgaactcttgagctcaggtgatatgcccacctcggcctcccacagtgctgggattacaggcgtgagccaccacgtccagttgatctgatggttttataaagaggagttcccctgcacacactctctctcttccctgccgtcatggaagacgtgacttgctcctccttgccctctgccatgattgtgaggcctccctagccatggggaactgcaagccagttaaacctttccttcataattacccagtctcggataattataaagtctttatgaacagtgtgaaaacagactaatacaccctttatgggtgttaccagtggagggtcttgactacaagttgtctgggttcttaaccagattcttggcattttgaacaaagaattggacaaaatgcacaaacaaagcaacgagaaaacgaagcaagggaagcacagatttactgaaatgaaagtacactccacggagtgggagcaggctcgagcaggagcaagtggctgattagagaattttctggagccttaataccctgtagaggtttcccattggttacttggttacaccctatgtaagtgaaggagtggcctgtgaccagtctgattggttgcaggaggcgaccaatcagaggttgaagtgaagttgcaacgttacacctgaagacctggcctgggaccagtctggttggttgcgggagggaaccaatcagaggtactttccatttttcatctgccacgaggtgcaaagggagtagtagcctctgatccttttgttacctgggtatggttttccttttgattcagttctaaaaagtcagggtgaatcggccttaagttccctgcctccaggcccctgccgacccagcaacaactatccattccctgtagttttgcctttgggagcctgtcattaaaatggaaccacacagcacgtaccctttgaagactggtttcttccacttagtctagagctattgagattcgtcctggatgctgcatgggtctctagttcattccttgtgatgctgagtagtgccccattgtggggagggaccacagtgtgtttatccattcatcctgggaaggacattaggttggtttccaggttttggcaattatgaatagtgccgctacaaacatttgcgtacagcgttttttgtaaacataaggtttgatttctctagggtaaatatccatgattggggtttctgggcgtatggtcattgcaggattaacttttttttttttttttttttttgagacggagtcttgctgttgttggctcaggctggagtgcaatggcgtgatctcagctcactgcaatgtccgcctcccgggttcaagtagttctcctgtctcagcctcccgagtagctgggactacaggtgacgccaccatgcccagctaatttttgtatttttagtagagacagggtttcaccatgttgcctacgctggtctcagactcctgacctcaggtgatccacctgccttgacctcccaaagtgctgggattataggcgtgatccaccgcgcccagcctctacttcagtttcataatgggctttaatttgtgaattaacttcttgatgtatctgctcatccatccattcattcattcatttctatattcacccaacaaatagttaagtgccttacttctgtctttgctatttctttgcctttggagcactgttttgaaagagccagcgcccactgtcagctgtccagctggtagcactgtcatctggaagattttagatactttctcatgagtgaatctacaccagcctgaatctcacactacctgacatcctctcaatcgtagccacacccaagggtcctactttgctgtccccactgccaccagaccaaacacacccccttccctgaaagtctgggagtcggtttcttcttcacaatagaagttggcctctgctggtcatgccccaaaccttctggagctgcgggttctgccttctctgcagctgccttcccgtgggctgccctggtcagtgcaggacatggcgcaggacctccgccctgccacacccccgggccatttcctcggcaggcctcgtgccagacttctccaaaggactgaccgcgtgtgccttctccaccttgcacacactcgcacaccaacctgccagcctggcctgtgctcttcgccgcccaaacgcacctctccctggtgtggtcactgacagtctttgcgtggccagtggccaaacccaggctggctttcctagtggcctcatcttctctctgcagcgttcacagtgatccacttctttttttttttttttttggagacagagtcttgctctgttgccctggctggagtgcagtggcaccaatgtccgctcactgcaacctccacctcccgggttcaaggcaattctcctgcctcagcctcctgagtagctgggattacagtcatacaccaccatgcctggctaatttttgtatatatatattttttaatagagacgggggtttcaccatgttagccaggctggtctcaaactcctgggctcaggtgatccacccgcctcggcctctcaaagtgctgggattacaggctttagccatcacacccagcccccctccctacccctttgtccctcctcagagccctgctggcccacttccctggccgttcaaaacattgcagctccaaggctgcttcccaggcctccccacctgctgtcttctccctggtgatattatggacagtggatctctggccctgagctcccttctgatttcatggtatagccacctccttgtccctatcgcttgagcgtgtcaccagcatcttcagcttgggaggtccagaactgagctcctgattttgccccctaaacttttacttcttctggtctcactcatccgtccacgtactgaaggcagaacccaggaacccaggaagtgtccttgttccctttgttcacatcctgtcggttctgcctagaccttaaatcatgaacctgacctaaggccactccagcttttgcctggaccacagcaaaaggccaggagtgagcccccgcttctactcctgacacctccggagccattcgccacccagagctgtgtaggctttaaaaagagccagccagccgcgtgggatcctggatgggatcctggaacataaatcaggtgaaaaattggtgaaactcaaatcaagttcatcgtctagttaatttcctgttcttgattatcaagctgtgcttgacgtcgtacaataagacattcacgttaggagaagtggagcgagggatatatgagaactccctgtaccgtatatgtaactttcctatatgattaacattagtttgaattaaaaagttttaaaaaattggatgggtgcagtggctcatgcctataatcccggcactttgggaggctgaggtggccggatcacgaggtcaggactttgagaccagcctgaccaacatggtgaaaccccgtctctactaaaaatacaaaaattagccaggcatggtggttggtgcctgtaatcccagctactcaggaggctgaggcaggagaatcactcgaacccaggaggcggaggttgcagtgagccgagattgtgtcattgcactccagcctgggcaacagagcaagactcagtctcaagagaaaaaaaaaaagttaaaaaattaaaatgcaaaataagaaagaatcgaactgtgtgctgtcttacttaaaacactgcagagctcttgtgtgtgcctagcatgtaagtcagatgcctcttgtcgttttgagacagagtctcctaccgtcccccaggctggagtgcagtggcgtaatctcggcccactgcagcctccacctcctgggttcaagcgatgctcgtgcctcagcctcccaagtagctgggatcacaggcatgtaccccgcctggctaatttttgtatttttagtagacacggggtttcatcatgctagccaggatggtctcgaactccttacctcaagtgatccgcctacctcggcctcccaaagtgctgggattacaggtgtgaatcactgcacctggccaggcagaaacctcttaatggctcccagggcctggcccacctccccagcctcctctcatgccacactttcttccctcagtctgcatcgggaacagttgccacctttcagccacgtgagcatgctgggaccgtcctttccatgctgatccctgcatccctcgtgccttccccagacctacaccaccgcaattgcctccatctcactgtgatatctccacttcagtctcatttcttcagaaaggacgtccctgactctgtccaaaccgcatgttgggtattctctattgcaggaagcttttgctttcttcctggctcttaatcacagctggtgactcgggtccttgcttgtggattctccctgccactggttcctaccactgagtcaggtgatggacgccatgttcacagttttatcaccagcgtctagcgtggcctgcagcgggtgctcccatagaacccataaacaaacaacttcttgtttcttattatgtgaagaaagttggtctgtgtaattcaccctccagagaaatgacagcactttcagtactttgttctgcccttccttgatctccacgctgtttgcagatggaccaccgttgtagagatgtgatttgattcttgacgtttctgagtgtccacggtgctgcgccttcccccaggtactacagtactgagattaataagacagagtcaatgtaaggtgttagtaggatttagaataggtctaatctcattcttaacggatttcaggagcttattatgtgttgaaagaatgaataggataaaagttgttaagaaattttctccgtttaatttttatttattaatttatattttagagacagggtcttactctgacacccaggctggagtgcaatggtgcagtcacagctcactgaggctttgaattcctgggttcaagcaatccttctgcttcagcctcccaaattgcggggattacaagcatgagccactggctctggcctattttctccttttaaaaaaaattgctgcagatatacacatatgcacggatatacacatacaaatatgtaccttatacatatatgtatataataaatacatgcatatgcagaattgtggcatagtcttagtctttttttttttttttttttttttttgagacggagtctcgctctggtgcccaggctggagtgcagtggtgcaatctcggctcactgcaagctccgcttcccgggttcacgccattctcatgcctcagcctcctgaggaactgtgattacagcatgggccaccaggcctggctaatttttgtgtttttagtagagatggggtttcaccatgttggccaggctggtctcaaactcatgacctcaagtgatcctcccacctcggcctcccaaattgctggaattacaagcatgagccaccatgcctggttgtatttagtctttaacctgtcctcaggctgtttctctctgggcagggagaagcatggaaagggggatgggccctggtggccacctttgaagcatggaggctccggtgccaccctgcccttaggctgggcacaaaggtggctgagggaaggctagtcagctgctggaggtgtcctttatggtctcagtgattaaaggttatgttgtccatgaatttaattttatttcatgatggaaaagaggacattgcaaattaagtatgtcacagaaatgtaaggagccacggggtctgatagggctgagggtgagtggcttgccgtcgagtttccagaaggcgttattatggaccctaaaggggatttcatgcgtttcaaagactctaacagaagtgttctgatgaagtggagtctggtgctgggacctgccacttcagcctggaattgtcctcgtgtgaagcgcagtaaaaacccagaatggatgtcggcaataagggaatttctgggatatgatgggggaacgaatattgtcacctccatttgtgtcaggaagtctcactatgcagatgagtcagctgcagggggtggcctcccaggctgctggtggagcccagaagcagggggcaggcgtttggcctctgatactctcctagctctgagttgggacggagctcgtgtatctacagtgtgctcacacagacttggtgccggtagatggtgaggggataggttggcaggtgggtagggggcctcccaaggcagtagggacctggaggaggctggtagaaagtggagattggccaaagtgacctgaattagattctacctggttcatgaatttgcctgaggctaaggcttcagcgcaagggatggtggagtaatacctttcctgaaacacctgctgccggcgtggccttgtcggtctctgccagatcttgttagcactgtggcttcaggcctagttaaacattcaagcccaatgcggttggagagcacccatggcacgcccattgtgcagcagtgtgtttaatacatgtgctgcttttaatgggtgtgaaagatcagagagcttgggtgtgtgttttaccaaccactttttaaactcacatagtaaaatttatagtatataaaaagcagaaaatatggtgtatcttctaaatattcacatttaaaacattttttagaaataatgtatgtcaagcaaggtcaagctaatgtgtttatataggctctaaattagagttgtgaaccagtatctcatcccacttatagggttttttttgaaaacgttcaaatgtttccagctcttttgtttctttattctaaaacattatctgctattttgttcgatagagtaactgtttctattccactttctttttttttttttgagacggagtctcgctctgtcgcccaggctggagtgcagtggcgcgatcttagctcactgcaagctccgcctcctgggttcacgccattctcctgcctcagcctcccaagcagctgggactacagacgtgtgccaccaagcccagctaattttttgtatattttttagtagagaggggttttcaccttgttggccaggctggtctcgaactcctggcctcaagtgatccacccgcctcagcctctcaaagtgctgggattacagacgtgagccaccacgcctggcttattccactttgtaattggctatccctgctattaatatacagggtactctccctctcgtatttgcgtctaaatgtcatctataataaataacagtgaatacttactgatttcatatttagttttacttttatcccacccattttcttttagtagttcttatgacttcacgtttatttaataaaggtaaaaaagaactttctgtttccaattcattcctttcaccaataaggaaggatgtggatcttcactgcttcctacatagctgccagcctcatgtagctgtttaaaatttaaattataattgaaatcattaaaaaattaattccttgttcatactagctacatttcgagtggtcagtagccacatgtgcctggaggccacagaactggacggctacaggatgtacccatcatcacgggaagttcatagaaagttctttttctttttctttttctttttttgagatggagtcttgctgtgttgcccaggctggagtgcagtggcgcgatctcagctcactgcagccttcacccactgggttcaagtgattctcatgcctcagcctcccgagtagctgggattacaggctcccgccaccacgcccggttaatttttgtatttttagtggagacagggtttcaccatgttggccaggctggtctcaaactcttgacctcacgtgatccttccaccttggcctcccaaagtgctgggattataggcatgagctaccatgcctggcatgtatctcttcttctctaagtactcagctgtcttgtttgaggctagtacctccactagtctggaaccctccttcctgggctttctgcccacttccatctctcctttgacaacagtggtttttccagggtctgtgcagagctcagctttctgccataagacaggggagtttctgaagactcctcaccccttttgggagtgagggctgctgactgaagctccaggtcactgttttatgagctagctctccgtttgttgatggccggggacccagcctttgtcccctcctctcgtgcttgggcactcactactcactgcctcggttttgctttcagttttgattgtgcattgagtccacaacttcaatgggattttcttaaggcataaatgacagttgcatggtgtgcagtgggagaacaaatcgcccagcctgggacatccctgggtggcagagtggacctgctctcaacttatggaatgtgcagcaacaccttgaggttattaataaatacctgagtctgggcatggtggttcatgcctgtaattccagcactttggcaggctgaggccggaggatcacttcaggccaggagttcaagcccagcctgggcaacatagtgagattccatctttaaaaaaaaatttttttttaaaagaaggtgggcttggtggtgcacacctgtcatcccagctacttgggaagatgaggtgggaggatcacttgagcccaggacgtcgaggctgcagtgagccgtgatcatgccactgcactgcagcctgggtgacagagaaagaccttttctcttaaaaaaacaaaacaaaacaaaacacacacacacacacacacacacacacacacacaactgcgattcttccagaaaagttcagaaaaaggaagtccgaaatacatagtccatagtatttcagccaccagtgctgctgaagtgaaattagagatagcagagatatctcaggagaaaatggaggtttttgggtttctccgttagatgactcgagcaagtctgcatgtgctctgtaaacaagaaaacacagtctgggaaactgtcagcctctgccccagccagtgtgcaaaatactcttcaaaagagagaaaactagaaaacaagttgaaaaccgggtgatctgacaagtgtggaaattcacagcaagcatgtgcctgtgctgcagatacgatctgggagagagccagcagcctggatccacatttcccagaagcaacaggtggtgaaggcagcggcatgactgctcccgcggaaggttagtcacgcatgttcagcatcagccgggcgcggtggctcacgcctgtaattccagcactttgggaggccgaggcgggtggatcacttgaggtcaggagttcaagaccagcctggccaacatggtgaaaccccaactgtactaaaaacacaaaaattagccgggcatggtggcaggtgcctgtaatcccagctactcaggaggctgtggaagagaattgcttgaacccgggaggcagaggttgcagtgagccgagatcatgccactgcactcctgcctgggcaacagagcgagactccatctcaaaaaaaaaaaaaaaaagagaagaatattccgcaacttagagcttttcctttgcatgatatgatgtttacaggcgaggtggctccgcagcctcggtggcctttcttccagctgaagatgcccacaggaggtgtcagtgcaggtataaccacctgtgggtcagaagaaaatgcctttgcaagtaaatctcctcctggatgaaaaggcccatctgtgttccaggcaaggacagtggccgcttctgcgtttctgtggccaagcgtctggcgtgcgggtgtggctgggctcaccatgctgtgcgggctacacctgctgcaggagaagtgtgtttgtgctcgaagaagacaatgtgggtgtcggcccggcgtttttaggttggactacaatagtgagagctgcaaattggatgattcttggagctatttcatgaaggtcaaattttcttttgttttgttttatttaatctctcccagacttctgaacttttgctatgttgaatttttagttcttcaaggttatttggccttattcttgacttgcatgtttttctgccctagctctaccacattatctttttttttttttttttgagaaggagtttcactctgctgcccaggctggagtgcaatggtgcgatcttggctcactgcaacctctgcctcctgggttcaagtgatcctcctgcctcagcctcccaagtagctgggattacaggcgtgcatcaccacgcctggctaattttcgtattttcagtagagacagggttttaccatgttggtcaggctggtcttgaactcctgacctcaagcaaccccccgcctcggcctcccaaagtgctgggattacaggtgtgagccaccatgcctggcccacattatctatttctaagcctttaatatttttcatttacctgctactgctcactctaccttgtattctcagggagggtgtatttcttcccagctttattttatttcttctctaaatctcagaattattgcaccttgttgatgttcacattactgtatttagtttattttattgtattattaatattattattatatttgagacagggtctcaccctatcacctaggctggagcatagtgacacagtcatagctcactgcagccttcatttcctgggctcaagcagtcctcctgcctcagcctcccaagtagctgagatcacagaaatgcaccaccacacccagcttccttttctttttcaaaaaaacagctttattgaagtataattcacatatgatgcaattcaccctctcaagtgtatgatttggtggtttttagtgtattcatggtgttgtgcaaccatcaccacaacctaattttacattttcgtcaccccaaaaagtaaccctgcatccgttagcagttacaccctctctctcctaaacccatggcagccactcatctgctttctgtgtctacagatctccctatgccagacatttcatataaaggggatcacctagttcgtggccttttgggactggcttctttaactaaacatcatacagctttatttccattttcagtgtattccctttttttgttttcaagtatttagtggctacctagtctcagattttaaatttagtttttcctttctcttctttctataatctatttttcatcatctacactgtgtgcttgaatcagcacctcttagaaacctacggatgagctgttagctctctagggacaagaacacggtctgggacccccgtccctgctgcaggtgtgacctgaccccctccctctgccgacgtgacctatccccctccctcccgtctgtggcatctggtgcatttggtgctgtcatttcacaaataaaaggtgatcagctggtggtctgtttcagttctggtatctttccccagctctcttgtttcatagcctcttcccattatttaaactctgctctgttacaggattcttaatagttattgcagaccttcatttccattttgttgtctgcaactcattgttgaagtgccatttgttgcttctgaacagcccatagacacttggacttgaatgcatatgactctcttcttgtgggtccagatcgtcactcactgactgtcctcacattcacagctgttctcaggacaagcaccgtctttccctttttcggatgtccctgtttacctgaatcaactcatttaatcctcacaacagccctgtgctatgatatgaccatcatatcacagcattttcgttttctttttcttttttttttttgagacagggtctcattctgtcacccaggctagagtgcagtggcgtgatctcggctatctgcaacctctgcctcccgggttcgagagattttcctgccttagcctcccgagtagctgggacttacaggcacctgccaccacagctggctaatttttgtagttttagtagagacagggttttgccatgttggccaagctggtcttgaactcccgacctcaagtgatccgcccacctcggcctctcaaagtcctgggattataggcgtgagtcaccgcgccggccagcatttccattatctagacaagggaactgaggtcaagcattggagtgaaagtcacctaggtggctttttttcttttttaacctatttatttctttcaacccttagcccagatcctaaccttcggtaagtactcagtaaacatttagtctgctgggtgcatgaacgagcgaatgagcaaatgaatgacagcgatagcacctggtgggctgttcgctggtgtgctgggtgtgctgggtgtgctgggtgtcgtctctcagagactcatttctacagtctttgtgaaggctcgtgctagtaaaccctaattcaagaggtttcttagaggtgggaggcgaaggtctctgaagtgtgtggactcctggactctccctatgttagcattctggaatgtagcatttagcagtggggcatttattaactcggaatacagaagataagaagccaagccaggcacggtcgctcacgcctgtaatcccagcactttgggaggctgaggtgggcggatcatgaggtcaggagatcgagaccatcctggctaacacggtgaaaccccatctctactaaaaatacaaaaaaaattagccaggcatagtggtgggtgcctgtagtcccagctgctcgggaggctgaggcaggagaatggcgtgaacccgggaggcagagcttgcagtgagctgagggagccactgtactccagcctgggccacacagcgagactctgtctcaaaaaaaaaaaaaaaaaaaaaggccaaaacaggggaatgtggtcactcaggggatgcctgtcattcccatttggctgtgatggcagctgtttagccattactgggagagagagggaagctgggtatagaaggtacctgtttagaagcaggggtggggaagcgggagggagagagagagagagaatgcgtgcacatgctctaaaattttattttctggctgggtgtggtggctcacgcctttaatcccagcactttgggagacagaggcaggcggatcatttgaggtcaggagttcgagaccagcctgtccagcatggcaaaaccccctctctgctaaaaacacaaaaattagccaggcatggtggcacacacctgtaattccagctactcaggaggctgaggcaggagtattccttgaacccgggaggcggaggttgcagtgagctgagatcgcgccactacgctccagcctgggcaacagagcaagactctgtctcaaaaaaaaacaaaaaaatttttttttggttaagcagaagatcaaattaaacaggcaaggtgcctaccctttgtttctttcactttcttccataaatccatctcatattttattatttgggacttcttttttttttttttcttttttgagacaaagtctcactctgtcacccaggctggagtgcaatggtgcgatctcggctgactgcaacctccgcctcctgggttcaagcaattctcctgcctcaacctcctgagtagctgggattacaggcatgtgccaccacgcccagttaatttttgtatttttagtagagacgggatttcgccatgttggccaggctggtctcaaactcctgagcacaactgatgctcccgtctcggcctccctaagtgctgggattacaggagtgagctaccgcgcctgacctgggacttcatttgttaagaagaggttaagtttcaccagcagccatttgtagtaggaacttgagatttatcatcaaatattgggacaacaagaacaaatcagttcttatgattatttatggtgcatatgagtaggaaggacttacaaccctccggagagcattttaatgttaacatatgaaagatattctctcttttgtaccaaaacttttgttcttcttacgcagaaagaatagataattataaaatatatctatgactccataggctttggctatttggtagattaagagtatttttatctttatttttcttattggctgattacagtttagtttaaataactctcatgccgcttggtcgtttccgacctagtcgtgaggaagaatgcaatgcaaagtgaaagacgtttttggaatgtttctgaaccagcccaagctgattgcctcttttctgtttattgttttaagtcataagtgacgtaagcttctaggcatttgttatgctatgtggctggctcccaaagtcatgtcttaaaacattctttccttcctgattattcttctctttcttgtttttcttttcttctttttcttttaatttttttttcttttttgagacggagtttcactcttgttgcccaggctgaagtgcaatggcacgatctcagctcactgcaacctccgcctctcaagtttaagcgattctcctgcctcagcctcccaagtagctgggatttacaggcgtgtgccgccacgcctggcttgtttttctttttttctttttttttttgagacagggtctcactctcttgcccaggctggagtgcaacggcgcagtcacagctcactgcagcctcaacctcccgggctcaagtgatcctcccatcttagcctcctgggtagctgggaccacaggtgccaccacacccagctgatttttaaattttttatagagatgggatctcgctatgttgtccaggctggtctcaaactcctgggctcaagtgatcctcctgccgcggcctccgagagtgccggggtcacagctgtgatccccgtgcctcgctgttgttctctttctgttgagttggcagtcaggtccttgattcttggtggctgagggtatctcagtccaaggcaagaatcccacagaaagagactgggacaaatgaggccagaaatgggcctcgcccatcactcttttccaaaatgggctttgtcagtcactcttcctatacttgggtcaccaaacctgatcaccactatgtgcaaagtgcagttttagttttcaaagaagtgacactatacttaagaatacttaagaacgttaactgcgttaacctccacgcacacagccatagacaaattcccccgtcagacaggagcccattaggaaatgcccacccctctctgtagcctttgtaaaattaagctgataaaagacatcgctgttgttgaggtttaaaatcaatggataaccaggaaagaatataagaaatcatattaattattctcctgtttacactacacttaaatcatttagctgtcttttttttttttttttggaccttctgctgcaaaagagccattctaatgaacttggaccccagggtccatgtgtgtggttattcattaaatcatgtcgcctgcagagtctcctgacttaagactttcgctgggcttgaactcagtaacctgtcctgatgtatttctcaggcgtttgtgattaggcagctgggctctgccttacctgtcagggtgataacccttctggttctgacaaaaggtttcactttaaatttagctttccatattgaagcataaataaaaagataatttacttcccgattttgctcgttgtggacacggaggtgtgtttgaccttcgtaaagctagtaggatcatgttatcactatgggttggtcattcagcgcttcctaaagaaaaactcaagtcagaaacaaatcaggagcaattattgatttaacagttttgcaaatgcttttgtatgtagaaggtgcatgaaaaagattccagtgatacgcagatcaaacactgcgtcgataatcacagctaatgtcgagtgcttgctgcgtgcgtgttgatcatttaagcctcacatgcgagccgtgcggtaagccctcctcctgccctcgccttagagatgaggaaactgagaggcagcgatgaagcagctcactagccctgctcctgtcctccccttagagatgaggaaactgagaggcagcgatgaaacagctcactagccctgctcctgtcctccccttagagatgaggaaactgagaggcagcgatgaagcagctcactagctctgctcctgccctccccttagagatgaggaaactgagaggcagagatgaagcagctcacttagatcacgggattagggggcggacctggacccgactccgaggccccctccagcagccaggccctcgcccatcacgcttggttgcttgtaatgggagccttgcctctcgccagcagtttgtggggagtaggtttcccgtttccactgttatttcctgactcccgtgcctcccaacttcccacccgctgtggctggcatttccaccggctccctggcttgtcctacgcctcatgcctcctatgtggctcttctttctcctcccgcccccctgctgcccgtggccccagaatggaggcttcccaggatggcccacacagtgccctgcacaggtgctgtggctcagccctggccattccctccacacgttctctgctccagccacactgagctccaagccatcctttagctatgcctgctgcaggccacctctgtagagggcctttcatgacctgttctagtaacccccctgcctggtgtcagccacccccgcccctggcctggtttgctattgccgggctgacctcgccccgtctttcagttctccgtgtggagggtgctgatccgtccgtctccatctgcttgtgaagcaataacagaacagcataggctgggtaatctatacagcacggaaatttctgtcctcatgcttcaggaggctgggaagtccaagatcaaggcaccagcaggttcaggtgtctggggagggctgcatcttctggaagggagaaggaaactggagggcaagcgagagagccccttacagcaagcccctttatgcaggcgcctgatcccatcgcaggggaggagccctcctggcctcgtcacctcttaaagccctgcttccttaagactctcactccacaacgcctgaactttggaggggacacattcgagccacagccccttccttcctgaggcttctcaagatgccccctcctgtgcttcctggagcacccgtccttccttgtcctgggacttggcacgcctgaccatagtcatacctgcttgtcctcttggcccctcttcaggtaatgggctccacacaggtcacgatctcggccaaaatagtcacacatcgtccctgcacccatcagtgtgtagtaaacaggaagtgcttaataaatgtttgatgaattaagagtgactcagtaatcccagtacaaaaaagcaacagcagacgttggagatgtgcttgaggcacgtgcccagcttgtgagcagaggccgccgctgccactccgtgctccccgtggactgccgtgctgagcgctgtgaatgtgctggctgtcccgtcgtgctccagctcttcaggcctccctgctcagcctctctcagcttcagttgccacgcacttctaggagaggccatcttgactttctcttgcagtcccggagccacacagggagcaggtgcgcagtcacctgggtgagggccccttcctgggtttcagaggcagcccagttcatgctcccagggcagcccttgtgcatggggagccgtagcctcaggcaggggcaccctgagccaacagcaccttgcagggccagccacagacataatggaaaacctcatccttcagccgcaacttttcctacctcccatcaaaaaaatgtccctcctctctcagtatgtggggactgcggtctccagagtggccatccacagtcacactggctgtcagtggctcctgtcaccaccctgccacctggtgacttgtgggccacactcaggagtcatgggaaggagacccttagagcagccccaggacaggcctccttgcgtgtacttctttgatgaaggcgggtataagccctggcagctcattgtcctctcttgagtccacataggttgcattttttaactctggcaaagtgaagttacaaagtcagtctggtgtcgcctgggacaggtccgagaaattagtataaagatggcttcactcctgcgtcgtattccagttcacgtttccatttcagtgtatacatgttacagtcgtgattgatcctgtgcataaattgggatgtgggtttttgttggagaaaaaaatgcacaaaagttcaggagctaagtaagagtgaaagattttcattggaccaggtgtggtggctcacacctgcaatcccagcactttgggaggccaagatgggcggatcacttgagtctaggagttcgagaccagcctggccaacacagtgagacccccatctcaaaaaagaaagaaagaaatagttggacatagtggcggacgtttgtagtcccagctactcaggaggctgaggctataggaggtgggggctgtagggagccatggttgcaccactgcgctccagcctgggcaacagagcaagaccctatctctaaaggaaaaacaaaacaaaacaaaacaaaacatgaagagtttcttggggccagttggcatctaaaaatatctaagtcttttgattctcagctatgacctggctacgttctaggctgtctttacgtgtttctaggactcttggcaaattctcagaacagttgacttaaaaagattagccacgtagtatttttacaaggagagagggaggtgaagtgatgagatggggccatacttataaaatgattcgggattattgatgaagtagtccctaggtttctgattaattaattttaaagcgctgaccaaatatgtacccagcgtaagaagccagagtcgatcagtgttgtagacacgtcgcctctcgatggcatctttccatgccacacccttcacgacctgaagctggagcttaaacccttcaagaagggtccctgcgaccgggtgcagtggctcacacctgtcatctttgggaggccaaggtgggcagatcactaggagttctaggccagtctggccgacatggagaaaccctgtctctactaaaaatacaaaaattagccaggcgtggtggtggacacctgcctgctcacaggctgagtcaggagaattgcttgaacccaggaggtggaggctgcagtgagctgagatcgcaccattgcactccatcctgggtgagagagtgagactccatctcaattaaaaaaaaaaaaaagaagggaccctgctttgttcatgattttattctcggtgtgtggcatacactaggcctgaaataaatgttatttaaatgttaaattacattgtccctccttccgatacatttgccatctggttaaattccagtgaagtcaaaggatggatttctttaaataaagtttgcttctttttcaaaaattccttgggctctttctagaaaagctgctcctttgccatcttcccagcagattcccggggcaggatccacccacctgttcacagctccttccagcgcagtgtgggtccggctgttagctcagcctcaaaggagaattgtaaagatacaggtcaagtgtccttttgaccaccttttttttttttttctatatgcgggattttgtgagacaataaaatgcatgtggacctcagcttaacaaaagctgaatgttcctggggtgagtgtttgaatccaacaggaaatagatgctcaacagctctgagtctggggaggttttaatggcctcttggtccctggtagggtcttgtttttcggggtagttttgcagcctctgacacaggtaagatggtcagtaccggaagctgccatgacgtctagactgaccgttaggaaggtactcactggactggtattcacagatggaaataaaccaaagcagtgtctagggtcaaccaatctgctttgctgccttcacagggaggtcctgggaccctttcatggaggaactttttaatgcttattttaaccctgaaggtaaaacatgaaacatgcagccattactccaagaaaacgtaacgtgggtgagtggtgtgtctcgggggcccacggtctccctgaggccgcatctctctggagagatcgtggacgtccgtcgtaaactatgacctattcacattttcactttactctcaactttccaggagtgagtcctctccagagagcaagacggagctgcgtttcaacagacggtgctttcaatctgtgctgactgtaacttttatccatcataggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaaggttagtttttttgttttttttttcctacttctaaaactttctattaattctgcagtagagcacgtgaaataataagcagcctccaggtctgaggcaaacaacttggaatgaccttcgatttggttttcacgattttaatatttagtctaaagttagtagcattctgcatttttaacatccttgctttttgacatatgacgcacctccattgcctttccattgcacaaggatgcttctcatttgaattattagttattttctcttcctgggacctgtggtgccttttgggatttctagaagctggtgataaatgacagtaaaggtggctttccttggcaccttgggtggagagctagttgataatctgatttcagagaccactttctcaaatacttctacgtctcttgaaatccactattttatgattacttgaaatgatgttggtgtgggtgaatcctaggacacagctcactgagaggacaggctgccgagaacattgtagtatttcattattggaaccgggatctcctggtagctgcctagaagtgcccgtttctggactgacctgtcatcataaactaccagggaattggcgcggtcgaccttgggtgtgtgaaatcatttcagtttatgagctgttcctttgctttcacatttgatttagtttccccactggtaccttctgtttatttttatagtttaaacatctactgtctccattcttaaaatgagacagagaatcaaaacagctctcctatgctgctttgtgttctcagataacacagtggggtatgtgtgaggatggcggccagtggttacagcttcacccaatacgtccctgcctctccacattcattcacaggtttgaaagccgctattggtatttacgaggaacagtcttcattatgtggcagtcagctggggtatgcagattacttactgggtcagaatacatagtgcctgtcgcccagttacacgtaatgattgcactcgggttctgtcaactccgctcgtggatcgcggtcgttgggtgctttgttagtgtaatgcagggcttctcaccttggcaccgctggcattttggaccaggtagtcatgtgttgtggggctgtcctgtgcactgtcagatggctggcagcatccctagccgccacctgccagatggcagcatacccacccgtaccctactccccagctgtgccaaccaaaaatgtctccagacatggcccagtgtcccctgggggtgcagagtcacccctgggtgaaaaccaccgggacagtggtgttggaccctctcttccctgtactcttggcacatgtgtaaagctcatgtatctgagattccctggatgcctgcaaactttagagacagccgccttgcctgggctgacgttgtgcaggagtcagaaaatggagctctgggctcctagacagcggacccgggcagggaggggctggcgtggggtggaatcgggaatggttttgctatttggggaagaattgtttcctccagcctgcaaactgagctgtatttaagtcgtgaaagacagccccgagccaaaaatatataattcgttgtgtttgccattttagcttccacatatgtgtgtttctgtccgttaggggatgcggtcgcagagttcaccatatcacatgctcacgggtttagtgaccacggttttagcaatggcgattctacactacattgcactctagtcatatatatttgttttggtcggaatgagcaaaaaccatttagcgtatcttcttggcatgtggagattttccaaatattgttgaaagtttctgagaatcttgtgatctatcaagttgacagaaggccgggcatggtggctcacgcctgtaatcctggtgctgtgggcggccgaggtgggagggatgcctgaggctaggatttccagaccagcctggtcatcgtagcaagacatcatctctacaaaaaaattttaaaaattaactgggcttggtggcctgtgcctgcggtcccagctacttgggaggctgagccaagaggatcacttgagcccaggaatttaggctgcatgagctatgattttgccactgcactccagcttaggccacagagtgagaccttgtcctgtctccaaaaaaagggaggagggcgctcagtggtaaagtaaattcgggaagcttgggatattcaacacagaaagggtttctttactgcaggacttctcggagccttcactaggctagtagacagtagctaggccttcagaggaggacgcggtatatacagcattctcaggcctctttgagcacaattgttttttttcaagctgcaccttgcagggctaatgtggtcacaccttttgggggaatgctcatgtagtaaaaggagtttcatgccaaggaccaatacattagagaaaaggtgttcaggaaacgttccctgaaggagcatgcgtagattttcacgtgtgtcctgttcctgctgctgctcacttgagatactcatggcttctctttcccctgaactcctgtctgcattcaccgttcagctccaccacgccttcccgtgcctccgcagctgataacgctgttccctcgtctccaaattctcagtcccttcagtctgtcccacttggctgtaacatacacgatcttaaatctttgtttcttatgcgtcttcctgggagctctttgcattcagagactgagtgttaaataacttaaatatttcccaagtgtcgagcatggtgcctggcatgtagtaattaacagtttctttttggctttttaattctttaattaaacacatggagcgatgcagctctgcagagccaggcgaaggactgaagtcagaagcccgagcagaactgtgtagaaccagggcagcgcccacgaagggtttatttcctgcccttagcatgtgtgtcctctgtgaccttaagtcatctcctaggtcatagctggaaaattcttatctaatgtaacataacctgtgtactgtaacgacctaccaggaaatgatagtgatgtcaaaggccagggctttggtcctgaagtcatagctcaaagggaaccctttctacacccaagtgttggcttctttttttttttttttttttttttaaagagatgggatctcgctctgttgcccaggctagagtaccagtggtatgatcttagctcactgcagctcgaaactctcaggctcaagtgatcctcccaagtcaacctgctgagtagctaggaccacaggcatgtgccactatgcctagctaatttttaaatttttttttttttgctatattgcccaggatggttgccaactcctggggttataccatcctcctgccttggcctcttaaaatgctgggattacagtcatgagccactgtgcctggccttgggttcttgaaatgaccagcagtgagaggtcctcatcctaagggccctgacattgcataatgtgggggacagatactgcccgagtgaaggaaggagaggtcaagaaggaaaccaaggagtaagcattagacatgaggacgccactgtcagcgtcgcggaggggaggcggaccacggcgggcaggggcgcaacttgaagcaagacccttctcaagccttggctttgcgactgtgaagaaactgcagccaggtgcagtggctcatgcctgtagtcctagccactcagacagctgaggcaggaagatcgcttgagcccaggagttagaggctgcagtgagctgtgatgatgccactgcactccaaccagggtgacagaatgagacactgtctcaaaaaaaaaaaaaaaaaagaaaagaaagagcaaacacacacttaattcctctaagtgagagttttcctcttcagtgcggtggtgataaggaagagacctctcgggattgctgggagatgagccggaatggtgcctgtggacgccagggctgagaagaagcctcgctcacactcggcacgcacgccttcactccacgcagagcagggacagtgaccacagacggagccatggaggactgggaggggccgagagacggtcccagcttgcctgcaggaagtcactgactctctggggaaggtcccatcttctccacggttccgattcgagggagattctcacagtgattgcggctgagcattgctgtgggttggatgctctcggccgtaaccaagtcacttgtatgacacgggagcatgtgtgccttggcctgttgaatgtgacgtcagcgctccagcaggcatttgctttccattttctcatgaaccctgtgggtgatgagtggatctagatgccatatatcaataaaaacagcttttccaacatcttcatgaagaaaaagaaaacccaactgggctcagtggctcatgcctgtaatcccagcactttgggaggccgaggcagagagatcacctgcggtcaggagttcaaggccagcctggccaacatggtgaaaccccatctctactaaaaatacaaaaattagccaggtgtggtggcatatgcctgtagtcctaagccactcaggaggctgaggcaggaggatcccttgaacctagtaggtgaaggttgcagtgagctgagaccacgccactgcacttcagactgggcaatagagtgagactccatctcgaaaagaaaagaaaacccaaaattgaattacttgtatcacattacttctgatcagggaaccatttgagctgtgaaagcatcttagtacatctctgaaaggcctccctggagcgcacctgcgtggctggtcttcctgagtttaccttcatctattattcagaaccccgggctgcttggccactgggtgtttctacatggaccagtcagtaatgaagctagtgatgtagatttacccatacggggatgactcagagaggacctgtcctgctttcaaaaggtttctccttcccctttaaggccactcacctcaggaaccatccttttgtgacagtgaattttgaaaatgaccctaaatgataacttcttttatctacttgttttctatgtgtcaagtcattatgagtaggctcagtcggcccaatttgaggaagtaaggggcttttcattcgttatagaaattgaaaaaatgatttcatattttatagacacatacatatataaatatatatagcttagaaattaaataggtatttattataagtggtagtctgaattgatagtggtgatgcttgcacatccctgtgaatatgctataaaccctggagttatatactttaaatgggtgcattatatgctttgcaaatgacatcttaagaaagctgttgtaaaactaaagggtagtctccgccaggtgaggtggtcacacctgtaatcccagcactttgggaggccaaggcagatggatcacctgaggtcaggagttcgagaccagcctggccaacatggtgaaaccccatgtctactaaaaatttaaaaattagccgggtgtggtggctggtgcctgtagtcccagctacttgggagactgaggcaggagaatctcttgaacctggaggcggaggttgcagtgagctgagatcatgtcactgccctctagcctgggcaacagagtgagattccatctcaaaaaaaaaataaataaaaaaaaaaaccatctctacaaaaactataaaagttagccaggcatgttggtatccacctgtagtcccagctacctgggaggctgaggtgggaggatcgcttgagtctgggaggcagaggctgcagtgagccaagattgcaccattgcactctagcctgggcactagaatgagaccccatctcaaaaaagaaaggtggggggcggggtaggaataggaacttcacagtggacaaaccgggcagatgccaccttcaccaaatgatccaggtgagcctccctgctcactgccatccggtaccctagtgtggtgtgctgagaagggcatgtcacctctgcggcattctttccgcaaaccccaaacctcagtctgctctgagaaagcaccaggcaggtccagatctggacatttgacaaaatgcctggccgggacttcaaacgcagcagggccagaagagacagagaaagacagaggaacccccataggctgggggtgagcagggggcatgagggctaaatgcaacacgggacctagaggagacccgaacagcaaagggacggtggggaaactggggacatcagaataaagccagcagcttagttaacggtatcgcgccagcatgagttgctttggttttgataactgtacggtgagtatgtacggaggatatatgcagagtccttgaactgtctttcccactctctgcaagtctaaaattatttcaaagtaagaaattatatatgtgtgtgtgtgtgtgtgtgtgtgtgtgtgtgtgtgtgtgtgtgtgtagagagagggatggaaatgtatgtgcggaatcattgaactggcattgccagagagtgaaatattgcatttccatgaaatttccccagatgccaaatattttcttatcttgacttcatgatggactgtttccacagctggtaacagtcttcctgcctgacagtctgctgagtatattttcatctattcttgactcggatcgccatcaccagcctggttattgagcccagtggtcctttagggctaagggattgagtgagaggtccagggacttttcgactccgccccgtgtggctctgagattgtgtgtgtgagttttacacgtgtgtgttcatgtggtgacttgtctagtattctcaggccatctgctgtctgttcttactgctttggggatgtaagaaaatttctttttctgtgataattactgcttatcttttcttctaatattctgcttctatttttctctaatgttgcattagcagaaatactctattttgtacttatgcccgtacctaacctgttagcttaaacagcaatgccagggacatagagttagccccatggctctgccgcactgacaggctgccccgttcacctggagatcgttggggccaggagctctgctgcctgggctcaccgcctctttacgcggttccgaccgtaccgtgtggctctgggccagtgcttgctctgtctcagtgtcctcatctgtaaaatggaaccgatcatagtacctgcatcgtggttgcttacgagggttaagcagatacaaggagtttcaaagaacacctcaggaaattgtgtttgtggttattgtggttgcaatatcatgactattcctgctcaccatgttaacatcattttgagtttgggagcaaaggatgcttctgataacacgacatcttgcaaaacagtcgtgttgagaagacgaagcaggcaaagccagggctcttctactggtgtatcctcctcatttctgagaaaagaggtttccccactccctcccttgacagttttgaaaagggacagctgttggcttagaaatgatttatcttgtgatgagaaataaccttgaagaaaaaacgattttatagctttgtgccatatattttgaccggaatgtagggtgcacgtcctgaaatgtgttaaaaacaaatgcaaatgtgcccaagtgtgttagagaaatggctacactcttccctccaaagcccacgtccacatgggggaaggagcaaagataatccggaaaaatgcagagtttgctcttgggcgttctccagggaatctcaggttacccaggcaacagccagcaaactccctggcccgccaggcgtgctgctgggaggaccttagaagtcttgagacttcccttgatgccggagggcccagggtgctgcttggaagaaccaggaggacaggcatagctgctcaggtcactctagggaaacaaggcccaggagagcaaggtgccaggattattcctgggtcctccttgtgccaggaaagggggccagagccatatgacggtggtccgggtcccagggccctggagtctgtggccgtctgcggaatgatcattgctgcctcacagtgtggctgcaaaggacgagatcatacagtcgagactgcagatattgcgtggatgggggcccgacttgttcacgggtaggatcttggcccatagacattcctaagtcatagtagctactgtcattatgacactgctttttctataatgtgcctgcccgtgtggctccctgtgagccagctgctagggttgtctcccaaggcagtgaggtgcttccatgcctgcagcttcctggagtcagaaatactcttcccagggagggcttctcagcaggggtggagatgcctgcagctgtgcagggggagacgctgtttagccggctgggaaacatttcacagaggcatctgtacttggcaaaaaacatgttgtgaaatgtcttaatccagattaaaattaagctaatgaatcgctcaaggaaaattgccatgggggttggggggtaggaggtcaggggagggaaacaaacccacccaccattgcatggtgggaccctcctggtacagaaggggcctctaactacagctcagaaggggatgttgagatgtgagaatctctccattgggtagatggatttctctttttttcttttcttttcttttcttttcttttcttttcttttcttttcttttctttctttctttcttttctttttttttttttttttttttttttttgagacagagttttgctcttttgcccgggctggagtgcagtggcaccatctcggctcactggaacctccacctcccgggttcaagagattcccctgcctcagcctccctagtagctgaaactacaggtgtgcaccaccacgccaggctaattttttgtattttagtagagacgggctttcaccatcttggccaggatggtctcaatctcctgaccttgtgatccacccatgttggcctcccaaagtgctgggattacaggcatgagccactgcgcctggcttcttttttcttttttaaagagacaaggtcttgctctatgacccagtctgcagtacagtggcatgaccatagctcatggcagcctctccctcctgggctcaagcgaccctcccacttcagcctcctgagtagctgggactacaagcacacaccactgtgcccagctaatttctaaaatttttaaaaagcttttgtagagatggggtcttgatacattgcccaggttgatctcaaactcctgggctcaagcaagccaccacacccagctctaagatttcttttgtttcatttgtttgaaagtttttatctagaaaattatccctcaaaaggaaggtagctgaggaatcttgctctgtcgcccaggctggagtgcagtggcacaatctgggctcactgcaacctccgcctcccgggtccaagcgactctcctgcctcagtctccccagtagctgggattacaggtgtgtgccaccacacccagctaatttttgtatttttaatagagacagggttttgccatgttgaccaggctggtcttaaactcctgacctcaggtgatccacccgcctcagcctcccaaagggctgggattacagggatgagccactgcgcccagccaaaatccgcattttcaaagtgcagtaaaatgatggctgctgggtccgggtgacacaggtctgtggggccatgccacccagcgcggcctggagtctgcacctggctctccccccacctcccatactcccacttcccggacaaacctgctgggaatggaataggcagtgagcactgtcccggccctcaggaggcccgagcgtgggtgtctacagctggccatgtgacccagacagcccccttccttctgcaagcgcagcctcatttgccatttgtgggcggctctgccagacctcacttctgtatcagaacttcttatcactgcagggtgcaggcctcggcctctgttcaaggggatgtaagcaaagcactgagttccccacctgtggagaccactgccccaggcccccagagctcagcctcatcccagtgggcatgcccgggctgcaccggccttccagcccctctgagggaagcccttgtggagggcatggagccccctgtcctcagtgtgccctctggtgccaagttggtttgactgtcacggtgacacattcatggctctaaatgcttagaaaatctcataaagccagtgtgccgtggggggcactgaagaagcaggcggcctcgtcttaaagcacaggagggttggccgggcacggtggctcacgcctgtaatcccagcactttgggagggcaaggcaggcagatcacttgaggccaggagttcgagaccagcctgaccaacgtggtgaaaccccatctctactgaaaatacaaaaataagccaggcgtggtggtgggcgcctgtaatcccagctactcaggaggttgaggcagcagaattgcttgaacccaggaggtggaggttgcagtgagccaagatctccccactgcactccagcctgggtgacagagcgagactcagtcccaaaaaaacaaacaaacaaaaaaagagagaaaagcacagcagatgaacttgaggcaagaaaaatacctgaaacagactgacgccaggagattcctgtgactaaatggctacagaagaatagataccaagggctgttctgtctgtaatcaaggacattgaattaccagatgaactttaatgaccagagagcatagttaacagaagttttcatattcactaccagcatttactgagcacgcacttgcacttcgggctttggctgagccaagtgcagcagacgcttccacacctccagcttcctttcctggtctaccggttgggccctgaaatggctggtgtgccccatcaagcaccaagccccccaccttagccacaccagagagttccctcaggcatcttttaggcatgggtatcaggcacacctattttattcttctcttggtgttagatttttttacatttaataagagcagtggtctcattggcaaatatatacatatttatacatatatatatgtattttgagaatgggtttgctctgtcacccacgctggagtgcagtggcacaatcacagtgcactgcagccttgacttccttcgctgaagcaatcctcctgcctcagcctcccgagtggctgggaccacaggcacgtgccatcaaggtcagctaattggttttatttttagtagagacaaggtctccctatgttgcccaggctggtcttgaactcctggccctaagcagtcctcctgcttcggcctcccaaagttctgggattacaggtgtgagccagcacaccagcaaaatgtttagaagtttaactctgccagtcaataccaagaggtgctttcaaatagactcactgtatgttattgataactagaacattttacctctgttgataatgtcagtttttaaagagctgtaagcaaatgttatctagatgccattatttgctcagatatgttaattaatgatttcgctagctgttttggcatgtatattttcattttttgaatgcatacaaatgttcaaatttagcttgtatgttacatcagattcccaaactatacaaccctgtagaatctttgtttcttttatttaatatagtacaggtctgcagtctaactttaaatacaacctgggtcatatctttgcccttaggtagtgacacttactttaaatttccaaaataatatctggcctcccataatttatttcaatgttttacacttcttgctgcaaggaaattgcttttgagtccaaaaaaaaaaaaaaatatatttcttgccacggtttgtcttcttcattggaagctgttagttgctttcttagatggttcctaggttacctggtcacattaataataataataagtttattacgggtatactgtatgccaggaactgtgctaggctatatatatacttatttcatttaattattatttttttaagacagggtctttctcttttgccccaggctggagtgcagtggcaccatcaaagctcactgcagccttgacctcccagactcaagcagccctcccacctcagccccacaagtagctgggactacaggcacatgccaccaggccaggctaatttttatgctttttgttgaggcagggttttgccatgttgcccaggctggcctcaaattcctggactcaagccatcctcccaccccagcttcccaaagtgctgggattacagccgccacacccagccaatttcatttaattcttagcaacatatcttcactcttggtttatagatgagggaactgaggtaaagtgatttgaacagagtctccaaactagtaagtacttgactagggtttgaatcctagtttatgagaaataaaggctttgctctttttagggtacctgtattaaatcttgccttctcttttctaggtccattaattcctataaacttttaagtacgcctagatctggaaatcgtgtacctttgattattcagcccatcttatgagactagctcaccatcacacggagcttaagaaccttggatttgtgtcctcgcatagttggtggccagtttctttacttaataacagctttgttgagatataattcacatactataaaatcgatctttttggccaggcacagtggctcatgcttgtaatcccagcactttgggaggccaagacgggtggatcacctgaggtcaggagttcaagaccagcctggccaacatggcgaaaccccgtttctactaaaaacacaaaacaagtagccgggcgtggtggcaggcacctgtaatcgcagctactcaggaggctgaggcaggagaatcgcttgaacccaggaggtggacgttgcagtgagccaagatcgtgacactgtactccagcctgggtgacaagagtgaaactccatctcaaaaaatatttaaaaatcgatctttttaaagtgtacagttcagtggtttttagtatatttagcaaggttgtgcaaccatcaccgtgatcaatttcagaacatttttatcatcccaaagagaaaccctgttgaaataccacaaaccaggtggcttttaaacaacagaaatgtatttctcagggttctggaggctgggaagtccgagatcaaggtcccggaagattcagtgtccagtgaggacccgttcctgcttcacagatggtgccttctcccagggcgaagggacgagggattcctctggggcctcttttatgagggcactaatcctattttgaaggcttgtcccccatgacctaattacctcccaaggctttgccccccaatgccatccccttgggaattaggatttcagcgtctgacttttgagggggcacaaacattcgaatcgtagcaaaccccacgccccttagcagccactcccccttcctgcccctggtcccgcctggcagccaggaatctgccttctccctccaaggattcaccttttctgaatatttcacatagacgggatcacgtaatatctgtgctgtgtctggcttccctccccgagcataatgttttcgaggttcaccatgctgtggcaggcgtcagtgcttccgtctttttcgtggctgagtaatatcccattgttcgaatagaccacagtttgttgatccattgttcagtcagtgaacattcccggttccatttttgggtcctgttgcgttcgtgcgcgggtttctgtgtgtttccactgtcactttgcccgttggctttcagctcatccccgagcggttctgtgtgccttccccttgctcaccaccatgctgcgtgacggcagatggcaacagcggacctgcctgaattcagggtggcagtcgcggtttctgggtgtgtccccacagtctgtgtttttcttctagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggtgacattcctgtcttgtcgacttcttagttctgagagtaactcctcttgggtaacaccactccgcacccgcgggtcctccgggtgttgaagagaccggcagggagctcgagggagggtcagcagcaacccacgtggaaaccagcgctcaggggctgagctgggcgggattcctctaaaggccaataagggtttaaaatgcgtggattcgagtgccgggaggggatttgtggtactggaagctggactcagtttatgatagaatatagacgggcagagacaagagggggtcttcacggcgagaaaggctgggtgaagagagaggttgggagttagggccggtggcaggaaggctttcaggaaaaccagacttggacaccagggccaggactcagcccacccgcgagagcctgtcggcgggggctcatgcaggcgactcacctggggcgcgggctctcgtcctccatctgctctccatctgccaaaggattgcaggtgcaggtcatcccatgccttcccacagccacgggggacacccacgacacgagcccgtttccatccaccttgcctgtgccctgacagccctggacccctcgtcatacttctcctggacccccgacccatgcaccctgctcccagaaccgtggttctggcctaagcagactctgggggcctcggctcctcactttcctcccttcccctccacctccgcaccgactcttcccatgtctcaatgtcctggcagcctgaacacccagcgttaccactgggcactgttgggtaacaggaaggagcagacgggcagtcagggctgggattggagcaggtctgtaggcgcaggggggtgggggttcctcgcaggtcagaaagtcccacgcccagtgcagcagcgccccgcagcagaggtcggggtgggacaggcgtgtgtgcccagtgcccggtgccacttcacttcccgtgtctgcgtcctctttgtctcgaggcaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacaggtacgactggggctgtctgggaaaaagcaaaggttgcaggcagaagcctctctgcctttttcttttcttttctttaagactgagtctcgctctgtcacccaggctgcagtgcagtggcgcgatcttggctcactgcagcctctatctcccaggttcaaacgatgctcctgcctcagcctcccaagtagctggggttactggcacccaccaccatgcctggctaggttttgtatttttagtagagatggagtttcatcatgttggccaggctggtctccatactcctgacctcgggtgatccacctaccccaccctcccagagtgctgggattataggcgtgagccaccacgcctggctttttttttttttttttttttaataaagactaggtcttgctgtgttgcccaggctggagtgcagtggctcaatctcggctcactgcaacctccacctcccaggttcaagtaattctcctgcctaggtctctcaagtagctgggactacaggcatacacaaccatgcccagctaatttttgtgtttttagtagagatgggtttttaacatgttggccaggcgggtctcgaactcttggcctcaggtgatctgcccgcctcggcctcctaaagtgctgggattacaggtgtgagcctgtgcctggcctaatggtaacatttttgaaaaatacaggtccagtccttttatcaaatattcctgaagttggattggttagattcaggctctccctctggccaggcagagactgcagaagggatgccgtgtcctcctcagggtgtcctctccagggacacgcagtgcccgtctgttcctcattagtgatactaattttgattaattaggcaaggtggtgccgggttctctcatctagggttattatattcctcttatgactaataagcaatctgtgagaaaatacttgaagatcttgtacatatttcattccccatcagaattccctagatttaacattcattgatgattcttgcctctgtcttcactataatgcctcaaagggtgattttcagccaggcgctgtggctcacgcctataatcccaacactttggggaggccgaggcaggtagatcacctgaagtcaggggttcaagaccagcctggccaacaaggtgaaaccccgtctctactaaaagtacaaaaattagctgggcgtggtggcgggtgcctgtcatcccagctactcaggaggctgaggtaggagaatcgcttgaacccaggaggcagaggctgcaatgagctgagatcgcagcactgcaactccagcctgggcaacagagcgagtctccatctcaaaaaacaaataagaaataaatggagcagcacagctaatagcagtgtcgcttctgccacttgactgctaaaatgtggccttgtgcacatcctctctgcagctgcgtggttgctcttccctcagtccacactccctgagtcaggggaggagagagggtcagtgtcctgggacagaattatttctcttctgagtctgagaatgttggaagttactggatacctgtcacagaaaggagagtgtccgccgtgctgcaaggacaggaaggaacacacgtgatgagccgtactttgtgtggggggcacatgaggcacttgacatatttcacctgatttactctttttttttttttttgagacatagtcttgctgtgtcacccaggctgtaatgcagtggcgccatcttggctcattgcaacctccatctcccaggttcaagtgattctcctgccttagccacccgagtagctgggattacaggcacctgccaccaggcctggctaatttttgtattttttgtagaaacgggggttcaccatgttggccaggctggtcccgagctcctgacctcaggtgatccgcttgcctcggcctcccaaaggtctggggattacaaggatgagccaccgcgcccagcctcgtctaatttacttctgatagtcactgtatgagggagagaggctaacacagctatatttgctttctgaaatcatgttaacgttcccttagtttctagtaattttctgcagtatagaaaggatattactatttgctggcaattcataaatgaatgaaagagtcatggaaagcggggttgatttccctgctattaaaatcactgagctttatcattttgcaggtttcacatgcaatctgcatatgtgacaatagcaccaaaattacgctaactataaacacaattttgtgataacaacctgttagcttttacggtggcaattactgtcagtgctctgaatgacaggaccgccggttctgaattatgttttcgtttgaagcctccaaatccatgtaagtactctcagcacagtgatctgcgtgttcttcacaaaagattgtttcaaagaacagaaaagctgccttcatcttctcctaatcctagacattaggaatgtgttttcaaaaacaagcctcagcagctcacgctgtcatcccagcactttgggaggccgagatgggtggatctcttgagcccaggagttcgagaccagcctgaccaacatggtgaaaccccgcgtctgctaaaaaatacaaaaattagctgggtgcggtggcaggcgcctgtaatcccagctactcaggaggctgaggcaggagaattgcttgaacctgggaggcggagattgcagtgagccaagatcgctgcgccattgcactccagcctgggcgacagagtgagaccttgcctcaaaaaaaaaaaaccccaaaaaaccaaggttctgatatgatgtgtgttataatcatggtggatggtcattctttaacgaaggtgaaacacaaaatatgattatgctttgaggtgcgaaggactttccacagatctgttttaacaaggggcagctgagtggcgtctgttccacaggcgcttttagacgcagctgttgtaatatacctaatgagcagcgttttggtagctaattatgatctgaaaacattggcacagtcatggtgctgggtattgatcgactgcatttgttgtgtcttctagcctgatgaaagattacttttttaagccgcccattaatcagttcagcctgaacttcctggatcaggagctggagcgatcctacaggaccagctatcaggaagaggtgcgttcatttctccttgcgcttttactaaagaatgtgtttgttgttctcacatggtcattcactgttagttttgtgctttaccaagggatgggaacacgaaggcgaacattgatttcccacactctgtaaaccctaagtggcaactgtacatgaaatgtctctttgcaaaggaggaaaaaaaccctttctttagtcctttgtcttaaagcgcagcctcgccattactagcccctttcctctgccgtggcatctccaggctatccccagccttggaaggggcccccccaccacaacctgtcctgaaaggaaacccccaacctgccctggaaggaaacccccccacctgccttggaaggggcccccacacctgccctggtaaaggaaccccccccacctgccatggaaggggtcccccacctgccctagaaaggaacccctccccacctgccctggaaaggaaccccgacacctgccctggaagggaaccccccacacctgccctggaagggaatcccccacacctgccctggaagggaatcccccacacctgccctggaagggaaccccccacctgccctggaagggaactccccaccgacctgccctggaagagcccccgtcccacctgtcttggagtcttgggtgagactcttctctgttgccctccctgctttcttcccctgagaagggcccaggaggccttcacctctctctctaactccggctccatgttccctctcccgcccccaccgccttaaccccttgtacttgacttctcagcccatcacccaatcccacttcctccaagaagctctccccgactgcagactggattgtacttcccttcatacacttccttctccgtgtgtgccccattttggaatctttccgtgtgtggttctggattcgtgttcctccctccctagatgctcagctctgtgaggtaggacccccgtctctctcctccagcccctccttacagcctccagcacagtcccaacacccatctctctcctccagcccctcctcacagcctccagcagagtcccagcgctcacaagtgctccttagggggttgctggaaggaataatacaagaacctagagcctggtttgaatcctggcggcttccagactgcattctctcctctgggcccaaacctaacctctgagtgttcccaagtcaagagtggatgccctccccacccggaacaaaagggatttctcactctgattcccttggttcctccagcaggtcttcattaaactccgtggtgtcctggcttgggctctagagagaccctggtgagcccagtagagccagttcatgcctcgtggggtgggaggtgcccccttccgtcagcctccaagggacagtgaatatccgttaatgtcccagacatggctcccggagtggacttgcaagttggcagttggctggttggtggcccgtaaggcaaaatatcgtctcatttaatgctcatagcaatgctgtagggaagctgatgattatcctccttttaccaaagagctgacgctgagcaaggctgaacaggtggctgtggtcccatagccggggtcggacacgagtggtctggctgccaaaccaggcgtccgggccgctcctcgccctgcactgctgagcctcccaaacagcagacacctttgccatgccttcctccaggcaccaaatgtacgctcagcctctgctctgccagggactgttcttggtgctggggaagggggaaagacgtggcctgatggggagcaggaattagaaacaacatccggagctggaggtctgcgagtgccctcccagcacacggcgaggcaccaagcccaggctgggggctccaaggggggaactcctgagcctgcctcagtggggggactaggaattaatggaatgtgggatgagggaacattctggagagtggggccagcacccacaaacgttagagataccaaagagcctggttcgtccagggagttgcaggcgcatccggggcagggtggggcaggagtggcaggacctggcaggggccaggtcacggctcccatgccatggactttatgccacaggccatggggagctgttgaaggatctggaacaggttgtgttacaaagatcacacagctcacacctgtaatcccaattactcaggaagctgaggcaggaggatcacttgaggccagtagatagaccagcctgggcaacatagtgagaccctgtctcttccaacaaaaagaagaaaaacatggccgggcgcggtggctcatgcctgtaatcccagcactttgggaggctgaggcgggcagatcacctgaggtcaggagttcgagaccagcctggccaacatagtgaaaccccgtctctactaaaaatacaaaacttagccaggtatggtggcgggcgcctgtaatcccagctacttgggaagctgagacaggaaaatcgcctgaacccgggaggcggaggttgcagtgagccgagaccatgccgttgcactattgcactccggcctgggcaagaagagtgaaactccgtctcaaaaaaagaaaaaaaacaaacatgtatcagctgagtttcggagggtgataagagtgtggacaagacaggaggccacatgacaggtgggaggctgttaccgaaactcagggcaggtggccacagggtcccggtggggaggaaaggagagatgccaggacaagggagcctcccagctggcccgcgtttggggactcattgtgctgggggctccacgtgggtgcgttcttagccgagcatcccaccgcccacaaggtgcaagtactggtttatccctggttttggataaagagactgaggcatggacgcgtgggtatcatagctaatcatggtggagtggccttgagcccagacagcccggctgcagagcctgtgctctgatgatggtgggacggccgcacccagaggccctgggatgtgggtagtgagcagggcggagcctggcccacggtgccctggcagccagtggcactgtccctgggtttggagcccatggggagagagggcgaaagagtgtcatgatgtgggggagcgtcgttctcagtgggactgggacaggtggcactcccgggatgtacaggggtggggcagatgggcctgggagcctctggcatcagggccaggggtggcccagagggggaggctgtggcagggacaggtgtctctggcaagtagcagggcaggcaggagagactgcaagggaggtggagggaggagcggggcctctggcagcgtccatggatggggcagttctacagaggagatggcagccccaatcaggaaaggccctgtacccgagcccttggcttggaaggtgggaggtgtgggctctcagaaggacggcagcccacgtggaaaccttccggcctcacatgtgggcaaggcagtgatgtctcagggacatcacatgcatgcacccggccctgactcgaacccctgacgggcactagatggagccccacagaaaggggacgtgcgtgggcctctgccaaggtgagtgggcatgggcagtgtcgcccctgaaattcctacacctggccgggtacagtggctcaggcctgtaatcccagcactttgggaggccgaggcaggcagatcacgaggtcgagatagagaccatcctagccaacttggtgaaatcccatctctactaatcatacaaaaattagctgggcgtggtggcgggtgcctgtcctcccagctactccagaggctgaggcaggagaattgcttgaacctgggaggcggaggttgcagtgagccaagatcgcgccactgcactccagcctggcgacagccagatcccatctcaaaaaaaaaaaaaaaaaaggaaaagaaaagaaaaatgaaaaaaaagaaattcccacaccttctgaggggattccagggctgggacctgactcgcccttttgggcactacagagcctccagcttccttggagagaatttggaaccaaaccctaacccccaggttgccctggcagggtccagcctggcatcagggctgactggcagccttgctcccaccgtccaagtgcccctcctgccctcccacctagttcctgggagtggtcgaggcacccggagctggtttgtcccaaagaacgcacaccgcacccagggctgccaggagacctttccgctccgtgcgtctccagctcctgccctcagccccgagcctggccgggatgctgagtggacacccatggcctctcaggggttgccagaaggttgcaaggccaaatggaaagcagctgaactggctacatcccttcctctcccaaccacagcctctgcctttggatcctacaccttcctctaggttagggacacactcaggagtcaaccggtccatgccaagtcctggcctggctccttgttcgctgtgtgccctaggggtagcccctggccttggcctcccaatctgtacaccgagatgggtggtagttcctgcctgtggggtgccgtgagcgtcaatggagatcgcacctccccagagccttgcagggcctgggcctggtcacctcttggacgtgtcagcatcgttatttctccccctcaattgccgaacactagtgtgtgcctctctagtgtactggcccccagcacagagccaggccccgtaggttcccaggcgatgatgtgccacttaaatccccgtcggccacttccgccacgaagccccgctttcgcacctgctgaacctaggactccgccatgcagcaggaccgccctgcacattgctctcgtccaactgccttacagatgcagggacctcacctgcgccagtcagtaactcatcttgcagctaaatatataatgtgtctatgagaatgtgctgggtcataatcagttgctctgtgaccctggcagggttttttttgtgtttttttgttttcggaaacggtataattctgcagtggtgtgatcatagttcactgcggcttcaaactcctgggctcaagcaatcctcccacctcagaccccaagtacctgggactacaggcacaaaccactatgcccagctaattattttattttttggtagacggggtctcgctatgttgcccaggctggagtgcagtggcatgattatagctcactgcggcctgaaactcctgggctcacacaatcctcctgcgtcatcctcctgagtagctgggaccacactcacgcactgccatgcctggctaattttaaagttttttgtagagatggagtctcactgtgttacgctggccgggaactcctgggctccagcgaccctcctacgtcagcctcccaaagtgtcgggattacaggcgtgagccaccgtgcccagccccctgggcaagtttaacttctctgtgccttggactccccagtgttaaatggggtagtagagggagacagccctccgagagccttcctgccctgtgcctggcccagagcagcagtgctccgcacgtgttgcctgtttctccatctgaactgcgctcctggccgcccatggcctcccagtcattctgctccactcctgctccacacaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggtaagcgccgcgtggactgggtctccagctctgagccgttagctccctcttctggctccatggcttatggctgagcggttggactggtccccagccagctgtccctgctggctgatttctggagatgggtccccgtgtcctccccgagccctgtgccccagcatcctccctccctgacgttggcccagatgcggggggaccacctcgctggagggggcggtgcctccacagccccaaccgctgccagcttgtccccagatttccaggttcagagactgcaaaggagaaggtgagaagataggaaacaatctggaggaaggaaaggaaaagacatgagcgggggtagtgggcctgggacagcaggcgcctcttcagagtaccggagccaaacagcatctccacgcacttgcctcaggcagtggtctcttggatgtgacgccaacagaagaaagaatagacaagcccaacttcctcagaagttaagctgttgcgctacaaagaacaccatcaagaaagagaaagaacccacagaacgggagggaacacttgcagatcaggcctcggacaaggtctaacatctagaatggataaagagcacacatagcctgataataaaaagacagctcattttaaaggggacagaggctccgaatagaccacaggtgcgtcttgggaaagctgggccctcgggaccagcctggctccctgagggggctcgcagcggctctgtattcctgagcaggaaggtggccctgtgtggtccccgtcctgggcaccacaagccccttgggtggtcctgtcaccctcaacaggatggctgccggcctagcagagtcccactagcaacggtgccccggagctgggcttcaaacagacatggggaggcagccctgaccttgagcgtctgctgcccttatccaacatcccagggcagaaatgaatggctttgagtctggcgtgaggcgccggaatgctggcttctcccatctggggtgggcaggctgggattcctgccccctccttcccacctgcactgtacccaggaccctttcagcttcctccgaggccgccatgggccatgctgtctgtggcgtgtgctcagtgtttcccagaactccctgtgggctcatgccccatcacccccagcgagcagccctcttcctggcacagcctcccctcctgcctcagtgccctcctgtgcttctggggacccctcccaaaggagccgtcgcctgcaaaccctttcagggtccacttccccagaacccaaaccagacatcctcaggcccctggttggtttgtttttcctctttaaaaagatcagctttaggctgggcatggtggctcatgcctgtaatcccagcactttgggaggccaaggcaggtggatcacctgaggctgggagttcgagaccagcctggacagcatggtgaaaccccatctctactaaaaaataccaaaaaaaaaaaaaatagccattcttggttgtgggcacgtgtaaccccagctactcgggaggctgaggcaggagaatcaacttgaacccaggaggtggagattgcagtgagctgagatcgcaccattgcactccattctgggtgacgagcaaaactccatctcaaaaaagaaaaaaaagaagatctgctttattgtgacatgatttatatacaataaactcattcaagtggacaactctgatttttagcaaatttgaagaattgtatgaatatcaccactatgtaactatcgggcacctccatcaccccaaaaagaaacccatcctcatgggcagtcactcccccaggtctgccttccctggtccacccccaggttttcctctaatgtgggtagctgtagcgtcttgagggctctgaggccagcattgtctccattcctttttactttcaccctttagctattattccctgctccttcagacccaattctaaagcattgagggcaaccccggtgtagactgccgagggctggggtgaggtgcgctggaactgcctgcacagacatactccccaaggatctggtgaaggtggtggctgctgcacccctgaacaggcctgtggtgggatttggttccatttaccaggaatcgtcaagcctgggagaggcccagaccctgaaaggcttccctggcccctctgagggccgtgttgaggaccccaggttgacgggaacctgcgctgtggggtatacgggcaccccatccctttcctgtacaggaggaaagccaggcgcctcctcagtgactggcccaggccccgcccgttgcctccaggaggcttcctgcatcaccctctctgctctgccccagcaggcgtgaggtctcattttcagatccctgcagtctcagggaccagcatgaaggccccctccaacctcacatctttcccgctgctgactgggaacttggttccctctgtcccccctcctagggcctctgtattctgcatatttgtggttattcttggaagtattccaaagtcttcattatcctttaaatatcaggaagccagggctgtccaggaccctaaaagggtgaggctgtgcctgcgtccatgtggggaatggctggagagtgagcgttccctcgcctggccacaccacgcagccaagagggagaggcatggtaggtgttcaggcccgaaggctgggggcggggggctctgtgccagaggcttttttgctgttcagtcacaacagcggcccccgcccagcctctcctgaggcagggacagcaggcctatccccagctccctggcagcaagcttgagagaaggactgtctccccacgaggaccccacaccttctcttcacctccccatgtggccccaccatggcccaggggtccttggactcagccaagacctgttcctcctcctcacagtggttcttggcccgcacactcagctgcttctttatacagaaacttttattgtgtcaacatcacactcctgaaacgaagcccgctagacacacgcctgcaaaaggagtcagtgaatacagtcgctctgcttagaaggacaaagtcttttaaaatgaaatacgtggtgctggacctcacgtacaacagagccccgctgtctggagagtcctgaagccgccagctacaggtgaacatgcacgatgaacatgacagcccagatgcagacggcacgcgtgtgcgggtttggtggtctaagcgccacgagccaggttcagcctgtggtgtgattttctgaaacactgatgatgatgccccaaacagcagagaccactgtcactcagtttccacaggagctgcgctccaagaaaatccagggtgtgtcagcaccaccacagagcaccctgtttgtagctgggacacagcctctgggctaagatgctgtcagcagccttctgcctttgcaggtgcccaggggcttggctgctgtgtggggtgcagggcagaacctccctgggtggcacctgcccacatgcaggacagctctgtccctggcgcctgcccaccagatgccaggaccgcctcttctgctgcgacaactgcacgggctccacagaattccaggacgcctccaaagctgcccccgtcaagacctcctgcctcagaagctgatgggagccggtgacggcaacgtggtggcccccaggagactctcctcagggcctgtgatactctcacgtgttctgttaggcgagcgaagcatgtgcttttcacaagcatattttatcacaacgcaacatgtgaccctagaatcaggtacaatgagctaagcctggcttccttgccttctaccaaaagtgagggaggtagactcccaccccacgcctgctctcacgcccatcccaggggcaacacgggagagagcagagggcggcgctggctgcggcctcgcacctgtctcctggccgatgacccaccccgggccccgtcgctcctgctaacccccatgcctctcgcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacgtaagtaaaggctcagccgttttatttccacgctctcctggactccctaatctctcttttctttaaatcacttgggatagcaatttaaaaataaaccctttggccaggcatggtggctcacgcctgtaatcccagcactgtgggaggtggaggtgggcagatcacaaggtcaagagatcgagaccatcctggccaacatggtgaaaccccgtctctactaaaaatacaattagctggtcatggtggcaggcgcctttaatcccagctacttgggaggctgaggcaggagaatcgcttgaacctgggaggcagaggttgcagtgagctgaggttgcaccaccacactgcagcctgggtgatggagcgagactgcgtcacaaaataaaataaaataaataaaataaaataaacccttgaagaggcacgaactcttttactctcctgagccagcttttttagaagccgacttagcattggcctgcccagatgctcacggccgggcagtggccgggctggggagtccccggtgggcacgagtccctgccagtgtggcttcttcttcatcaagttccaaatcagttattttccttcacattttacaaagaagcgtctgtcccacctttcctaaccatgcgagaagcatacctggcacacagaattgacttgtgcccgggtcggctgctgctgatcaggaagggacctgtgctaaactccgtggagagggaaccagcacggccgtgggagatgatccttctggtgcaagtgagcatgagcttccgggcgggctgatggtgtttgacactttagccccaaatcacatctcactgggccccaaggaaaagtgttttgaaggaaactgatcacacagcgtttctcaaacagggaggcctccctttcctttccacgaagacacgtgccatttcccacacctgcagaagagtgtgatgccatgtgaacagggagcctcacgctgggtagggaacctagaggcttgatctgtccttgacactgcccactagcaaaagtaagactgactgcagatagtgagcaattagctggtatcggtgatatttttaggttacacagaaacatggattaggccgggagcggtggctcatacctgtaatcccaggcactttgagaggccgaggcaggtggatcacctgaggtcaggagttcgagaccagcctggccaacatggtgaaacccagtctttactaaaaatacaaaaattagcgaggtgtggtgccgggagcctgtcatcccagctactcatgaggctgaggtaggagaatcacttgaacccggaaggcagaggttgcagtgagctgagattgcaccactgcactccagcctgggcgacagagtgagactcagtcaaaaaaaaaaggaaacatggattagtggcgaatgttttggcggccgggtatagcaggggtggcggggtggccctgggcggctgtcctaacccttcgcctcttgcagttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacaggtacgcggccagcactgcttgcgggcaccagggtgcgtggccaccttgcccgaggttgcgtagggcctggctgcatttgcacattgcttctcacgccccgatagagatatttcccatcatgacccaaaatagctgtcagcacacatcataccaaagagctaatgagatgccctcagagtaatatgcaaaagaaagaaaaagaatatcatttagaacagcactctgggtagttgaatgtagacatcctggaaaacataatgctgccattgcattataccgaggtgacttctgatgaatgggctggaatctaagaaagtaggacctgaaggatttcatagaagatggtcaaggccatgaaagagcggagctgcagatggatgtgaaggtggagaggaagctggtgctgactttccttgagtggggtagggttcatgaaccgggacaggtcacagcctggaaggaggaggtgaagacgtaggatgatcttgcaagtcacctggggcttatttcaaaatattatgtcaggctgggcacagtggctcatgcctgtaatcccagcactttgggaggccaaggcaggcagatcacctgaggtcaggagttcaagaccagcctggccaacatggtgaaaccccgtctctacgaaaaatacaaaaattagtcaggcatgggggcgtgcacctgtaatcgcagctacttgggaggctgaggtaggagaaccgcttgtacccgggaggcggaggttgcagtgagctgagattgcgccattgcactccagcctgggtgacaagagtgagattccatctcaaaaacaaaaaataataaataggtcaaaacagttccccatatgatgtcatgagacgtaggattaatgaccagtcactgaacataggtcttttattttgaaatcctctgcatactgaggaggacgctggccttcagaaccgtatcactggtaggtgctgaggaatgggatggcgcagacacagaaacaggagtcagggaggccggtagacctctggggacaagcccagttctcatcattgtactacaaaaaatgtaaaaacttacaggatggcagtgataggtgctatatttaaaatatttgccattagcgacatccagtaagatccctatctttcatgtgttgcactaactgaataattcttgatttgttaaaaataagtcccagccggtcttggtgctcacgcctgtaatcctaccacttttgggaggctgaagcgggtggattgtctgagctcaggagttcaagacagcctgggcaacacggtgaaaccctgtctctactaaaaatacaaaaaattagccaggcatggcggtgtgcacctgtagtcccagctactcaggaggctgaggcaggagaattggttgaccctgggaggcggaggttgcagtgaaccgagatcgcgccactgcactccagcctgggtgacagagcaagactcagtctccaaaaataaaaataaaaaataagtctcaaaattgcctattacacatttgctactggtttcagggtattttaagccttttcaactaaatgtgttgttggaaatacagtaataccttgtataacagaatgtaagcagtgaacaatttattcaaatatttcgtgatatcttaaacccattaagcttccattcatgtaataaatttctcccaaatattgggcttttcctataactgcttataaaaatgtttcactattagtgtgtattgaagaaccgcctgtttacaattacagagggtttaggtgcgcagaatgttttaaagtcacatgggacatttcttccttgtccttgcaggagatctaacattctggctccctgagttattaagagaaccagagggacccctggcatttccgaaatgccccgttggagtggcattgctgttgccaaggacctctgcttgaattcattcaaaagcacaaaatgattctatttgccgcagtattgtcagtatcagacggagtaggcacggggtgtctttggttattagcaaagcaacagtccagccatgggcagtgtgagcatccgtcctcagtttacttaagaaaagaatcacaatacaaaagacatttaaattccctgcaaattaagatcaaaaagggaatttaaaataggactgtcattcagtacttgaaaggaaactttaatgaatagattaagcaaaataaagcagacttggatttttctgaaggtatggccatctagaacgatggtcacgatgagctctttctcgagagtatgaaatccagcaaactgctttttaccttttaaatccatcacaggtccctcatcgggcattcaccgtggcctttagtcatggctgcggggcttttctacctggagctggagagccacagtgatgggggacccctctgccgcctttgtgcccagagttcaaatagcagatctggggtagggatgatggttgaagttccactcggcccagaactcctccatccacttgaggcctcagagcccctaatcccatcacggttgctaagcctcagcaggatagagaggatgcgggatggtaaacaaagacgtaaactcagctttaccaagggaactgcccccagcattgggagacacagatgtgaagaaagaggtgggagcaggtggctttatgtggatgtacaaccacgtctaaaaaaggaacatagtttgttcaagctcttctcaggttgccttgtggaatgccttctttgctctttatgataatatttttctgcattttaatttcagttctgtattaacttcgccccttgacgcagtacagaatttcaggtaagcttttaatattgcacttctgtctgaataaacgagagtgactgtattaccctgcccatttcgaagcttcctgaaaacaatgggatcttgaataaaaggaacaatacgtgcattcttagaatagaaagtggaaaatatctcctcgttgaactgtatcatagttataatgtctaatggggaaaataaaattagttttattattttaataagacattacagtcatgtaattttatgtaagactttcgcatgcaacaaaggaaatctcgcaaatcaaagaaaaaagttattttgtaaaatattttaaaataaccgacttgaaatcagccaggcacggtggctcacgcctgtaatcccagcattttgggaggccgaggcgggcggatcacgaggtcaggagatggagaccatcctggctaacacggtgaaaccccgtctctactaaacaaaatacaaaaaattagctgggcatggtggcgggcgcctgtagtcccagctactcaggaggctgaggcgggagaatggcgtgaacccgggaggcggagcttgcagtgagccaagattgtgccactgcactccagcctgggtgacagaatgagactgtgtctcaaaaagtaataaaataactgacttgaaatccaaaatactaaatgtttgacccttgctttactataaacagcagaataaattctaaataaattgaagagtcggaaataaaaattaaactatataaaatctagaaaaagtaaaattcaatagttttcaagcctctaaaactgagataactttccaggcttacaaataataaatagaaccacaacgaaaagatggacagatttgagaggaagggagagaaaatcaaagcacacagaaaaggaccgggctcggtgactcccgcctgtaatcccagcactttgggaggccaaggcaggaagattacttgaggcctggagttctagaccagcctgggcaacatagcgaaatcctgttttggcaaaaaattgtaaaaattagccaggtatggtggtatgcacctgtagtcccagctactcgggaagctaaggtgggcttgaggccgggaatttgaggctgcattgagctgtgatggtgtccttgcaccccagcctggttgtcacagcaagactctgtctcagaaaaaaaaggccaggcacgttggctcatgcctgtaattccagcactttgggaggccaaggcaggtggatcacctgagatcaggagttcaagaccagcctggccaacatggcaaaaccccgtctctactaaaaatacaaaaattagctggggtggtggtgggcacctgtaatcctagccacttgggaggctgaggcaggagaattgcttgaacctgggaagcggaggttgcagtgagccaagatcggccactgcactccagcctgggcgacagagtgagactctgtctcaaaaaataaaataaaataaaaaaaagattcattagcaactgtagttgtcaataataaataaattaactgattatacatttactcaaataatacaactgttaaaatgcagtaaatatggaaaacatttaagattttcatttactaggtgaaactatatatgtactataggtacaactaggtatttatatatagtaaaaatatgtacgagatttatacttaggatataatgaatgagtgatgattacagctttagtacttaaaagtaaagcacctagcatctttttttaaccttttattgatgtgtatgtcagtatgcacagaagagtacctgatcataaaaggacagctcagtgcattttcaccagagaacacacccatttaactaccacccagaccaagaagtagagcattaccactaccccagaagccctccaaccccaccgctgctgaccccctctcccccgacctgaccacctccctaggggcagattttaaatggcactgaaatataccaaagtgtcaaccgaagccacgtttggctggttaggactgcaagtgatgtttgctttctatttttttcagtttttcaatccctcttctccatgataacggattacactgtattttactctaacttccatttatgacttataaattaactcctgcatttagtcacatgaaatgcctctttttgagccaggtgtggtggctcacgcctgtaatcccaacactttgggaggctgaggcaggtggatcacctgaggtcaggagttcgagaccagcctgaccaacatgtttgtgaaaccccatctctactaaaaatacaaaaattagctggacgtggtggcgggcacctgtaatcccagctactcgggaggctgaggcaggagaattgctagaacccgggaggcagaggttgcagtgagcctagatcgcaccactgcactccagcctgggggacagagcaagactccatctcaaaaaaaaaaaaagaaaagaaaaagaaattcttctttttgaagtggatctttgctatttgaatttaggaataggatcggctcctttgttcctttggtattaaaataggaaacacacattctagctgggaagctgtcctcgtacctgtttcttacagatgccttctgttgcgaggcagcccccttggtttctgagtgcacatgctgtgtgtgatggcttttcttccttggaagcaaaggtggaaagcaaacgctgtgctctgccttcctctccctctggcactagcccatgtgctgctgtccctcctctgcctggaggggcctggcctgcgcccgtctcgagtcagctgtgctgctggctccggctcccgcagattagagtgagctgtacaagcgataactgattgagaagcccagatacagtctcccatttccaccacagagactggaaacaccccctgcacataatggggatgttagaccttggtgacacctgctcctaaaggggactgttcttggtgtcaccactttgagaaaccaaaagaaaggtcaactcctaacccaacgagcggggctcacaaaaccttcccccagtccatattctcttcctgctctatttacaatcaaccagagggctcatggagctggacagaaatatgtttgagtcatcatcgtaacaaatggttattttgcttagtacttgagatgtaggatatgtaatgtcatctgtttcaatagcagttcacgaaatgagtcagtgaagcacagggtgtcttcccactgaggactcttggttcctggtcataggcgttgagtcacaaagcccgtatcagggctcccaagaccagccccaggtggactcaggactccgcaatctgctctctcaccgctgtgattacagcgaaaagacataaggcagaatcagcaaagggaagggtgtgtgagttgacgtttggaggaagccggcaccagcttccaagagtcctctcccggtagagtcacacgggatgggcttaattcctccagcagtgagtggtgacaacacttgtaacatgctgcctaccagggaagctcattaaagtctcggtgtccaggcttgtattaggggctgttcaggtctcccgcctctgcccagcacgtgcctaaattccagacttccagcaggaaagcgggtattcagcgtaaacctccttatttagacagtgtaggcagtgtgagccgctcttatcaaggaatggcaggaaccctccccaaatcccagctccctggtgccagccaccacctttgcaggcaggtctttccaaggatggcagcctcaggcctttcctgcacggaaccttaggctggaagggacgtagccatgctccagtccatcttcacagcttacaagcgaggaaactgagacccagaaagatggcatggcttacccaagattctgaaactcccccgcggtccagccaggatggggcccaggggttctgttccacccacggccagggcttttggcggttgtgcttcgcagagggccgtgatggccacacaggtcaagctcattgttttttaatatcccaagaacagttagtgaaacttattagacactttgattaaaggactgagcttttggccgggcatggtggctcgtgcctgtaatcccagcactttgggaggccaaggcgggtggatcacctgaggtcaggagttccagaccaacctggtcaacatggtgaaaccctgtctctactaaaaaatacaaaaattagccaagtatggtggcgcacacctgtagtcccagctactcgggaggctgaggcaagagaatcacttgaacctggaagcggaggttgcagtgagccaaggtcgcgccattgcactccagccagggcaacagagcaagaaagaaaaaagaagaattgagttttggccaggcgtggtggctcatccctgtaatcccagcacttggggaggctaaggcaggcagattggttgagctcaggagttcaagaccagcctgggcaagatggcgagaccctgtctctaaaagaaaaagaattgagctttccagtgtgatggagctgtctaaactgtggatccgccagtcgcatatataagtatatagtgaccaagcccattattgcatcaaatcaactggcctactctgtgcgcgggaggaatgcatcagggtacagcatttacatgaacagaacagtcacggtgttgtaaaaaagaaaaagactagaatgcagttcaacaaatgttaatagtgattgcctctggatggcaggacgatggacaaatcttttttgtctatttttttctacattttctatgatgagtatgtagtatttttaaatgggaaaaaatgtattccagcacactggggaggcagaagcagaacagtttgaacccaggagtttgagaccagcctgggcaacatagtaagacctcatctctacaaaaagttcaaaaaattagccaggtgtggtggtgtgtgcctgtagtcccagctaatctggaggctgaggcgggaggatcgctttagcctgggaggtcaaagctgcagtgagctaggatcgcaccactgcagtccagcttggatgacagagacagaccctgtctcttcttaaaaaaaaaaaaaaatacatatatatatatatatatatatatatatatatatatatatttcaaacaaactttaagaaattgtgctactcagccaggtgtggtggctcacacctgtaatcccagcactttgggaggtcgaggcgggcagatcactttaggtcaggagtttgagaccagcccagccaacatggtgaaaccccgtttctaccaaaaaaaaaatacaaaaattagctgggcctggtggcgcacactactcaggaggctgggccgcaagaatcgttgagcccaggaggtggaggttgcagtgagctgagatcacaccactgcatgccagcccgggctagagagtgagactctgtctcaaaaaagaaaaaagaaaaagaaaaaaagaaattgtgctactcaccactcatctgcagccccctgaccatggctgtctccatcagtgccactgaagtggagacagccccgctgaaagcaggctcagttatcaaagggagcagaggctgggcgcggtggctcacgcctgtgatcccagcactttgggaggccgaggcgggtggatcacgaggtcacgagtttgagaccaacctgtctctagtaaaagtacaaaaataatctgggcatggtggcgtgcacctgtagtccgagctacacagaaggctgaagcaggagaattgcttgaacccaggaggcggagtttgtggtgaggcgagatcacgccactgcactttaacctgggcaacaaagcgagactccttctcaaaaaaaagaaaaaaaaaagcagaaactggttcagccttgtttagaagggcaatttggaaatttctaaggaaattctaaatgtgcaatatttaaaatgactcagcacttccatacgcacaaagataggggtaggggaatattccctgtgacactgtttgtggtaagaaaagacagactcgggcccagttccatcagggggaatctggctaaattacagaatttccgagtgctggaacactgcacagccatgagaaaataatggcactggttcagatgttagcattgtcctgagtgatttcggcaaaaagaactaacccagaatcaggggagatggcgtcttgtcaaacttttttatacaggtagagagtatagaactcataaaagctatttgtaaaatgataagtttattggattagaaatctaagaaccaaggccaggcgcggtggctcacacctgtaatcccagcactttgggaggctgaggtgggcggatcacctgaggtcgggagtttgagacaagcctgaccaacatggagaaaccccgtctctactaaaaatacaaaattagctgggtgtggtggcacatgtctgtgaacccagctactggggaggctgaggcaggagaatcacttgaacccgggaggcggaggttgtagtgagccaagatctcaccagcaacaagagcaaaactccgtctcaaaaaaaaagaaatctaagaaccaaatatatcagagaatgttaaatttcttgggtatgatgatgatattgtagttacatagggaaatatccttattcttaggagatacatgctgaaatatttagagctgaagtgccatgtcagcaacttactttcaaaaagttcattcagcaaaaagccgggtgcagtggctcacacctgtaatcccagcactttaaggcaagctgatcactttgaggtcaggagtttgagaccagcctggccaacatgatgaaaccctgtctctactaaaaatacaaaaattagccaggcatggtggcacacacctatagtcccagctattcaggaggctgaggcaggaggatcacttgaactcaggaagcagagggtgcagtgagccaagatcgcaccactgcactctagcctgggcaacagagcaagactcaatcttaaaaaaaaaaaaaaaaaaagatgttaggccaagcacagttcaagcctgtaatcccagcactttggaaggccaaggtgggaggatggcttgaagttacgagtttaagaccagccttggcaaccagcaagaccctgtctcttcaaaaaaaaatttttttaattagctaggtgtggtggtacatgcgtgtaatcccagctacttaggaggctgggcaggaggatcgtttgagcccaggagtttaaggctgcagtgagccatgattgtgccattgcactccagcctggacaacaaccatgtctctaaaaaaacaaaggagagagagaaaagaaaagatttttgaaagaagctaaagacttctaaaaaaaaagaaaaagaaaaagaaaagaaaaacgattaccaagcacttactaaagatgttagttacagggctgggcacagcagctcacgcctgtaattccagcactttgggaggccaaggcaggaaaattgcttgagcccaggagtgcaagaccagcctgggcaacacagtgagaccccacctctatttaacaaaatgaaatcaatcagtttcaaaagttagtctttatccctccataccttcagccagcccaaaccaggaatgggcagcttgacagcttcaggttgttgaaggcctggactcaacaaagctttgcgtagctagcggggctgttctgagcttggaagcgccgagcagtaacctctccctttcccgtgtctttgctctccagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcaca

SEQ ID NO: 11895 - DNA, 13115 bp, Human
agagagggatcctttaataaccgccaccaggtcccatccctcctcttcccacggctctccaggattcccacctcactcagagcaaaagcccaagtccagggccaggcgcagtggctcacacctgtaatccctgcactctgggaggtggaggcgggaggatcacctgatgtcaggatttcaagaccagtctggccaatatggtgaaacctgtctctactaaatatacaaaaattagccaggcgtggtgatgcgcacctgtaatcccagctactcaggaggcagaggcaggagaatcacttgaatccgggtggcagaggctgcagtcagccaacatcacatcactgcactccagcctgggcaacagagtgagactccatctcaaaaacaaacaaacagctgatcacggtggctcacgcctgtaatcccagcactttgggaggccgaggcgggcagatcatctgaggtcgggagttcaagaccagcctgaccaacatggagaaaccccgtctctactaaaactccaaaattagcggggcgtggtggcacgtgcctgtaatccagctactcgggaggctgaggcaggaatcacttgaacccaggatgcggtgagctgagattgtgccattgtactccagcctgggcaacaagagcgaaactccatctcaaaaaacaaaccaaccaaccaccaggtcccgtccctcctcctcccacagccttccagggctcctacctcactcagagcaaaatcccaagtcctccccaagacccacaagtccttgctggactggcctgcttcaccagctacagagttagcagggcccagtgcaaaagaaaactcaaaggccccttgttcaaaaatgattaggaatctcaaaatgcagcagtaaatattaacccaagcacaagccctgctgtggggtgggggggccctggacaaaagcacgaagcccccggccctgcctccctccggccttcctgacctccccccgggcactctgctgccaggcacagtcctgccccagggcctttgcacctgttggtcctgcctctgactacctctgtaccccatccccctgttctccctccttcttcaggtcgctttaggggtggaggaagccgtctctgatcctccctcccacctctttaactttgcaccttcctaccctgccattctcccggctggtttttctgcagaactgtccccaccatctgacctgccaggaattcagcttgtgaatttgtctctgtctgtctccaggcaccaccaccagggcagggacccacccccgccccgccccaccccagggccctggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccgggtaggagagggtggcgggggccgctgcccggggcgggggcgggccgggcccaaggtcaccgcggcgggcgggccacggggaggcgggccggcgtggggatccgcaggcctccccgggcgcgcgcgtcccccccctcggcggcgcgcacggggcacgggcggcggcaggtggagccgaagcctccgcagcagccgagccgcggccactgccggcgtcgccgccattagacaatagcggtggggccggggagcggggaggcgggcggcggggaggggcggggaggggcgccgggcgcgcaggaagcggggcccggggcgcgccggggccgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcggtaagcggggcccgtccggccggcgcccccaccccggatccgggccctacgcccccgacccccggctcccggccccgcgccccccaacccccaggcccggtgcctccggcccggcgccccccccaactccccggccctgtcttccctctccagctcccagcccggcgcgacccccctcccctcctgccgccggcccccggacaccccccctccagttcccgatccaccccagcttccgggccccgagcccccccgccgcagctcccggcttggcgccccccccccccaacccgccgggacagtcagggcctcggacggccttggcctcgggtctggggcgctccggaagccccgcgaggcacctctagcccggggatcctttgggggcctgtggtggggggggcgatccgaggcgcacccctcccggaagagcgtgtccccgaggaagggcgctgggaatctggggttgggcccccccggaagatttcgagcaccgagagagagacccctcccccaagaggactttgcagggaggaatcgctgccccccaacttggggagggggctccctagggcgcgtttctacccccctcggatgtgcactccctcccggcgctttggagggcggtagagggcgcaccctgccccccatctagggcgggccttaaaacgcacccccactgcctgggggtggcgggggacggggcggctccgggcgcacccacccgctcggcttcccccgggagaggcggggggcaggaagcgcgggtggggtcgcccagggggccgtaaacacgggcccaggaagtggggcaggagggggggcgccgcagctgcgcggccgctccctcctagccggcccttgaggggggtccagcccacgcctgggcctgacccgggccgccccatccctacagggctcctcgcacctaccccagcaactcaaattcaccacctcggactcctgcgaccgcatcaaagacgaatttcagctactgcaagctcagtaccacaggtgagctgggggactgggggtccctgcgtcccgagaatgtgagtccccccatttcttctgcgcagatggcaaggctgaggcctggagattgggaaaataatatatgctagactctgacctaatcacttgacaaatactgaattcatttattttaaacagccccattttgtagaggagaaaaccgaggcacaaaaatagttaaataatttgcccaaagattcagctgtgtggcttcagagcccctccctcctccccaatacccccaagtcccccattggataaaagaccttccaacaattggagttacggcacggactcgccatccctcaacccccaaaacagaaacattctgcagcctggtcatctctctctttgcccagttttggagaaagggttcccagcacccgtcagattctccaaggtgctgcttctttcagaaatctggcgtttctgaagagcttgccacgctgcggtatctaaggggaaggaactatttagtcctcttacacttaaagaaacttaagcccaggccaggcgtggtggctcatgcctgtaatcccagcactttgggaggccgaggaaggtggatcacttgaggtcaggagttcgagaccagcctggccaacatggtgaaaccccgtctctaccaaaaatacatagttagctgggtgtggtggcgggcgcctgtaatcccagctactcgggtggctgaggcaggaaacttgcttgaacccgtgaggcggaggttgcagtgagcagagatggagccactgctctccagcctgggtaacagggagactctgtctcaaaaaaaaaaaaaaaaaaaaaaaagaaagaaaaaaagaaacttaagcccagagatgttatgatgttatttcctcgggggtgtccatagcattgaggaagtggcaaggctgaggtttgcaccaggtctctctcctggtttaaggatataggttctcgcctgccctgctctggaggggcacgccgggcctgggaatctggagaaagtcaggctatgctcaaacccccgtttggccttggggccctctctaaactgaagcgtgcccaccccagaagtgttcctggaaggatcctggatttcctccaagtagaaaggggaatctcgattttgttgttgctgctgcaaatatcccacctttttgggtactccctgtgtgctcaagaccgttcgtgcctcctcgtgcttcatccttcctgtcgtccgactgtcgtacccattctcaagctgggcaaactgagacactgacagtcgaaggtgctggagtcagctttccatgcaggccccagaagcttttgtgcgggttcctcgatatgaagggttggataccgcctggtgagccccggggctgacctgattccacagggaagggatcagatggcggtcacagtgctgtgtgacctctgctaagccggaagccctctctgagctttggggtctccatccgctgggcctgggcttcctgctgtccaacgagggaccctaccatatcagaggcacacaccggatgttcgaggcgtaacagcccctgggtggccagaccatcctatttttcaagaaaggccagaaatgcaggctttggagtgaaacttcttttttattttattttatttttttgagacggagtcttgctctgtcgccaggctggagtgcagtggcgcgatctcggctcactgcaacctccacctttgggattcaagcgattcttctgtttcagcctcccaagtagctgggattacaggcgtgcaccaccacacccggctaatttttgtattttcggtagagacgggctttcgttatgttggccaggctggtctcaaactcctgacctcaagtgatccacccgccttggcctcccaaaatgctgggattacaggcgtgagccactgcacccagccccggtttttttttgtttttgtttttgtttttaatggtagcaacaaatgcacattttaaaagaaaactagagaaaaattggtggcggccaaagcatccctaacccggcacactcttctccggtggagcaaaatgccaggttcctggggtatcctaagatccatgtgcatttatgggatgcttactgtatgccaggtactgttctagaacttttcttgtctgaattcattgactcttctccaccccaccctgcgaggttgttagtggtacctcacagaggaggaaatgaagcccagagaggtagtggagtttgcctagagtcacacagcagggaagacgaagggctgagctttgaacccagtccgagagggggtggggatggcagaagcaggtaagccacagccaggtccgcagggcccctgtgctgggttggatttaagtaggttaaaggacacctcccccaccaccatcaccagttcttttcctggactgggaggccctcctgcctgctctcttccctccggccatgacgccctcatgggggctttgagaaacgccccacagctcatccttcccgggagggcctgtaggaagctctggtgtcagccacccggactggccaggtggagtgggagaaatggtgtgttttgtcccagctaaagaaaaaaggctgttaggaaggactaagagggagctgaggggtctgcctgggaagtccaggccccccatgaagctagggtccccttgggaagtccagccgggagccgccttgcagccccagaccctctcagcctctttgtacgttctatttgggtctggaaaattttcccctgtggttgagagcttgggctgctgcttggctgtgtgaccttgagccagttcctcaccctctctgggtgtccactgtgtcatctataaaaggagcgtgacaatgacgttgcgggcctcgtcgggaccgtgagaggtgaaggctcgtgagactctcagagctagcgttaccgtgccccctctaacttctgttgttcctataatgttactataatgttgcttatttccccccaaccagatctgcaagggtggtttcatcacccccttcttacagtcaggggccctgatgctctcccctccccgcagcatcacagagagctcaactcttaccaacttccctgcccctcaattcaatgtcctcagcccctatgaaagtttacggcttcattggccaggcacggtgggtggctcatatctgtaaccccaagcactttgggaggccgaggaaggaggattgcttgagcccaggagtttttgagaccagcctgggcaacatagggagacccccgtctcaatttaaaaaaaaaattattgcttgaccctctgagaattggctgatcttgcccttacaggggacttggagcctcagtttcctcccctggataacggagggtggggggctcccgcccagccgccactaaccaccccatctcccccctgtgcctcctcagcctcaagctcgaatgtgacaagttggccagtgagaagtcagagatgcagcgtcactatgtgatggtaacgtcactccgcccccaggtccagtgttgggggcgggcgacagggccctccacatcccctccaccacgggcagctgctccctcaaccccggccacctcccctgggaagcgcgaggatcggggcctgttctccattcagccggcccctgctgggctgagcctgcctcgctagcctggcagatggccgaggcagtggccgaggtgccaaaccgccgggttgcagaccggccctgccaggtcccccggctgtccttggcagcggaggagggaggagagggaggctcaccggctgtgaaagccaacagccaggaactgacgtgggggagcagccgagtccctccccaccgccaaggtcccagcgtccacacgcttaacccctttgggcccgagctcaaagaagaagcctgtgggagggggtctgagccctacccatttcggggggctgaggtgtgacactgcattgctgctgccagaaccacttgctcggttttgtaactgccaggtgacgatttctgcatcaaaaatcccctcccttacccacccttggcctggccctcgagcagcgatgctggggtctcagcccagtacccaaatctcccagactgtgggggaggcagagccagaccctgaccctcccagccagaagaatagggctggggtcagagagagggacctaggacctgcctgaggaagactatatggagaaatggggcacacagctggggtcttgcaggatgagtaggagttcaccagacagagacagagaaactacgtgaaggcctgggaatgaacttggttttcccccaggggtgacagggagccatgggagggtttagagcaggggaggggcagggtgagatctggggcttggggtgggggtagctgctggccccagagccagcaggctttgtttacccctcactgtttatacctaggcaggcaaacttccctggcgtctgggcccacccgcagacaagacatagaaagatacaagattaggagccctggaatgcgtgttctcgcggtgcacatggagtgggggaggagccaggccagggctagggacctaaagtgcccccagtctccatccgcagccccagcggccccctgcccctctccagggcgggctgggatgctgggtgtgggcgtctctccctcctctttccctcccacctgcctctcctttctttcctgccctcagctgtctcttgctgtctcccccctttgtctgtctctgccactcccctatctctttgtctccgtgtccccccatccttccccacccccatctcccgctccccctctctctcccccatacagtactacgagatgtcctacggcttgaacatcgagatgcacaaacaggtacgcccatctcctcctcctcctcctcctcctcctccttccccctcctccccccacctccagccccgccttgggcacccccaggcaggtagcggccggccctcggctgggcaccaagccagcccggttatcctgttacctcctaagccctccccaagctcccgctctcctcccccccgccccgcctctttttcaggcctccctgggagtgtttctcccggtggtggggaggggcagagaccttccccacagcctacggcccccagccctccctacattcgcacaagcgcttactacctgccaggggcctgagtggccgacccccgaggaatgtgcagtctggcctcatcctgcacttacctcactctaagctgcaggcgacagccggtgtccagccccacctttgccactgactggctgccctcgggcccgaacacggctttgctcatcccaccctggccagacctagcccctcttagaagccgcaagtggcagggctgggccgggccccgcgcaggcctcctgtggctagcctgcacctgccacccgcccaggactgaagccggcttcatctgtgtgttccaggctgagatcgtcaaaaggctgaacgggatttgtgcccaggtcctgccctacctctcccaagaggtaagagccagggccttggggaggggttgtgagggggccccgcacttgcccagcccctgtccactgcagccatcttgggtggtgtgctgggcgccccagggcacacgcctcccctctctggacctccctggctctgaacaccagagccggcctgtgcagaagaatccccgggccagagacactccaggggtgcaggcgtgtggggggcgggcctcaccctgctctggaattcccagctggagtgagtcatgtcataggtagaaatgtcagatgggcctaaactgcaccaggaatgtttttttctcatctctcttcctcctttcaccctcttgagacatcctcctccaggccatgcgggctgcacaggaccaaggactagagggtgttaggggattgtgggggaaggggtagcacagggtggtcacacatggacacagccacacagataggcacgagcacatcaacacacgggagatacacagatgcagacacggatacacgtgtgtgcagacagcacagggacacgcatgcaggaatgtgcagctacacgtgggcacacgtgatcctgagcacacattaccacatgcacacacacacccagatgaacctgacgcccagctcctcttctcctttcttgggttctgaggctcaggatgcgaggccgcccctccccagggccatgtaaggcccatctcctgtccctgccaagtttactgtcaaaagtttgtaacttcctcttcaatccctgtgggtatctcaggatcctttgggtgccctgctttgcccagggacaagtcttagcaggacccaatgaaagccctagagaaaagggcacttggagcccttcagaacagaggcttcctggtagccaaggcaaaaagggagattggtagattctagcatctgctggccacagagtcaggtgtttggggagagctcagggaggaactgccctgaatctgagcccattccccagccagccctgccagaattcattgggccctccccagccatggtaggagaagggctcaatttggccagactcagggcacagtcttggagctcctaggatcaggacgtccctgtacagttgggcaggttgtgtactgcacaaacattcacatgtttcacatctttgcaggtggctgtgcacataggataggtcaggatccagggtttctcccgggctcactcaaaagctgtttcctaactacttagcacaaaacccttttaattgttttctgcacttttccatttgtctctgttggccagacgaagagacgagcttggtgaaaggaagcagttggagagagggagggtgctttctgatggggttgaaaaccactgggaggagcagacatgatggcccacttggtagtggggctcctcctggcctcagggccgtccccctctcctctcccaggatcaggaggaatcactgcctctcctctcccccgacccccttccagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcggtgctgtgtccctgcctctgtgttgtggctgcccccgggggaggacgggttccttccaatgtgagacatcctcctagaacatcaggagttcctagctgtggcccggtgcggtgtggctcacgcctgtcatcccaacactttgggaggctgaggcaggcagatcacttgaggccaggagttcgagaccagcctggccaacatggtgaaaccctgtctgtactaaaaatacaaaaaagctgggcgtggtggtgggcaactgtgatcccagctacttaggaggctgaggcagaagaatcacttgaattcaaggaggttgcggtgagctgagatcgcaccactgcactccagcctgggcaacaagagcaaaactccatctcaaaaaaaaaaaaaatacaaaaagtagccgggcatggtggcgtgcacctgtaattccagctgcttaggaggctgggacacaagaattgcttgaacccgggaggcagaggttgcagtgagctgagatgatgcctctgcacttcagcctgggcgacagaacaagacgctgtctcaaaaaaaaagagttggtgggtcacgcttctgcatttggcctacactgctctgatgcctagcccagagagggtgagctgaagacttcaggtcacacagcatggcccaggtggttgatgtttagacaggcagttaagggggcttaaaaaggcgaagggatccctaagctagtaagtggggaggctgaggtgggaggattgcctgaggccgggagtgcaaggacaacctgagcaacatagcaagaccccatctcctaaaaaaaaatttttttttaataataaaataagtgagtcagtggcagagctgatttctgcacccgagatctgaagacctaaaggacattctcttcccttagagaaagaggaggccccagtgcccacacaggtacacttcttttcggttctgggtgggttttttttgtttgtttgtttgtttttttgagacagggtctcactctgttgcccaggctagagtgcagtggtgtgatcacagctcactgcagcctcaacttccctgagctaaagtgatcctcccacctcagcctcagcctcctgagctgggacagtgggcatgcaccaccatactcgcctaatcttttgtatatatatgtgtatgtatatatatatatatatatatatatatatatatatatatatataattttttttttttttttttttgtagaaatgaggtttcaccatgttacccaggtctcaaactcctgggctcaagcagtcctcccgcctcagcctcccaaagtgctgggattacaggcgtgagcccccgtgcctggccagtatactcagagagaacactgactcgccccagctgagcctccatcctctaaggaacagccagaagccccccaacccccaccgcctcacccaagctgcaccagccgtggggaagccagaaggaaaggggattgcccccagttttcccatcttggcctcagcccctggctcctctgggacttgggccaagggaacatgttgctgcccacccagcaaatgggagatggccatttctactctggagggacttcacggcaggaggaagtccgagctgaggggagctgacaagggtggagatggacagccgacattggggaaaatgtctcatgtccctgaggagagggctgggagtggaggggacagggctggctgatcacaccagcctcctggcaggtcccaccccatct

SEQ ID NO: 11896 - DNA, 35646 bp, Human
ttgatttaaagtttcttttaaaaatggatatattcagacaaacatgatgtgattgtaaacacattagcctttatctatctctcaagatttttctgggataatccagttagaaatattctatcatgttatgatatgctagataaatgtgtcagattattattttagggaaaaaagttattgtagatagtttcctactatgctaaaaagcttaaacagaaagagaacaatctatgaaaataggaaatttatgaacagaaacagccaactggcacccatgtttgggactcacatgcaaatcaagttattccttgctttccaacacttcccaaattcttttaaaaccatatatgaagctggatagcaactctatatgaagacatcagtgctataaatacagacagcattgtgttgggtagagcaatgccaggaattgccaggaccaacagataaaaccagagcaattaagtttccataaacacttgacttgatgttgaatcaacactctcctttataaacagcagtttagcaagaaataaatgacaattatacatttctaatatataaaccatgctggtttggtgaagtaatagcattcttttgcagctttctttttacaatgtagtttgttggagaaagttgctcaataatttggaagtgttaatttcaagatcatgtaaaattctttaaagccaattaaagttaagctaaagataattcatcttatctatgaaagagtttacagataagcttttctatgtttttagattaacaccatctccctcaaccaaaagagaaattcttctaggtataggtgagcaatttttagtgatgtttagttctcctttcctgcagatggttttctggacattcattatatactttagcaagaccagaaagttctatcttaagagactctgatctttcttttaatttttatttcctaaccctcaccccagaactaacacaaaataacttatgactacacaattcttaccttatttttactctttccttttagatattcaattgccctttcttaagcaagatacaagaaaaatattttttattaaataataatgtattctttcttacaaagaacaaagacttaattcataattttaaaaagaggccagcaagctatgacttcaatataagcgaccatgcactcacatatacaaacatttcccaacttttcagaataataagacaattcaaaaacatctgattacacctagtttcagagtaaattttctattctcatatgtgatttctgtctgtgtgatatttctttctttgttctaagtgtcctgtgatatttctcatcatgtgactcaaatgatttctggaatttttagtgttttacaatttagtgttcagtatttctagacctctcaaggtagttagttgcttccacattgtttctggacaaatctctattagaattctcccaaattgcagaagttttccttttaaccaggaaggtcttaggaaaatggactacttatcttttcattcccagagcctctccaagtatgtgacacattatagaacagttaccaaactccataagattgtgtagtttatatgtttggtgattctatgtatcctcagcatctagaagagagcataaatcatcttaagacctcaataaataattactgaatgaatttaataaagttgagaagtttctggaccagcaagtcattttcccttacagtgacctttgttatctgattgtggctctgctgaatcatgcaactaatctttgcagttagttcccagggtaaaagtttaaaattggtgagttccattgatgatgttgccttggttacaaactagaaatgtccccataatcatgatttgtaatcttcacagactctagatttgttctgattatcatgtattcatgcctggtgtccaccgtaaatcccttgatctgttataggcatttaccttgtactgactacctcattgaacaaatctcccctgtggactgtcatttaaaagcacaaatacactacatagagaaaggcttggttcttatcaggacacaaatttaaaggctgtgtggacttgggtaagttatataatatctttgtcagtttctttatttgaaaataagattcataagtgactacccaaaagcattgttataatgttaaatgagattacatgcaaagttttattctaatgctattgttatctaaaagtaaatgttagttatctccatgcttttaataaaggtgtttataagctgatatactatccaaatataaagtaatattacatgttgagttcattctcatgaacttcttggggagggcttagaagaaacattttttcacgtagggacaattaccatagggttatatagatctgaaaatgacaacgtaggcatcttttatttcacaaaatattgaaaatgctgccaaaagaattagccagtaataaggggccatagtcaaacaggtagtggtcctctgtcacttttataacttgacattttgttttcgggagttgctagacatttaatggataatggcgattaaagatttattttacagactgtaaggcagcctctatcagaaccaagacagcatgaaggagaaattgagaactagtgatgggccccagcgggcaggattttaagctgtccaaacttctttctgcagtctttccatctgccagtctccacccttgtttcaagtctccagggtcttcatgctaggtcttggacttgtaaattacacaacttttgtgccccacctcagccctcctcaacttccctttgggcccttcctgctccctcactccctttccagtttctatctcaatcccattaatgctttgtactctctgaattattctctccaaaactgcttatggaaatcttacctttagtaatatataccaaagcaaccaccaaccaccttccttttgttttcacaaagaccttttacatataatgcaatggatcaaattgactataatgagagaaaatcattagacaagagaatttggaagaaatatggctgcacacttcaaataatatcagataatcatcaaatagctggtatttatgtcttacaaatatgatagtttgcacatttagatttgtaaaaataagatggtactcacatttaaatctataactcaagggaaaacaatttttgtttttagtggaaggtagttatcagaatccttatcttttctctattagatattccattgacctcatctcttttataaaaatgatcatcctttccccactcaattgcatttgagactttgtcataaatcagatgactatgtatgtgaatttgtttctgtattacataatatgccattggtccatttatctgtatttgtgttactagtactctgtcttaatgacttcagcattatagtgagttttaatacttggtattgtaaatcctacagctttgttctccaatattttttcaatgttaaatctatcttatagaagaaaatgcctttatgactcattacttttggataaccaaaatttcttaaatagaacacacacatgccaacacatgcataagcactaacataagaaaataaaaattagctagatttatttgaattagaaacttttgtttaacaaaagctacaactaagatagttcaaataataagccacagactaagggaaggtattcgtaaaacatttgacaattgccctatcaagaacatgtaaagaattcatacaagcgaataagaaaaagagccaacctaattacaaccatggaaaaaacattcaacagagattacagaaaagatgggatcaaagtggctgataagcacatgtaaataagctcaatatcttgttattaaacaaatataaattaaaaactgcaatgaaatagtattacacaaacataatagattaaaattgaaaaaagctgagaatacaaataataggtgagggtatgaagctgatggaagtatgatttgataaaactcatttggaaaaatatttgacaatacctaccaaaggaagacatgtgtataccatacagcccaataatcccactctggggtatatatccaaacacatacacacacacacacacacacacacacacacacacacacacagtgaatagcaacagtgtttactaaaagaggtacagagaaaatgttcatagttttatttataatagttccaaactgaaaataatcaaaattcttataaataatagaatgattaaattaattatactgtgtgtataccatggaatactctgcagttattaacaaatcaaacttcttcacatgcaacgtggttgaatctcataagtataataatgagtagtgaaaaaggttagacattaaaaatagatatttcacttattcaaagtttaaaaactgataaaactaatcctagttatatcaagataggttttactcttgagggcttcagactgaaaggggtgcaagtgaccttcctgggtgttggaaatcatctatatattgcttttggtagtggttacactagcatatacatagttgtaaatcaatcaaactatacacttaagacttgcatgctgtgttatatgtaagttatacctcagtaacttttttaaacaaataacagattcactgaggtgaggaagattaaaaagaagatgtatttcttgtagagttcatgttaattctttgtagagttaattctttggttaaggcaaggaagggactgttcttcatgtaagtgctttctgagaaggtcatggtctaacaattgattctatgagagtgcattccccagggcatgccatagggcagtacccagttgtcctcagtcttttccctcatctttgatctttcctctcacaaaatattaacttttagttgtttatgatttacaaatttgtcaacaagaaacacaatctgaaactaaagggtaaagaaatacatttaaataatgtatcaagttgctggtattattatctggaaatattttaagagtattggcttaagattgccatctgtgtataaaataattgtgttaagaaggaattgatgctaaagccaatgaagtaatgcttcttcttcttctgtaatacttctgttcagaagagctacctttacctaagttcaagcagctatgtaattccttggttgaaatggcctacttagttcctagatttgcaatcttccaggtggtagagaataatttatcctattggaacattgggataagataagtcccagaggttggactagggcttagtatctcagtctggatctacagggtcttttaccctgggcccatttatattttcaccctcacaaactctgttccagctctgagccatgctctacaattctaatctttaggtctgcatctttcttacatcagcaggatttgctatttgccaaatgctctatttcctgcagttttccatcccttcggctttacctgattttgacccatatgtccgggaattatcccaaggcccaaaatctgtactattataattctggggcaacagagataccttcataatttcctgtattcaatcctcattctgaaatgcttaatttacttctgatgttgaattattaacttttaccctcatattttgactcagtcaccccaagtgactattttagacctcaagcaaaaaaaaatgaccctccagttttgttttgtttttttttttgtagcttcttttctctgagaaggtgtaactttgagtgtacgcattttacctattcattgacctcaagccaaagcatggactgaaaaatctaaggtcctttcttagcagtttcccttagcatagttgccctaaactttgatcaaccagaattcattggatatgccaacatgcaaagtaaccataatcccaggtgataccgattatcccataatcattctcaagagatcataataagttttcttctggatgcttttaatacttgcacagaaaataagttctgggattaatttacctagatttagcattatatcaaatatcttatatcataaaacaatgaattttttcacacacttttgacaaaaaaaactatatgtaaaatatgcagattgtgtgtgtgtatatatatatttttctaataatatcagtaatattatgtattttcagaagtcttctattagaattaattagagcccataatttttgtgtccttttcaatttctttcataagagtttttcagttttccttgtagaagtttttcacctctttggtaaaatttatctttacgtattttctttgaaacactactgatttttgcatgttgattttatatcttgcaaagttatttaacttacttatcagatctaagaatttggtggagtctttaggttttctagacataagatcatatcatctgcaaagagtgacaatttgcctttctctttcccaatttgaatgccttttatttctttctctcaagtgatttctctggctagaacttcccagcactatgttaaataagagtgctgaacatgggcaatgttgtcttgttataggccttagagaaaagacattcagcttttctccatttagtgtgatgttagatgtggatttgtcatatatggcctttattatgttgagttatgttatttttttttttatggagtcttgctctgttgtccaggcttgagcgcaatggcatgatcttggctaactgtgacctctgcctcctgggttcaagtgattctcccacctcaacctcctgagtagctaggactataggtgcgtgccaccatgccttgctaatattttgtatttttagtagagacgaggtttcaccatgttgcacaggctggtcttgaattcatgacctcaagtgatttgcccacctcggcctcccaaagtgctggaactacaggcgtgagttaccgtgcctggccgagctaggttctttcaattcttagtttgttgagagttttttgtcaggaagagatgttaaattttatcaaatgcttttaaggagtctgttgagattaccatatggttcttttcctttattttgttaatgtgatatgtcacatttattgatttgcatatgttgaaccatccttgcatccctgctataaatcccactgctataatgatcatggtgcattatatcttacatgtgctgttggatttggtttgttagtatttttttaaggaactttgcatctatgttcatcagggatattggcctatagatttcttctttgttgcatccttgtctggttttggtatcagagtaatggcagccttttagaatgaattagggcaactttactttccttgaatttttttggaattgtttgagaagaataggtgttagttcatctttgaagattcggtagaattcagcagtgaaatcatctgatcctggacttttcttattggtagagtttttattataattcagtgtcattattcattattggtcagctctggtttctatttctttctgattcaatcttggtaggttgtatgtctccaggaatttattcattttctctaaaattttcagttgttagtatatagttatccatgattgtcttgtggtcttctgtatttctctagtgacaattgtaatatcttttgtttttctgattttgtttatttgggtcttctcttttttatcttggttactcggcctattggtcttgtttatattttcaaaaaatcaacatttttttatcctttgtatattttttaaagtctctattttgtctagttctgctctaaactttgtgatttcttctgcccgttttgggtttgatttgtccttattttcatttagttcttgagatgcattattagattgtttatttaaaatctttcttttgtttgaggtagttgtttgtcagtataaacttgccttttagcacagcttttgctgtatccccataggttttggtatgctgtgtttcaatttttatttgtttaaaaaattgtttgatttactccttaatttcttccttgacccagtggtcattcaggagtctgttgtttaagttccacattttttacagtttccaaatttcctcttgttattgatttctagttttatttcactgtagttagagaagatacttgacatcatttcaatttttaaaaacttgttgagacttgttttgttttgtaacatatggtccatcctagagaatgtttcatgtgctgatgagaggaatgtgcactttgtagctgttggataaaatgttctataaatgtctgttaggttcctttggtttaatatccaacttaaatccaatgtttctttgttaatttctatatagatgatctgtctaatgctgagagtggggtgttgaagtccccactattatagcattggagtttgtctctccctttagatataataatatttgctttatatatctaggtgctccattgttgggtgcatacatttagaattgttacattctcttgctgaattgatccctttttcattacataatgaccttctttgtctgcttttgctgttttgaacttaaagtctgttttatcttatagctataagataaactatagctattcctgcttggttttggtttccatttgcatgaagtatcttttgatatccctttgctttcagtctatatctatctttacaggtgagatgactttcttatagacagaatacagttgggtcatattttaatccattcagccactctgtattttttaaattgaaaatttaatccatttacattcaatgttattattgatatgtcattttgttagttgatttctggctgttttgcatattttttgtttcctttttctcttattgtttatcatggtggttaggtagttttatgtagtgataacatttgagtttttgctcttccttatttgtgtttgctctaccagtgggtttaatacttttgtgtgttttcatgatggtagatatcttttcacttccatgtgtagggctcctttaagcattactggtaaggccagtctaatggtagtaaattcccttagcttttgcttgtctggaaaaaactttttttttaatctttcatttatgaagaataactttcttcgttatagtatccataggtggatgtttcttttttttttttttctttcagcacttgttaaatatatcatctctggcagcagcagctaggtgcagcagacacttcaggtgggaaatgtcaatgtggctccagagatgtggatatgcaaggactgctggggccctgtgcaggatgcagcctggttgggaataggctctcaataaaggacgcttctgtagctgcctagcactcaagggtgtgtgaaacccgtgggacccaccgtgaactctcctctggaactgtgcctttgggcaggctccaggcaactctttggtagcctcgaggggtctgtgagagtctagaagcatcccaatggctaggaagcagaagtccacgatgaaaatgtgcatcagtgggggtcactcacttaccctttccatgtgttaaggagcctttccaggctcccagtcagtcccaactgagcagactgccttgtttttctctccttttttgctttaggtgtttcatgtcacttatctgttgaatactagatggtctatttgaagtttaattatctactccttattttggttcttctttgtggagaaggcaagtgccagatgcctagtcagctatctttcttgaagcccctcccctcagaatctcccttttatttaccttttttgtttcagttacctcagggttaatattatctgctttactagattttttgagcattagaaagagaaagggacatttcatcatctgtgtcaccatattacgataaatcttgaaatgtgaggctatgtgaacatttggagggagaaagaaaggaaaggaaatagatgaaaaagagtgataaaggtgagattgtttacatgtgtatgttctctgaaagaattgatttagagagttcttctcatattgagcatgtctggcagtcagcaggggaaacgtgagagcaatggtaaactacatcattgggtgaaaaagcatgattaattgtctgccctgtattattctgcacaaatttgttaacttgctctttaaaagtgcttgcttttgtaaaatgagaaccaaactgttagccttttttgcttctcacacagcaggattaattcagaaataaacttggcagatggtgaaaagaaggtgccaaccaaattcaataatctatacttattaatatcctagagttagctagctatattaactaaaaataaaagagaaggtacattagctctgatttgtctgactcataatgacaaccatgcttagcaaagtgatcagatattatggaatatcgctaagtcacttacataaattagtagtagcaagttactcctcttctttgtagctgacggagagtttaaatagaatctttctgtgttcttatattagtttcctcttgctactataacaagttatcataaattgaatgttctaaaataaatacaggtttattatcctactgttctggaggtcagaaattcaaataggtcttcctaggctaaaatcagaatgtcaacagggaaactctatggggagaatctgtttccttaccttttcctgcttccagaggctatccatattccttagcttggagtatcttcctctgttttcaaattcagcatgactggtcaagtctgtctcatgctcatcactgacattgactcttttgacttcctcttcaacattaaatactcttgtgattacattgggtccacctaggtattccaggataatctccctactttaatgttagctgattagaagtttgaattccatctgctaccttaattcccttgtgtcatacaatatgacatattcaaaggtccagggattaaaacaatttatatttttgagattctactattcttcaaacaacagtcctgcctttctatctggatcccaatgactaacacattaaaccttgttcggatcctaaaggtttcttttaggaaaaaaaatgcaaacacatgtaaaagtggtttaaatagtttattaccagatgttatcccatgaattgagaataatctaaaattgtgttatttttctttcagggatggaaattaaacacctcttgtttttggttgctgctgcttgcttactgcctatgttgtccatgaaagtatgtgagggttggatgtttcataattactttctaaataaagataagagctaacactttaatacaattcaccatgttagaggcactgttgtgaggccactacacccattactcactttgttttcacaatagccctgttaggcaagtactcatcttaataccattttataaaggagagaaccaaagaatagtaaagttgagtaatatggccaatatctgaggactaggacatggcagggcctgaaattatacttaatcagttagctctgtgggtccatatctatttcattgtggcctctctgaataacacaggaaaaaaactgagaatgcagattagctatataattttttactataacaagaatttaaagcatcaaaattaaatataaaatggaaaggtgccaacagcacaaagagcaacgtgaggagctgattagcagtttgaattccattggctaccttaatctcactaataattaaaaacaataatctcactaataattaaaaacaataactttaacagtcacaaaacagaagtagaacactcaatgatataatattttatgatcagccaataatattcacctttaaataacttcaatgatataaagaaaataatatatattttaatttaccccaaattttgtgacaaactgaagtaaataactttggtatagaaaatgagtggtttttatattttcgtaggccaggtagagaagtaagaaataaaaggcacttagttttattgtggaaagaaaatccatatgcattaggctattagggtgttggtttggtatttggttcctattactcactcttcttccccagagagagactaggtggagctcctgtttaatgcccagtaatcctccagtaagctggaattagcgtcctgaattagagtcctgaataagacttcttccttccctctgattctctgaccattttacttccccagtgaggaagggtgaccttcatgcttcataataaggaaaaagctaacctgaagtatagccaccattccagaggaatgggaaaagggcaaacagtcagaaacctatatttgccatcaagacctagtactaggctgtttagaccacttaggccaagttctgggaaacagcctggcccagattgtcatgtgaaagaagaaattagtatcactagttaaaagtccagagcaaagagcagataagtagaaccctacccgtccaagggaaaccatacccaatccgcttttgaccaagaatacaaaagaaaaagtagaaggcattgataaaacaataggttgatgctctataacagagaattattagaatattttcatacattttatagatagtttggtcataaaataaaggcttaagaattttaaatttaaacaagaagataaatttaacccccaacacaaatttattacataaactttaaacatgagtctgagttaaagtaaataatgtgttccaatttgccaacaaaagtagtattatgctttcttttttcagactccaggtagaaagcaaatagactaaccaccagacctgaatcatattttaaacttccaccagtggcagtgttttttgggatattagatgtctaatttaacaaaaattgtttttactttttatataggtagttttccatgacaatctggtagatgttacacaaaaagtttttttgaggaaaactatagagagttgtgatcaggtaacaggcaggctgaatcgtctctgagttaattagagacttatctgagcacacggtatacctgcaatctgaagaataagttggctttgcaagttaacaaggtgtactatcaaaggtacaggcatgggcaaatattctatggcaggaaggaaactggcacattcagataaccaaaaaaaaaaaaatcagagataaggacacatatcctaaatagaggctgagaataaacagagtattcaaaggccttgttaaagattttagttcctctttttatgaatggtaaactgttgaagacttctaacagtaaagtgaatccattgtgtctgtgttttaaaatttttactccgaatgatgattggagaatgcattatgaaagaatggatcacggagtgggagagaggctatagacatagtaaagcattagtggattctgggaggccagttgaaagctagacagtagccacaatcagtccaggtgaaagaagcaaagaaaggaaagagaaaaataaagagtgtgtttgttccttacaccaaaagaaagagtatttctacactgaaagtttagtcaaaagagtcagctgccaataaaccaagcagaataaagtcattaaaacaatattgcatatgcaaattgagcttgtcagggattttaataggagtatttttaatgtagggtttcccaacttcaaccttattgccattttgtatgggataattatttgttgtggtgagggctgttctgggccttgcaggaatttagcagcagcatccttgccctctattcacaaaatggcaggagcactctccccctatcatgcccatcacgacaacctcaaatttccccagacattgcctaatgcctaagcagcagggcaggtggatcacctagaatagagaacatattattgaaaaaaatggagggaggtaaatgcgaggctctattacttgggcaactgtagacagccagagttggcgatattttccagaatattgatagggaaagagagtagagacagagaacaatagttgaatggggaagtgatgtaaatgaaatgatggttgcttgtttatctgttttaagaaataagcagcatgtagccagtaatggtggtgcacacctgtaatcctagctactggggggctgaggcaggagaatcgcttgagcctgggaagtagaggctgcagtgagccaagatcgtgctactgcactccagcctggcagcagagtgagacttcttctcaaaaaaagagatataagctgcataatcataaataaacactgctgggaagggccaaaaagaaagagtggctgacagcaaacaaaatgaaaagtaaataatgtaagatttgggggaatggtagaagagaatggactaaataacactgttggagaattgagccttagaaagattagaaagaatgacccattcacttgtaccacagaagaggaggaaagaaaggggacagatacaggtagattgacagactgggtgagacagttgaagcagctgccctctgatggcttctctttactgagggaagaaggatatttcacattctgttgagagaaggtggttgtgaatgggggagattgcaaaagttctacaataatgtggagagtgacagagtgagttaatcaaacaattcattagaattgattagcagagttaaggaactatttgaggtcaatcttactgatttggggtcatgcagatatgtgttgttttgttttgtgagacatttttctggcaatgctcagctgatagaacaggcaggagaattgtcagtctcatccgaagttgggatgttttaggtaggcatttctagatgatggtgtgcagacaaaagattcaatattgcaaaaggagagttgtgaaagtagagaacacagatagagatgaaaggaaagacaagagagggctagtagagaaaatgaagaatgagttagaaggctcgattatattaaagaacagtcagaatggctgatcgtggcaacttggaagaacaggaaattccaatcaggcagggaaatgcttgaccaggtgatttgggaggtatggtgttttgggatgatcatgagatatagtaggtgaccattaaagtgaggataaagaggactgaaggagaagtctaaaggaggaagattttaagggcctgagacatcaaagggttggattcatccatgtggatgttgaagtcctttgagttgacttcagaaatctgggtggaaaagatgaattcgtttcaggaaacccaatttccaggaatgagaggaagtaagaaaaaaatccatgataggatgttaaataaatgttcaggaatgaggtgtgagaggaaaatgtcatgagtttccctgcagcagagattttgagaggagcaaggagagttgtaatctggaaatagtatgtggaatcatgtgggtccgcagcctgtcctctagtccaaatcagcatgacttgcaatgtgagaaaaaagtgacatcatgtgagtatgtccacagagacagtctctagaggagtcttctgaattccatatttaagttttctccccttaccctaaactgttgatataaatgacagtgaatacttctatatattgtgtaagttatgatgctagatcgtattcattcataaattgtgctgatggtcatgtggtagttaaggaagcaacagacacccctcacattatagtacattagttctgccacattttttaaaaaaggtatgaagtacatgtgatatcacacacacacacacacacacacacacacacacacacacaaagattctctttatagcgattaatgctaacctaaatactttggtcatgtatttttcttcttagtgagtttcagaataaaaaataaataaatgaaaagaacggtcacaaattcaagattataggctgaatttgaattctatgttttactctctcacacatacacttgagagcattgatgttttctcatatgaacagtaagaagacatagaatttgtgttaataacacttgcaactttgtcctcaataatgaatctcttagtttgggttaccccagacacacacctctacacaagggttcaagtggaagtagtttatttgggaagcagagagtacagttgttgcagggtgggagatgtggagaataagccagagaagtaagtaacaggtgtgattttaagatatctccctttgtggatcttattgcccaataaaaagtgcttcaacatggtccaaagtatgaacctggaaaaaccctaataacaggataacaagtgcattattctgaagactaatgtgatgtcagcctgacgttgagaaatcctcaaaattagtactggagaaatggaatccaatataatgagacattataaattcaaaaatgctataaatcactgtttaatataaactataaatttgcattacctataggtctgcaaaatatatgtgacaaattccacttaaaagaagtaacactaattaatatttttctggtaacagaagaaatcagctagagaccaatttaataagctcgtcaccgacttgccaaatgtacaagaagagatcgttaatatacacaacgccctcaggagaagagtagttccaccagccagcaacatgctgaagatggtaagatcaaaaaatagcaacaaccatgattgcaataatagtaatggtgtttactgagttttattaagttctatgcactttcaaagtgctaaaagttttatcttcacaacaaatcttttacatagcagaagaaacagaggtccagagaaggtaagtaactttctgatgattatatggttagtcaatgacagagctcagccagtctagcttcattcctccacaccctaagacagtgcttctcaacctttaatgtactcaagaatcacctgaagaacttagtaaagcacactttcctgggtctcactctctgatatcctgattcatgaggtctgacctggagaccaccacaagctcccagctgatgctgatgctgccagtacacacgacaaatattgattaacaagttatccatgcatttcatagctgtcttcattgggcagtagtccagaggctaagacactcttcctagaattaaaatatccagatatctagttagttgatgtggccaggtaaataaatattggcaaatttatcccccagtttcattgcatcccataaataggaagagaaattatttcattataaacctgctatgctctgctacaagacaaatttagggaagtctcaggtgtttaggtgattaccctcacatttgttatccagcagtatcactcagtttcatgagcaccctcagcctgcttccttgaaccctggaccggcctgtagcaacaagggttagaaatagtgcaggctctggagggtgattctaaggagcacctttctcttgcaaatgatgaagaggatgaaacaaggaaatacataaatgattttgagatttatctcttaatcactttaaaatccaaaggggtatttgaactaaaaataaaaatcaatagctttcataggcattcctgcatggtgttgtagccaacatacatgtgtttattatttacaggcatttttctaataccttgttacattaactcacttccttctcccaataaaattgtcttcattttacatattatgacactgaacctaaggaaaattgagtagcttattcaaaatcttaaggactggggcccagattaaaatgcaagtgggccagatctgaggagctggagaagtagagtccaaattccttggttgccagatgagcaaataagtttacctaggaggtacaaacagagttaaagaaaagtaaaaaatatagcctccgatttcagattggagatgaaaggcaaatacagaaaaaacactggaaaaatacaagaatacatatattcaagtactaacacaaaaagatatgaaatatcaagaagacgataaaagtaagtgtaccagtaaaactgagaaatatttcaaaggaaatacgagagttcagctgctccacaaacaatgcataggacatgtataggattagaagtagcaacagcaaatttaaggaacaataggactgaagagttaaccacaattaccaggcagagattttctttaaaaaaaaaagtttctgaacacaatattagaacctaagtagagtcacttgttaaagctggaattcagagctttggtacgatcataaatacaaactttaattttaattttgaatatgtctcaaaaaaggagtatctcaccaacattaatcagaggtaatgtcctatacatcatcttcaaagtgcaaacatcctgctatattttaaccagataagttccagttccggtaagttttctttttttattttattttattattattatactttaagttttagggtacatgtgcacaatgtgcaggttagttacatatgtatacatgtgccatgctggtgtgctgcacccattaactcgtcatttagcattaggtatatcttctaatgctatccctccccctccccccaccccacaactgtccccagagtgtgatgttccccttcctgtgtccatgtgttctcattgttcaattcccacctatgagtgagaatatgcggtgtttggttttttgttcttagtagtgaatgccatggtattcccccagcccagagaggctatacactggtagatgtgttgtgtcctctctgcttatcagttagacatagccatgactaaaatatttttttttgtttgaaactatcaaaacctacaaaaccatggttttacccagtgctaggctaataagttatttaattcatctcacggtttagtaaattcatcaaccccaagggtaattctaaacattgaccacaagatggcagcaaatacatattataattaaactacatgctcaggacgacactgaaaatgagtgtcctccaaacagtctaaacagtagctgaatgatttacataaaaacttatagtaaaaacaaactctatgacttctgttggcaatctgttatatgcacatataagggtattcttttaaatggatgtatatgctgctgaacaccaggggttcagccaaggtctagttgcttgcagcacaaaaatgagtattgcccattgcctgggaagaaaggctttcatgagggtgatgtcagcctgactgtcaaatccctccctctccctaaccaaccaaagttaaaagtttatataggagggacagaaaacaagagggacaaggaagaggatttggtcaacaggcagcagctgtgtctccttgaccaggtgtggtgatcaggaaagcctcagttccctgctaccacctgcggggcccgatggtgggtttcctgacaaaggaactcagataagacaaatgttcataggctcagttctttgtaaaaattgggcagtttcatatacaccacaatgataggagactgttagggagatcatttatcacagagtgtcatacttacagatgcagaatttctccctttctgcattgggagaacagctgttacttagtcatacctgaccaaatgcttcaactcagcacagttgatgcacactgagagtcaagaacacatactctgaagccatcctaagtggattcaaattcttattttgtcagttatttatagtgtgaccccgaaaagttacttaacatctctgtgccttatttcccttatttacaaatggatataatattttttttttgtagagttgccatgaggttaaagtgagagaagatacacacagaattggtgacagattctggcatgtggtgttagcttttatttttgttattcataattttagatggaaatatgactctatacttgcttctaatcacagccagcatttattcaatacagaagatttgtcacatctcagttgtattccttggaatatcacatttgaacaaacctttgggcataaattacaggtaacagtttccagatggataaactgagattcaaagagataaaataacatgtctgagtttaaactacaaataaattactaagtaactctggtctgtttccctggaagcatttacttaaattctctactacatctgagagagaatctatctctgaatgtaattaccaagttttgaatttgtgaattcaagggccaacataataaattgaaattgttgtctttctctttctactagaacgtttaatagtaatctcattatttaaatttctagttgatacaattgaagatattatatctcgtggattattaaaaacaataaattagaatcttatgaaaatattaattggaacatgtgctttttttttctttccactacagagttggagtgaagaggctgcacaaaatgccagaattttttcaaagtattgtgatatgacagagagcaacccccttgagaggagacttccaagtaagtgtgtatctatatgacccgcctttggactaaaaaaaaaaaaaatagtaaaacagggattgttatgtaccctgatgaaagtaaattaagtcatctagatttcctcatttgcactgggtcatacaaggcagtgaattgtggactattacactgttttaactcattaatttttaaggtttatatctttaagttttcagattccaagttctggagttttcagattccaagttctgaccatcaggagaaatgaataaaaaatctcagtattgcagaagagtggagtgagcagctagaaacctaggtctccattctgtggagttactatagctactgaacaatagcaccatggggatctgcttagctttggaacgataatgcagttgagaaataagttatatgcagccctgctcagctgcccataagacaattttaggtgctcaaaaatgagcccatcttaaagcatataaattaggtaacttactgctagtttccaggaaataataaaaaaaaacattattgcttctgtgttacgctgtttttgtgttgctgtaaagaaatacctgagccttggtaatttattaagaagagatttcattagcttatgactctgcgggctgtacaggaagcatggcacccacatctacttggcttttggtgagaccttaggaagcttacaatcatggcagaaggtgaagggggagcaagtgtctcacatggtgagagagggagcaagagagagagagttggggggtgccacatacttttaaacaaccagatctcatgagaactcactcaccattatgaagacagcaccaagttctttgaggaatccactaccgtgaggtaaacgtctccggtcaggccccaccttcaacacggggattacatctcaacatgagatttggaggggacatccaaactatatcaccttcactcaggaataaacattatattttaacatgagaatctttttttaattaacatgttttaaaaatgctgattcacatttatatctacagattatttggaatcttagtccaatgctttttagcagtgaattagcaaagtggttcctgcctgccttaagaaaagacagatactcctgaataccatgttcaaccaaaagcccacaccatacatgaatggctaaataaacaaatgtttattcaacatctttgtattatgaacacctgtgtgtagcttcctttaagccatagaccctgttagcactcttatgcttctctgatttggtttcacctatctaaagcagcttggaagcagcagagactgaaatgttgatgatttgatttcaaaacttgttcatcacctactatcaacgtttcaccaaacttgagtaccacatgctcattcatcaatgagaaagattttcagtggggatacaacttattttactccctctcagaagatgttgtcaagatgatcagtgaaccattcataaaataaaaatgaggaaagtctccttgtatactatttcccatttgttcagagtatgacccagcccgttttctcatttcagataccttttgtggagaaaatatgcatatgacatcttatcctgtatcatggtcaagtgtaattggagtctggtacagtgagtctacaagtttcaaacatggagaatggacaacaacggatgatgacataactactgaccactacactcaggtaacctgtgtgctggcaaacacacacattgtttaagagataagcatgtgtgtggaaacgtaactaagaaacaactgaaaatcattctaccttcttatggcaatctttactcaatttactgagttcctcttataatttgaaatagaaggaagtgttctgttcaaaatacgacttagagaagatgcttaacctcttagtatccttctttactcactagatttttcaggaactcacaaaatcataagacatcaatctcatttgatattggtagtatttgtaaaagtgaaaataatggtaccttacaatacagagaaacccctgatttctaactttagttttattgtggtaagatatacatttaaaaaattaccattttaactattttaaatggtttcatgttcagcattaatgtggcatgaatgttcagtggcaataagtccactcaaatcgttgtgcaacgccatcgccagaatattttcattttcccaaaccgaaactctgtactcattaaacaataccttccattcctctccctacttccccagacctctggcaactaccactctactttctgtctctgtgaatttcactactcaaagtacctcataaatttggaaacatacaatatttgtccttttgtgtctgctttatttcactcagcatgatatattaaatccatgttcatccatgttgtagcatgtgtcagaattgtattcttttttttaaggctaaatgctatttcattgcatgtgtatatcaccttttgcttgtctgttctgatgggcatttgagttgtttccattttttttttttggctattgtgaataatactgctttaaatattggtgtgaaaatatctgtttgagtgcttgctttcaattgttttgggcatatgccaaggagaggaattactggatcatatgtgaatactgtgtttattatttgaaaaactggagtactattatattttctgttgcagctgcaccattttacgttcccaccagcaatttacaaaatttgcaatttcttcacatctttgctctattaatctgcttaggatgccataacaaaataccacagctgggtggattaaacaacagaactttattttcccacattttgtatcctagaagtctatgatcttaatagagcatagtttctagtgaaagctttctgcctgacaccttctcacaatgtcctaacatggcttctccccagtgcaaaagaggagccagagagagtcaaggatagagacagagacaagagagaccataagagcaagctgtctagcatctgttcatgtaaggacacaaatcctactggaacagggcccaagtcgtatgactttatttaatcttaattatttccttagaaactctattttcagatacagctacactggatggaagttagaggtacagaatacgaattttgggggaagaattcagctcataacattgtaccattgcccctccccaacaaatttattttttcctcacatgcaaaatagattcgttccatcccaagagccctcaaattcttaatttattccagtatcaactctaaagtctaaggcccaaagtcttacctaaatattatctaaatgcatgagattcaagatgtgattcatccagaggtaaaatttctcgccaggagtgaacctatgaaacaaaaaatgttatatgcttccatagtacaacagaaagacaggcataggatagacattctcatttcgaaagagagaaatagaaaaggaagcagcaatgggtcccaggcaaatccaaaaccaggcaaaagaaatttcatgtgatagtaaggcttgagaataattctctttggtttgatgctctgcactcttggccaacttggaggcagcatcacccatggctctgtgggcagccttttccctttagctcagtgaggcagcctcttccctttagctcagtgaggcagcctcatcaaatgactctcagaagaggccctgctaacatggctgttttcagagatcatctgcagggacaacactgtttgaagctaagcaggaagcagccttgctccctggacctgtagtgggcatgggagccctcatgatctctgaaacatttggggagtcattcttcccttttcttgaaagataaagcatgtttgaagtgaaatatctctatcatgtcattctgaagagtctaagaagtcggacagccttccttcacttgggtctgttttctctgtccactttagttcaaactggcagtacctccactgcataatcacacctctatttctgctgagatgtatgattaaatccataaatcatatccatggtgtctttatctaatggttgttcagcgacatccttaggattctcttttgaaaatactttctcattttctgcaatatagatgggctaatgattgtgtaaatcttcaagttctggttcttccttgcataaagatttcttcaattgcttgctctcctcttgtaggttactataagtgatgaggagaaaccaaaccactccttcaatcctttgctctgaaatctcctcagctaaatttctatgtttgttattcacaacttctgccttccacaaaacactagaagacaaggcagcagccattttgtttgctactttgtaacaaagattacctttcttccaatttccaagaacatgtccctcatttatatctgagaccacaacaaaatagactttaatgcccttatttctatcaacactcccctcaaggcaatctacactttttatagcatgcacttaagaacttccagtctctacccattatccaattccaaggctgcttccacatttttaggtatttgttgaagcagcatctcagttcttgataccaaaatctgttttagtgtgctcagtctaccataacaaaatatcacattcctgaatgacttaaaccacagaagtttattttattgaattcacaaaggctggaagtccaagattagagtgccagcatagttagtttcttgagaggattctccttctggcttaaagactgcttcctttcactatgttctcacatgtgcccattggtaagttacacaaaatctaaaataaaatccacttgaaataaagcctacttaaatttgatgttaaaagccaatgaagataaagcatataaaaaagaggcataatcacagaaattaatgcagaaatcctaaataaaacactagtaaatagcattttcttttaagattgatacacttagacacaaagggtatgtggcaggaatccaggagtatcttaacattaaactaatcatataatttaccttatcaaaggattaaaggataaaaatacaataaatatctagaaagctaaaaatctaagaaatttgtggcctggattcaaaccttctatttcctatataagtcaactaacacactaattttatcacaaaagcattatctcatcgctgtggtatattaactgaattccatcaccttcagataatcttgatttgtctccttcaaagtgaatcggtgtcactttcaaaatagaacacgttttatcaaaatgatttctctcatttcctgtttccaggaatgaagacaatgaaatcagagaaattcgctttcatttgcttaaaatttaacacagtagaatatagaaacattttacattccaccagttatggattcctctcatgactagcaaatggaggagctaggactagaacccagatctgaatcctagtcaagtggtctttacacagctcttaatctttcatatgcacttgagagatgggaacttcatttcacctaatgttctaaaaatcagaagcagctgagcgcagggaagggcaagtagcagaatacagggttccaagcagaatgaactgaacagcaagaacattaatgcgaaggtgagtaagcccatgacagcaggcccagtgggggaatataccacaaggcttttccagacattttccgacattttctgtagccttgtataaatacattagtatgttcatagaaaaattttgtaaaataaaagctctttttctacaatcatttgtgtctgaagacctaatgaaaaaagtttcattttcaatttttctttgctatgagttaaaagaataaatgaataaattaagttcaataatcttattaccaattaatatagagagagaacatagcaaaatagatgttcagctgcatttttattaaaatcatgtttcaggttatgtgctccattagattctgagttcaacagggtctcttacggaaaatactcattggtagaaaatgttagtaagaacctgcaaacaaagaatctacattataaaatttttatgcccagatagagcaatagttttagtaaaagcctaggttagccgcagataattaaaagccatatggtgtggagagattggcacccatgcatgactctctttgtaaagagaaaacaatattttatctaaaagagtcatacaaacatgttctctaatcaagaacatgaacagaaatgtgaggaaagtctctaggactgtgagaaagctacccaggctcacataaggcagggagggcgagtgagaacaatcacacttactgaaaacatctccttttgaaccacttaaatatttgaatgtttaatcctaccattcacttatgatgtagaggacagcgttgttgtatcccattttacagctgagaaaatgaaactcagaggcataaagcaaacttctaagtataccctacccaagaagtaaatgatggaatttaaacctggctcacttttcctcaaaaaccaactcagtactctacagtatgcctgttcactgaccgataagaaaagtttcttccaagctttgatttttatataaccaccaagcagccttcattatgtaaactgataagttatcttgtccacataaatttgatgagaaggggagaatgagccagcgttgatgacagccactcatgtttcgttccaatgagtcatggagaattgacacagagttttgatcatccctgagtatactggataagatcagagaaatgaatcccatgcacagtcatgtacggcccatgtacagaaaggcaacactcaagtcctctttgaacatcagcctgttcatagcaaaatgatcaacgctaccttttggacctttaccctctctctacccatctctcctatcccagagaaaatgaacattgggttttgttaaaattagaaattacatctagaagcccaacttactttcaaaaagaaaaactgacaaaaaatagagacaatgtcaatcatcaagtcatcctccccgtcagctgattttctccacctggtttccattgtgtgcagctatgtgcgtgtacatgcatgtgtggtatccagacacgtgggagtccttttgtttctatgacttcttattaagccatgcccaaagtaaacctaaaagcaacatgtttacttttaatcatggatgacaatatggatattatagtcatttagtaaaatatttaatctgtaataaaacaactctttatcattgcagattgtttgggccacatcttacctgattggctgtgccattgcatcttgccgccaacaaggatcacctcgatatctctacgtttgtcactattgtcatgagtatgtattattagtttttaaaatatatatccccctaaagtaacctaatctagtttttcaaacattgtttttttgtgtgcataaatgtttgtagcaactttattcataatagacaagagctggaaataacccagatgtccttcaaagatgaatggttacacaatctgtagtttgagtcttgactacttcctagttatgtgaaaacacatatttagttatatattattttattcctttgactgtattttctcttatttaaaaaaaactccaatatattttcagagcaatttaccagcagtcttcctatgtgtcattgattcttcaggtaattattatataagagaaacaaatttgattaagcaaagaaacaaggacatttacttcaacaaaacaagagtattgttagaccaaaaggacagacatgcagtggagtcttaacaaggaaacaaatagaaagagccaagtgtctttccctgtatttagctatctagtcaaaaagttgttgcatgtcttctctttaaaaattaaatatacatgttacagattctaccacagatactagtcacaattcctagaaaatttaatctgattgtttcagtaaggttctgctgcaccttcttctcctatcaactgtgattatgaagcaagatcaagtaagacaaggatgactgcagggcccaactgtgtggctccagtgacggttatcagaaaagtgaagattattcagagctggatagaactgcctgatatttgactacaaatgccagttcaatatcacttctgcacttctgctgataaaagtcagtgacgccatcatatatctccttcagctacatgtatttcttagattaacacataagtctttcctacataatgtgaactcaatgcatggtgcttaaccactgcctcccatgtatgtagcacaatacaaaatgttcagtataaatcaatgaacatgatttatttgaaaacacactgccatacttcacattttcagtggcgccaccactatcactattgattcagagtgtaatatcaccatataataactctatatgagttatatataaattgtgctgaagacaataaaatctctttgctgctacaacacatcatttgtgatacatgttttcaagggttggtagtctgcagtgaacttcaactgatccaaaaaagaaaagtacaaaacatggagatctatgatggggaattttcttggttgaagattagtccaagtctctcattaaatctcttactgaatttagtaataatcttcttttcaaagtgaaattttagcagctcagataaacaaatatcatatttaaaaaggctttttaaaaccagaacatttactttttaaagttgtatttagaagcagatattatctacattatgtttttagacatacatgggtaagaattgtcttttcttttttgtttttccttttgagatagggccttgttctgtcactcaggctggagtgcagaggtgtcaacatagctccctgtagtattgaccttctgggctccagctatcctcccacctcagccttccaagtatctggaactacaggcatacgccaccaggcctaactaatttttttttttttttttttttttttttgtagatatgaagatgctttttttttgcccaggcttttctcaaactttcgggctcaagcaatccttccactttgccctctcaaagtgctgggattacagggataagtcattgagccctgcccgtcttttctaaagtttcaaattagtccagaactagaacttctcatctactttctttcccacaccccagcactttagttttatccatgctgatgtactttcatcttttatatacaccatctctttcaataaaagacattaacatgtaaaaagtttcttataacatagtgcaagatggagttagaacctctctaacttgcctcacttgagattttcttcttaacattggtaagaatcatgcccttttaaatgatggtttaccaagtccttataggtattaatgaagaatgttctattgtaattggctctaaagccctcttgcttgtgagtccccttgcttgtacttgggagtacccaaagttcccaagtactgttaggacttgactgtccaacgagatgtgcacattgactgaaaaatattttcatgtcactcacatttattggttctacgtgctaaaaaatattatagctgtaagattggaaatctcacacccatcttaaaaattatcactgttctttacaagaatgtttacacaatttgtttttaaaattggttgtacactgtgagtaaagttttatgtgagtttttcaaagatgggttttatgaaatcacttttttttattcaaggggaaatgatcctgaaacaaagaatgaaccttataagacaggcgtcccatgtgaagcctgcccaagtaactgtgaagacaaactttgcagtaagtttgtttgcattctgtttgtttacagttaacccattgatctgggaaccatacatcctttaaattaagcattaaaaaacatcgcacttttctacaactttcatctcattcatgtacaaattatttctgcttacccctccccaattgccagagtgactgaaaaccattgatttaacctatggcaaaggaaattacaaagtctaggtctgagaactcgagttcccacccaacagattaaaatatttaattagggtcaacctagataaaatattgaggtaagtgtagatttttctctgctctctaaaaagttcttggacccccttactgcaacccataatttaggcccattgctttcagtttaccggtgttctccaattgcttgcccctccatgactacctacccaggttgcctgaccacttattgtggcatgcaatttttactgagtgatccttattcttctttggttcctgtgaaccatctaaaaagttagctgatgctcacattattccttaaagcctcttttttttttttaatttcttgaataaatcttacctaaggtaaagctttagccaaatgggtgccatttctgtttattcccttagatagccaaatttcactttttgaagcctacctgcaaacataatttcttaatttctaggaataatcttgattaagataaattatactagtaataagtctgtggagaaaaaaataaacctaagaaaaatatcctgtgacctccgacttgaaaggccacttatttttcttcacctaaccaggttactttattgtcttttaaagtaagaaagaaaatggattcttcttcctccttttacctttctctcgtttctcttctcttgtactcttttatttacttctctatctgtctccctctctctttctctgtatccacttcactttttataccccgtttctggaaaaaaatgtagatggagagagattcctccccaccgggaaaaaaaaaaaaaaatcaaccagttacctatgccttagcaggagaagggatggcaattgagtagatttttagaatctaggtgagaaaagcaatgtctgtggtggtataacaatttaatagaagtaaaagaagagtagggaagagaaatgttattcaagaagattgattatatcacatagatgatgtatatcataagccctttcttcacctgtaagtgtttgagaaagtgagagctattaaaggaatatatgaacttaagaattgaacatattgggcacaaacaatgctaaaaatgtaagacctagacatgcagatataattcatttaatgtaattcaaataaaatttataaaaataattcttacttataatattaggaaagtatataaattaagaacaacagataaaagaaaacaacggattacaacactttacagattcaaagaaaatatatgttactgctaaagaaaaaaaaatccactgatagtcatatttcaccagaatactacataagagaataaagtaggataaagataggtaattgattttttaaaaaaaatgagtaatgactttggcaaattactgattgtaggaaaaagaagcagagatacactatcaaatatacaattgctctggcagtaatatgacatccatatttcatctccttgttgcaccttgataaatctactgtagttattctccaagttcctggaaggtgaatcagtttaataatttaggaagaggaaaatgtgtatagcatagaaggatattcactaaaataataaacagtaagacataaatgtaaatttaaaatttgtaggccgggcgtggtggctcacgcttgtaatcccagcactttgggaggccgaggcgggcggatcacgaggtcaggagatcgtagaccaccctggctaacatggtgaaaccccgtctctactaaaaaataaaaaaaaaattagcagggcgtgatggcgggcgcctgtagtcccagctactcgggaggctgaggcaggagaatggcgtgaacccgggaggcagagcttgcagtgagccgagattgcaccactgcactcctgcctgggccacagagcgagactccgtctcaaaaaaaaaaaaataaaataaaaataaaaataaaatttataagattgttataaatttcatgcaatgatcaaactttataattgaaggataagagatataatgggaaaatttaaatttttccattgtcaagattcaaattcaggactgcataaaggtcagaaaatcttaaaagagagagggaattaaattattgttatttttgcctttatatagagacaaatagatacattggttagttgtgatagagaattcaggtcaaaaaatattttggtaagctttttggtgctattgccacaaatttaaaattttgggtatcttcatactgattggagaatttcgtgtgcatttctgcctctgtatgtaccaggatgtaggtgcgtgcacatccatgggatagagcaaggtgagaaaaatcactagaatgttagttgagataacctctgggtggatggagagattatatatgccatcctatatgtgctttttaattccattttccattggctatacattacttttaataatccaaagcaaatctttaaccattaaataatgcagcattagataattagacaaaaaattatgaatattttatattgcaatggcatagttaatactttcaaaatgacagtgtaattaaaaatatgattcctctccaatctgtttatattggacttaaaaaattgtgataaaaacctgttttacacaaagacaaaaattttacctttttcttttcatacatgatcttatcacctgttttgcattcagatttagttagcttatgctaattaaatttagttagcaattgttaataaaaatttctctttttgtctttaataagatggtctctttcctcagcaaatgcgatttttaaaagactgtgttgtaaaaccatactattttctttcagctaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctagaaatacttggtcaaattttaacattataccaaagttatacccagttctacctacttgtatatttctttactcatttcaataaagtgtttgaaaaaaaaaaaaaagacatcacccactttccaaaagtaaacaggtaagccatacctcaaacccattctgcatcatacagaggttctcgtcacaggtacaaaaattctgtgtggctccaagaaaagaggacaatttgagaatgacgccctcttgacatgacccatgtctttccatttagatctatgggcatttctcccatgtaaatccttcagacccattctcactttttacttaaactacatatgttagatctatccacttgattgtatctatcttttgagtaattgtcattagcacaatcatggacatattaacatcaggagaacagtgactcatcctgggacacagtaagtaggctggtactttatagccgaaatatttaataaatggaactcattacaaaaatcaaagtaataatttactctaagaaaattaaatgtgtgtgctgtagaaaatctttactcatttttgcattaccaggtattgtgatttctcttacctcaccaaggtagcattagattttagaataattaaattagagccctgagttctgaattttgcatgctagataaccaactaatcctgcagtctactgtaacatattggcaggcagtgttactgtattcttacactacaatatgctctttctagaaattaacatgatacttctcaaaatttgcattccaatcacatctcttcccactttgcataagagtaagcatattcaaatatttcttaagggttggggaaggaggcggaagggtatgcctacgtctaaggaaaatcaaataagcaagtaacaaaactttgacctcatttgtctacattacccaaatttaaataatatgttggcttatctcacaataaattgtatttgttaaatataaaaagtattccccccaaaaaatatctcagagcaaactgactgtgtgaaaagtaccctgtaatgaagaaggttgggggcggtggatgacctcatgtacaccattcttctattatctcaaaagctttcagaatcacacatattgtttggaaaatcattaaaaaagctattttagatgacagagaaaaaactcttatttaccatgcaacatctttctaaaaaatggaaacagtcttacacctctttccaaatgttattgaatatagaataaataataacaaataattctgaagcagaaacaatatccagtggcagtctgtactttcacagtagtaaaagaaaaaaaatagttctaagtgtgtaatacaaagattaagagcatgagcagaggtgtcacccagctggtttgaattcaggacacaacatgtgcttgctctgtgactttgaaaaagattatttttctttgtcctcatctataagttatagtaagagatagaacctacttcataagtttgttttaaggatt

SEQ ID NO: 11897 - DNA, 10317 bp, Human
  misc_feature (1)...(10317): n = A,T,C or G
tggaggtggcctgagaatttgcatttctaatacgttcctgtagacgctgctgatcccaggagcagctttgataggagaggtggaggcaggggcttttaatctctgtcatgaccaggacactcaagctgcccctcatcgtttgggcacaccctcccccatcagtaaccccctcctcactggtacatctcctgccgggcctgaagctcctcctggcgctgttgctggagcacagggtggtggtctgcccaggacaccttggctgtgggagaaggggagtaggttggggtggggagagaaactcaccatcactaccaccagccacacagtctccacgattgccaccctctaccaggtcccctcctcccataagtacagtttctcctacaccaggctgctacctcccgctccccaaggctccgccattccctctcctctgcccgctactctgtggccacaccagctcacctctccatttcacctgcccttctccccaacccccagtcccctaccccttcctgtgctccccctgcagccccagcccggcccgcccctcacctgtaccctcctgcagcaccagggtccccgccccctccagccactggtagcaggggaagaggaggtggccgccccgcggcggtgtcagctggaaccagcggcagaaccaggcatccggggccaggggccccagcaggggcagcactgggggcgccttgtgcacgcgcagcagcagcactcggcctacgtcctccgggagcgtcacctggaagtcctcctcctgaggggaggttaagtatgcgtcaggccggaccctcctgctcgcccccttcacctccaccccatccactcccacgcactcacagcgcccgcagtgaactccttgccgagattgtccaggggcagtggggggctctctccccgggtccccacgatgctgacagacactttgtcccatgtgccagccccgaaggcttctccggtggacaccctgaccctgaactcggccatgctgccagcctaagtccagctctctacggcgcacagggctgcagagcggggctcccccctgggacacgcctggttattgcccctggttattgccactgactccaagcccagtggactcctctaaaaagcacgtccgtttcagggcggggaggggcggggcggagaggctggaacacgcaactaaagtgggggtgggcgggggattggcagcgctgggaacaggagggactaagaataccctgaggtttggggaacggggcctttcagtggtggtgccaggccagagagcctagagttgggacccagttggggtgggggtagatttgtgcccaccacgtctgtttgttttccttcttagccttagaagtctatgcaaaaatatcaccccatttcccacaactcttcttgggcctgcgttcattatttttaaaatttatttatttatttatttatttttgagacagaggcttgctctgtcgccaggctggagtgcagcagcatgatctcggctcactggaacctcctcctcctgggttcaagtgattctcctacctcagcctccccagtagctgagacaacaggcgagtgccaccatgcccagctaatttttgtattttagtagagacggggttccaccatgtaggccaggatgatcttgatctcttgacctcatgatccgcctgcctcggcctcccaaagtgctgggattacaggcgtgagccaccgcgcccagcctacattcattattttatttcattcaataattaatgttcagaactacctctgtgccaggtgctatgctcactgctattgataaaggcccaggcaagacctagtgcttgctctcatggagattaaaaatcaagtgtgaggccaggcacagttgctggccaacatggtgaaaccccatctctactaaaaatacaaaaaaattagccaagcgtggtggcgggcgcctgtagtcccagctactcaggaggctgaggcaggagaatagcttgaacccggaaggcggaggtttcagtgaggtgaagttgtgccattgcactccagcatgggcgacagagcaaatctcggtctaaaaaaaaaaaatcaagtgtgagagaaaataagtaaaccaacacataatttcagatgataataagtgcaatgaaggaaatgaaacagactaatgtgaaggagtgagaagcagaggtgggaagggaggcgttcagagcctcagaggaggtgaaaggatctgtctggggaacagagttttgtgcagaggaaactgttcctgaagaggccctgtggttaggaaaagcttggcttgttggaggagggaaaggcaagagtgcagtgagggagggatttgggggagagatgccaaggggaagttatggatttgggctttgggggaataacataacagatttggggttttcggtctggagatgctaagtttgagatggccattagacatccaagtggagaacccacgtctgggcatagagctcaggactgcaggtgtgcatctttgagtcacaagcacacaggtacatctataccacaggctggtggagatcactaggcagagaatatcctataagtagagaagagaagaggcacaagctgtgccctaaggtcctctgatatttggaagtcatgcaaaggagtggaagcagcaaagttcagtcaatgaggtaggaggagaacgatgccggcagacactttgtcctcttgtgcctgtcacagtgtttcatgaaagccaactgaagtgagagtgacttatcatgtatattccatatataccatggaatactatacagccatgaaaaagaatgagatcatggtcaggcatggtgtctcacacctgtaatctcagaactttgggaggctgaggcaggcagatcacgaggtcaggagttcgagaccagcctgaccaacatggtgaaaccccatctctactaaaaatacaaaaattagctgggtgtggtggtgactgcctgtaattccggctactcaggaggctgaggcaggagaatcatttgaacccgggaggcagaggttgcaattccagctactcaggaggctgaggcaggagaatcacttgaacccgggaggcggaggttgcagtgagccaagatcgtgccactgcactccagccctggtgatagagcgagacttcgtctcaaaaaaaaaaaaaaaaagaatgagatcatgtcctttgtgggaacatggatagagctggaggccattatccttagcaaactaacacaggaacagaaaaccaatattgcacgctccagttcttactttcaattctttaggatatatacctagtagtagaattgctggatcatatggtaacagtatgtttaattttttttttttttttttgagacnnnnnnnnnnnnnnnnnnnnnnnnnnnnnnnnnnnnnnnnnnnnnnnnnnnnnnnnnnnnnnnnnnnnnnnnngattacaggcgcctgccaccatgcccagctaatttttgtatttttaatagagatggggtttcaccacattgaccaggctgatcttgaactcctgacctcaggcgatccacccacctcggcctcccaaagtgctgggattacagacgtgagccactgtgcccagcctgtatatttaattttttgaggaaccgccatactattttccacaatggacgcaacattttacattcccaccagcaatgcaggaggagggttccagtttgtccaccaatgcttgttattttctgtttatttgataatagccattttaatgggcctgaactggtatctcattgtggttttgatctgcatttccctaataatcggtaatgttaagcatctttccatttgcttgttggccatttatgtatcacctttggagcaatgtctgttaatgtcctttgcccaaaccatccgttcttaattcttatccattgctaggttgaattttagatttatcatgtgagtcgtatgcaagacccacacgttttcaaatacgtcaaatgtttttatttatagatcactcttttttttcctaaagtagtatctatagtacatttctttattcatatatcttcacatggtcaagttttctttcatacatccaaaatgtagtgtgatgttttcttattcaccaaatgttagctctacttgtagtctggttccaaactaatcagcctgcttttaaattttaagacatttgttgaaaaaaaaattttttttcttttttcttttttttgagatggagtctcgctctgtcgcccaggctggagtgcagtggcgcaatcttggctcactgcaagctccgcctcccgggttcacgccgttctcctgcctcagcctcctgagtagctgggactacaggctcccaccaccacgcctggctaattttttgtacttttagtagagacagggtttcaccgcgttagccaggatggtctccatctcctgaccttgtgatccgcctgccttggcctcccaagacatttgttgaaagtttataggatcaaaccaaactcaagtggtatcatttttaaacattggattgtacattattgtaaaggtaccagtaaccattattattaagaataagttagtgattatagctccttttgtaataattagatcactctcataatacaaatcaatattgcaagtatccatgtgccaaaatctagtgagtctaggaaaaagtgaaaatgctttattgtctcttcatcctaaaatacatccttggatacttagaaatttcagtgaatctattttaaaggaaactttgtgtcactattgtaaatcgaaaattcgtttcatttcccataatagaaggtaagaataaaggagaatgcaatgaaaaccaaacagtgtaattcaattccaggtagattcttttgcctgtggccagctccctgttccaggagattatctaacgctaaaggggtgctaaaaacatatcaataccaaattgacactttctccctgaaaaggggaattgatttgccgttttatctcaattaaacctgtgatcttgcacctccaaggacttgtcctggagtagcgttgctcaacgtgtggcaagcagatggctggcatcagatgtctttgaatgcttattaaaaatgtcagttccgggttggatgtgactcctgcctataatcccagcactttgggaggcagaggtgggtggatcacttgaggtcaggggtttgagaccagcctggccaacatggcaaaacaccatctttactaaaaatacaaaaattagctgggcctgttggtgggtgcccatggtcccagctactcaggagactgaggcaggagaatcgcttgaacccaggacgcagagattccagtgagccgagatcatgccactgcactccagcctgggcagcagaatgagcagtgtgagactctgtctcaaaagaaaaaaaaaatgccagttccccatccctgcctcacaccaaggaggcagactccccagaagattagccagggaatctacattttacagtagggtgattcttctttagaaccactgcccttgatccttttgtacttggtaagcatgatgattgggtttttatgcttatatatgagacatgcttgtctcaaatcttgttacagcacattacccttcctacttaaaaggttaaaaaaaaaaagaaccatcgcccttgatcatgtaaatattttattacattctgtcctacagctcatgatgatctcagacaggttgaacaggagttgtcacccaacccctcaagatatagatgaagaaatctgagccctgactgggaaaggggtttacttgagattttaaaatgtccattaagtcatgtgcaccccatctttgagcccctgaatgatttggctcctgcttgccttcttttttttttgagatggagtcttgctctgttgcccaggctggagtgcaatggcaccaactcggctcactgcaacctctgcctcctgggttcaagccattctcctgcctcagcctcctgagtagctgggattacaggtgcccatcaccacgctcggctaatttttttgtatttttagtagagatgaggttttgccacattggccaggctggtctcaaactcctgacctcaggtggtccacctgcctcagcctcctaaagtgctgggattacaggcgtgagccactgcaccgggcctttgtttccctccctccctccctcccttccttcctctttcctgtcttctcttttactttcttttaaattcgaatattctcatcaaagctgtagatgcatatgatttaaagagtcaaatagttctacaaatctctcaccaacaactgcttcctgctccacttctgtcctttccctctcatgaaagacaataactttcactactttctttgataatctaaaccactgcatctcaaaatagcatgcatgattgtttatttaatgatttttcagctttaggcaaatattggcttccccctgtggaagataggatttttttttttttttttgagacggagtttcgctcttgttacccaggctggagtgcaatggcatgatcttggctcaccgcaacctccgcctcctaggttcaagtgattctccagcctcagcctcctgagtagctgggataacaggcatgcgccaccacgcccggctaatttttgtattttcagtagagacggggtttcaccatgttggtcaggctggtctcgaactcctgaccttgtgatctgcccgccttggcctcccaaagtgctgggattacaggcgtgagccaccgtgcctggcctggaagataggatttcattttctttcctagtcttgctcccatttgcaaacgtttctcacccccatccttctagtacagttttattaggaccgagcaaacgacactcagtgtttacgtgatttttgttatggatatgctattcataggggacatttatagtatactgtaattatttttttcttccatacaaaaccttttgttgtttctctatataataatgattatattattggtctggttttctatatatttttcattagtttaatccgaaacttcaccacttgttcagattgcctctctatcagttcagacacatccatttcccagtcggttccactgtgtgaaggagtctctccagtgtgtcctgttggcttctctcctggtcctcctgagctcttgcttcaccaccatcctttgtcttccttttacctctctgctgtgctggagatttgtttcccggatctcatgttttgttatttcctggcttatttcttgggctaagcaagaaagggtatgtgggagggaggagaagtttttaagactttgcatgtctggaaatgcctataatctatctatacacttaaatagtagttctgaaatcaatttttttttttttttggttcggaattttgaaagcactgctccaatggtagcagtgttgctataaagaagcctagagctatttgcattcctgattattttcatatgacatgacattttctccagaagcttttaggagcctctccctggcccagcttccataatttcacaatgatgtgccaaggtgtagtcaatttttattaattgtgcagtgctctcagtaggtcctttcagtcttgaaattcatgaccctcagtgttgggaagatgtcttgaattatttcatcgattatttccttctctttattttttcagtgtctcttttttgaacttatactttagatgttgggtctcccaaactggctctccagttcccattctcgatttcatttattctccattttattttatttccaatttcccatcattttgccttttgttctgttttctagtagattttctcaactttctcctctagtcctattgagctattattcctcctatcatatttttttcactggtggggtcttgctatgttgcccatgctggccttgaactgctagactcaagtgaccttcctacctcaccctcctgagtagctgggaatatagacatgggccaccatgtccagcctgtgtatatttgttttattagtaatctgtttgtgtttcatgcttgcgatatttgaccttgtttctctgaggatattagtgataaggtattttggatttttgtttgtttctttttttgtttttgttttaagatggaatctctctctgtcacccaggctggagtgcagtggcacgattttggctcactgcaacctctgcctcctgggttcaagcgattatcttgcctcagcctcctgagtagctaggactacaggcattcggcaccatgcccagataattttcatattcttagtagagacggcgttcgcaatgttggccaggctggtcttgaactcctgacttcaggtgatccaactgcctcggcctcccaaagtactgggattataggcgtgagtcgctgcgcccggcctgtttgtttctgatatttgtggtatgtgggtattatctattgctgcagaataaactactataaaccatagtagcttaaaacaccaagaaccatgtatttgcagatgattttgcaatttgggcaggagtccatgcagtgtcagctggagtccttcatgcaactacattcgcctgggagataggctggcactggaatatccaagaatggttccactcacatgtccagcatggctgggggccggcggggtctttctccacgtggttgctcatcattcaataatccttcctgagcttcactacatggtgcacggatcccagaggcctcttgcagcccagaccagaagctggcgcagtgtcacttttgatgcattgcatgggtcaaggcaagtcacagaccagcccagagtccatgtgggaggggaaatggactcaacctcttgatagaaggaggaggaaagaatcagtgtacatgtttaatctaccacaccattttttgttttttgtttttgagacagggtctcctttgtcacccaggctggagtgcagtggcataatcacagctcactgcagcctcaatcttccaggctcaagcgatcctcccacctcagcctttggagtagctgggaccacaggtacatgccaccatgcctagctaatttttaaattttttttgtagagaccaggtctccctacattgcccaggctggtttcaaactcctaggctaaagcaatcctcttgcctcagcttcccaaagtgctaggattacaggtgtgagccactgcacctggcccacaacaccattaaaaaaaaaaaattattggctgggcacagtggctcacgcctgtaatctcagcactttgggaggctgaggccggtggatcacctgaggtcaggagttcaagaccagcctgactaacatggagaaaccccgtctctactaaaaatacaaaaaattagccgggcgtggtggcacatgcctgtaatcccagctgcttgggaggctgaggcaggagaatcacttgaacctgggaggcggaggttgtgctgagccgagatcatgtcattgcattccagccagggcaacaagagtaaaacctcgtctcaaaaaaaaaaaaaaaaaaaaagttcttttactgccatttgaatggggttttggagggagaaaaagtccatgtttgtgttaaatcttccacttttatccataataacttagaagatcaacctgttgcccttctccacctctaattccctaccagttgcatccatagccccattctagcaccttttactgttttctacgtacttctgctgaagcagggagtaccttggaagaggtaaaactgaagtcttcttagctgaattttgtggagaatcctaagatagggctaagcagaatgagataggcctttgataaaatgtttgaattcattttaattttgttttgcatcatcttatttgttttttcaaacttgtaactttacaagttataaaaagaaattgtggccaggcatggtggctcacacctgtaatcccagcactttgtgggggtgaaggcgggaggattatttgaggccaggagtttgagaccagcctcggcaatataaaaagcaatgcctaggtccctccccagattccggatattggacccaggtattaacctttttttttttttttttttttttttttgagacggagtcttgctctgttgcccaggctggagtgcagtggtgtgatctcagctcactgcaagctctgcctcctgggttcacgccattctcctgcctcagcctcccgagtagctgggactacaggtgcccgccaccacgcccggctaatttttttgtatttttagtagagacggagtttcaccatgttagccaggatggtctcga

SEQ ID NO: 11898 - DNA, 14082 bp, Human
gcctcctgagtagctggaattgcaacctctgcctcccgggttcaaatgattctcctgcctcagcctcctgagtagccggaattacaggcagtcaccaccacacccagctaatttttgtatttttagtagagatggggtttcaccatgttggtcaggctggtctcgaactcctgacctcgtgatctgcctgcctcagcctcccaaagttctgagattacaggtgtgagacaccatgcctgaccatgatctcattctttttcatggctgtatagtattccatggtatatatggaatatacatgataagtcactctcacttcagttggctttcatgaaacactgtgacaggcacaagaggacaaagtgtctgccggcatcgttctcctcctacctcattgactgaactttgctgcttccactcctttgcatgacttccaaatatcagaggaccttagggcacagcttgtgcctcttctcttctctacttataggatattctctgcctagtgatctccaccagcctgtggtatagatgtacctgtgtgcttgtgactcaaagatgcacacctgcagtcctgagctctatgcccagacgtgggttctccacttggatgtctaatggccatctcaaacttagcatctccagaccgaaaaccccaaatctgttatgttattcccccaaagcccaaatccataacttccccttggcatctctcccccaaatccctccctcactgcactcttgcctttccctcctccaacaagccaagcttttcctaaccacagggcctcttcaggaacagtttcctctgcacaaaactctgttccccagacagatcctttcacctcctctgaggctctgaacgcctcccttcccacctctgcttctcactccttcacattagtctgtttcatttccttcattgcacttattatcatctgaaattatgtgttggtttacttattttctctcacacttgattttttttttttagaccgagatttgctctgtcgcccatgctggagtgcaatggcacaacttcacctcactgaaacctccgccttccgggttcaagctattctcctgcctcagcctcctgagtagctgggactacaggcgcccgccaccacgcttggctaatttttttgtatttttagtagagatggggtttcaccatgttggccagcaactgtgcctggcctcacacttgatttttaatctccatgagagcaagcactaggtcttgcctgggcctttatcaatagcagtgagcatagcacctggcacagaggtagttctgaacattaattattgaatgaaataaaataatgaatgtaggctgggcgcggtggctcacgcctgtaatcccagcactttgggaggccgaggcaggcggatcatgaggtcaagagatcaagatcatcctggcctacatggtggaaccccgtctctactaaaatacaaaaattagctgggcatggtggcactcgcctgttgtctcagctactggggaggctgaggtaggagaatcacttgaacccaggaggaggaggttccagtgagccgagatcatgctgctgcactccagcctggcgacagagcaagcctctgtctcaaaaataaataaataaataaataaattttaaaaataatgaacgcaggcccaagaagagttgtgggaaatggggtgatatttttgcatagacttctaaggctaagaaggaaaacaaacagacgtggtgggcacaaatctacccccaccccaactgggtcccaactctaggctctctggcctggcaccaccactgaaaggccccgttccccaaacctcagggtattcttagtccctcctgttcccagcgctgccaatcccccgcccacccccactttagttgcgtgttccagcctctccgccccgcccctccccgccctgaaacggacgtgctttttagaggagtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgtgagtgcgtgggagtggatggggtggaggtgaagggggcgagcaggagggtccggcctgacgcatacttaacctcccctcaggaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacaggtgaggggcgggccgggctggggctgcagggggagcacaggaaggggtaggggactgggggttggggagaagggcaggtgaaatggagaggtgagctggtgtggccacagagtagcgggcagaggagagggaatggcggagccttggggagcgggaggtagcagcctggtgtaggagaaactgtacttatgggaggaggggacctggtagagggtggcaatcgtggagactgtgtggctggtggtagtgatggtgagtttctctccccaccccaacctactccccttctcccacagccaaggtgtcctgggcagaccaccaccctgtgctccagcaacagcgccaggaggagcttcaggcccggcaggagatgtaccagtgaggagggggttactgatgggggagggtgtgcccaaacgatgaggggcagcttgagtgtcctggtcatgacagagattaaaagcccctgcctccacctctcctatcaaagctgctcctgggatcagcagcgtctacaggaacgtattagaaatgcaaattctcaggccacctccaacctactacgacactgagggtgtagagtgggaatttttgttttgacaagccttccagatgactctggtggccactgatgtttgaaaaacactgctctagggccaggtgccgtggtggctcacacctgtaatctcagcactttgggaggctgagggaggcggatcactggaggtcgggagttcgagaccagcctggccaacagggcgaaaccccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcctggtctgtgggatcagagcagccacaggctcatttggttcctggtgattctccatgtgtcatgaattccacccctaaggaaaccattgcaccaaatctggcagcaacagccccaagagagggaatagacattgagatctactgtgtccatggagacccagagtcagcctaggccctgccaaaacgagctgtgagatcttagaccaattttttcatctcttcaattcttattttcttctgtaaaagaaactaagaataccaatctcgtttgggttaggaggaacaaatgagaaaatggttaagaatgtaggtggtcagctgctaagtcttgcacaactgtgtgctcttgctgttgttcctgtctttcagttcactctgttccaacactctaggctcttataaaacgtacagtgaggtctcagatccattgcaacagcattgcctgggagcttgttagaaatcagaatctgcatttaaccaagatctctatgtgagagggattcaagtctgagaggaagggtttggccaccacctggtggcagtgtactttaattgcaaatttttctttgaagttgaaagctcaaacccaaaagcaagttttgaatgaatcaaagaatgaatgagtgagagcatgactggctaggggtcatcaagtttgcagatacatgaatttaccatttccctggaaggtctttggctgtgttgcttgtttgagaatagaatttagagatgcctcgggcggctccccctaaactatgaaggctgaagtgcctctctatgggacacctaccaaaggcaactgaaaccttctgcgcagcccctgtcccaggatagtctcgcctctacaagatgcgtctgtgttagtcgggacttctatagttgcaagaacaaaagctaactccaactagcaggcagaaaaaaagtttgtcggccagacacagaggcacttacagaaacacaggcaggaattgtccacccagtggaaaatggccataactaacagtctgtgtttactgctataatctacatatccagagagagaccacctctctggctcagccccaatggcaaattccctggaaaggactctgattggcccagctctagtcaggtgctcaactctggaccaatcacccttgaccaggggagccatctcactgtgggaaaatggcagctcccttgcagcctccttgggtagaatggaagggcagctcccaggagggccctcttggctgaaggggtctggctgtgaccaggccccccaaggggactgccactccatctgccctagcaaagagtctccctgaggcctcttgctgaccaccttccctctctaccctccaggtggaaggcttacaacccaggttggcctcactgcctggatgaaaagacagtggaagacttggagctcaatatcaaatactccacagccaagaatgccaacttttatctacaggctggctctgcgtgaggatgcccacccttccctgcccctgggcctcagatgccctatgacctctgccttctgccctcccctagtcagttcccccaccctcagtgatatgagtcacatagtcctgcccaggaaacagcctccttcccactaccaatcccacagagcaacagctaccttaggggtagtgactaccttgggcccggaggctggttcaggatcccaagaggcataaggctggctgacagggaagggtctcccagggcctcctccccactccccacccctcacatcccctggcagttttgcagagatgaaaatcaaggggttgctggaccgcaaggggctctggaggagtctgaatgagatgaaaaggatcttcaacttccggaggaccccagcagctggtgaggagcttgggccagggatcctgacctctttcctggggcatcagctcctgtggctgcccagagtctcagaaaaccaagcaccaatttgctatgtaaccctgatcaggtccttgctagaccttacttttccccacagagacaaaagagaatatggacggaggggatccctgaccttctaacgccttctaatacaacagacatttgttgagctgctacatatcagacaccgggttaggggctacatggttcttcacggggctcacagttgagcaggccagttggtgttaattagactcaaaatcaaataattcatttcactgtgaaacatgctcattggatccagtgagggtgtaaagggggcacctgccataccctggagagggccccaggaaagctctcccaagggggtgaactatgctgagacctcaaagttcagtaggccttagcagtgccaaggatgggccgtgggggcagagagcagttcggggaacagtgagtgtgaaggccctgaagacagaaggatcagccacctttggaggaaagaaaacaccactgtggtcaaagtgtaatgaacaagagaaggagagcgagagaaggagcaggaaggtgcacgggggtcgcacaggactttgtcggccatggcaggacttgcgtctttcctcagcccagtgcttgactggttgccagcaggggaataatgtggtcactgtgcactgctggggggcaagagactatgagaatctgctatgaggctctggctgtggtcaccagaggatggtggcctcagcaaggcagtggcaatgcaatggagaggatgggtggaccgagaggtactcaggatggagaatcaatgggatttgatatgtgaggggtactgccaagagaggtccccaggctccggctgggcgcagtggctcacacctgtaatcccagcactttggaaggccaaggtaggtagattgcatgaggtcaggagtttgagaccaggctggccaacatggcaaaatcccgtctctactaaaaatacaaaacttagccaggtgtggtggcatgggcctgtagtcccagctactcaggaggctgaggcctgagaattgcttaagcctgggagatggaggttgccctgagccaagatagccccactgcattccagcccgggcaagagagtcagaccctgtaaagagagaaagaggtggggagtgggggagagagagagagaggaaggaaggaaggaaggaaggaaggaaggaaggaaggaaggaaggaaggaaggaaagaaagaaaaggaaaaaggaaaaggcggaagctgaggcagacagatcacttgagcccaggagttcgacaccagtctgagcaacatggagaaaccctgtctctaccaaaaagacaaaaattagccaggcatgctggtgtgtgcctgtaatcccagctacttgggaggctgaggcaggaggatcggttgaacccaggaggcagaggttgcagtgagccgaggtcacgccactggactccagcctgggcaacacagcgacacagcctgtctcaaaaaaaaaaaaaaaaaaggaaagaaaaagaaagggtcccgagtctcctctgtaggcaactgggtgggggatggagctgccacttcccaaatatcaggcaatgggactgacctgagctgtaggaataatctgtatttggcctgcaacgtgttgcatttgaggctagtgagttattcagggggagtgtcaggcagacactgggatgcatgggctggggactatgatttgctgctgggtgaagaggcagtgactgaagacaaggggcaggggaggtaactctgaggacacactgtgaagattagccagaggcctgtgggagctggggtaaccccgtccccgtgtcccccaccccctgcaaagcacgcatttgagtgaccccgttcccctgtcccccaccccctgcagagcacgcatttgagcactggcaggaggatgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagaggtgaggggtgcagggatcttggctctgcacagtcccatctcagtgccttcacacccgtcccctactggagacagaggggcacactcacatttgttagggacctaccgcgtgctgcgtgccaagcacactctcccgaaacacactcctctcccagccctgaatcctctcccttctacaactgcacccccttcatttagaaaaccaggtggcagccccagatctcctttcttctgcagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccaggtatgcagtcaggcaggggcagggcagcgtgaagaagagtcaggagaatggttggaagacactcatggctgcctctctccccacctgcctccccccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaaggtcagtggcttgacaaggtggcccagcctgtgcccatgcctctgtgcctcttctaagcagcctttcctcacatggccctatccatgcaagctgggatgcagagcccccgtccgcttcagcagcatctcctggcacaactcccctggaagcctgctatccagcaggccctaagtaacataaatgcagcaccccagaaaggctctcgaagggagatcaggcagcatcaacagccgtcatagaagcccaaatcttaggaaggggaaggacctggggctggcaggtgccaaagtttgaacatggctttgagagaccaagttctctgcagatacttctggggtaggggagggctgggtgggaggcccccgtgctctagggtgggttctgtaggtttcctagaccctgctagctttcagacggcatggattcgaggcatctcctctgtgaagggcaggatggccccctcccagggtccacccacagtcgctgctcagattctctgatccttctagacttctcctgggtcccagatgcgggccctactctgtgctcttctgtactagctggttctttctgactatctgcagcttctgaggcctggcgctcagaggtgggctctggtggacggctccacattgccaggcccacaggccctggttttcctagtgccttccctgcctaggggctaggaaatcacaggatgccagagccggaagacacagggctcagccacatcagcacccacgtttgacaaaacaacctgaggctcagggagaggaaggagcacgcctgagctcccagaacaagctgctggtggagcccagcaggaactccagggctcagacccctgtcccaggctgcctcctctcattcttgttgcctctttccaagtgacttgcagggctggtgcctgtgtgggggaaggtctggggccagaacaacccaggcctcccctagctctgccattttcctgccatgcagctgctgatcccgcacacccgatacaccctgcacatcaacacactcgcccgggagctgcttatcgtgccagggcaggtggtggacagggtgagagctgtgttggggagggagtaggcaggccactccttcaatgtgacgaatttgaggtcctggggtaggagtggcccatctccccgacaccagtgctacctcctgcttctggagcaaggtctgtaggacccaagagtcctgtctctcagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatttggggtgcagtggaacggtgaggggccgtccctggagagccgagggctggtcggggacgtgggaagacaggaaaggagactgaggccccagggaggctcacgttgaggaggagggccagacattcatgatgctaagcagaggcattcctcagagcgggtcggggttggaggctggacctgaacctggatgcattgcagctttgtctctgaaatcatcggtatctactacccaagtgatgagtctgtccaagatgacagagagctccaggcctgggtcagagagatcttctccaagggcttcctaaaccaggagagctcaggtacagggacctcagccctcaggcgcatttgagtgagcccatccccgtgtcccccaccccctgcagagcacgcatttgagtggccccgtccccgtgtcccccaccctcaaggctcaccctcaagcctccgcagcagggtcctcaggtccctggaagccccatcccagcccagctctccttgcaggtataccctcctcactggagacccgggaagccctggtgcagtatgtcaccatggtgatattcacctgctcagccaagcatgcggctgtcagtgcagggcaggtgaggaaaggccagcgcccgaggtggcaggctggaggtgacccagctcctcagcctcattctgccctctcggccttcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaagtgagtgtggggctgggggccaggctgggccaaattggggtaagagagggtgtgatgtttaccctgctggcccagacccaaccctgccatcaggtagcgggtccctttgccccactgaccctccagtgggacacatgagccttggacatttcacagtgaaggtcaaatggccaaatgcgatgatgcggagccactctcagtagcaaggggaacgtgtaattatgcttcttggaaattccgaattgagctttcattccccgaaagcttcctgcagataagctttacatggatatctgtttaagaggagggacatggatcaggccccatcgagggctacttcaggtcccacacttgggggctagggccagagctggctaaggcaagttgcagctgctcagatagtggggaccaggagtctgggatgcaggacctcagcagccgcctcacccaaccttgtggtggatcctcagaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaattgggcctggtggtgtgtggctgtggtcctaactactcgagaggctgaggtgggaggactgcttgagcccaggagtttgaggctgcagtgagctatgattgtgccacggcactccagcccaggtaaccgagcaagaccccgtttctattaaaaaaaaaaaaaaaaaaaaaacaaggccgggcgtggtggctcacacctataatcccagcaccttggaaggtcaaggtagagggatcacctgaggtcaggagttcaagaccagcctggccaacgtggtgaaacccggtctccacccaaaatacaaaaaatagctaggcgtggtggcacacatctataatcccagcaacttggaaggctgagataggagaatcacttgaacctgggaggcagaggttgcagtgagcccagatcatgccaccgcactccagcctgggtgacagagtgagactccgtctcagaaaaacaaaaatgaaaacaaaaaatgcccaagaggttgattgtgacctactgtctcagctttaaagtgaacaaaacactgaaaaagggtcactgggagccaggcagaatgagaacacccagtcggcacaggcagtgcctatgtatactttcttaaaaacatcccctaaagttaaagacttgtacgttataaggcaggttccgtttccagagaatcagaaaacattgtcatatctctaatcatactttgctgctagatttcatcatcactgatggatttacatttcatacacattctttcattctgtttttcttttttttctggctcatagtcggtgagcatccattaaggtaaaaaagtgtcctttaaaaaaaaaaaaacaactcccgtggcgacaactggtagacatcaccttaatcaaataatccaggtgagttcaggcgtggtggctcacacctgtaatcccagcactttgggaggccgaggcgggcgaataacttgaggccaggtgttaaagaccagcctggccaacatggcaaaaccccatctctactaaaagtacaaaaactagccgggtttggtagcaggcgcctgtaatcccagctatttaggaggctgcggcaggagaatcgcttgaacccaggaggcagaggttgcagtgagccgagatcatgctgctgtattccagcctgagtgacagggagagactctgtgtcaaaaaaaaaaaaaaaaaaaaaaaaaaaaaatccaggtgaacttgctgataccatgttgctttgctctaatgttgtaagaagagcacctcatctctgtggtttcttctagaaactcataactacagtctagtgatgagaaaaatacagacaaacccagattgagggacattctgcaaaatacttgaccagcactttccaaattttaaaattgcctttgcttttttggtgtaaaaacaaaatgcatcctttacaattcatctaatgatttccatcactactacacattgcaggcatgagtgcttttgtttttcagtttcactgatttttataaaacaatgtggacaaaaatgcaatttatatactataactgcataaacattaccattggaaaaaaacagaacagtgcctcagaaagggtagggctgactggcaagtggcatttgacatgctcattcctcgttgagagtgagtataccgaaagtgatttagagatatatgtatctgtcaaacttctttccatcaattcctgctaacttaagcaataaaggagttaatggaaaagaaatggagttccttgagaagttaaagagctgactatgcaggccaggcgcagggactcacgcctgtgatcccagcactggaagtccaaggcaggaggattgtttgagcccaggacttcaagacagcttgggcagtatagtgagaccccatctcttcaaaaaaaattaaaaagtagcagagcgtggtcgctcacgtctatagccctggctattcgggaggctgaggagggaggactgcttgatccacggaggaagaggttgcag

SEQ ID NO: 11899 - DNA, 57267 bp, Human
  misc_feature (1)...(57267): n = A,T,C or G
tatatacaagagaagcattttctccatagataaatgactttctctctctcaaaagagaaaaatgggtttaccgttgggttcctgctgaccacatcttcctgtgttttttgtcctctcaagtgatcataaattttagttggtatttcttcacatctctttttctgggcatctgatttgcttattttcaactttccaacagaataaaggatccagtaggtgggatttaaaatttttttttgttttagaaaaatagcagtccgtaaagttagaataaacgaataccagtaaactacgtcaatgcttttgaaatggatacctttatataatccattgacatcctcagtgtcattaaagatggcttttgagtaagcatttatatatgcatctttaaattgctatttgcatacattctgtgcagtacttcttcactatcatatgaatctgtagccctttaattagttgatttattttgtgttgacatggcaattgtgatggtggtatttagatgtaattattagtatgattcattaaaaccattagtgcagacttgagctacatagaaaatcataatgttattaaatgctttagtactatttttctgctgtggcaacatatctgacataaatatttcattttcttgaaatataatttaatattttttaaaaatctgagtaatttatattgaaatagtaattatttccataaagattagactgctcaatacctataagttagtaaacattaggcaactaaaggccagtatttagtatgaaaccagtattaagttaggccaggattttagatttttagatcatttaaaattaatgtaaaagttctgattcatagtttgcctttgttatttttattataaaagactattataactcaatgtgtttgaatgcagatatttattgataggaaactttaagggcaagataacaaaatagtcttaatcttaatttctagaaaaaggttaaataaaaccaattactaaaataatacataatagaaaatactaaatcataaatactttataaatataacacatatatctttagctaagaactattaaatgtgggtcattttgcatttttatttcatttgtaagaagttaataatggataaagctcagtaaataaaataaggttttcctcagtagagacagtctctaactattaatagattttctgtcttcacttgacttctagtgtttactgtgactctttcacctgtataatttaatttcaaagtcttatttgtttgttcttttatttgtgtatcatctgcctgatgatttaactttagggcattaaagaaagaacaaagtaaagtttggtttcattttcattgtaggtagttaagttgggtcataaactcttttctacttcccaaatctaattattgttaagagttgttgattctttttgttttgctttgttttgttggtaaaattttctagaagctcttcaatataaagtcacagaaaaacagtacttccattgttttagtgttttaaacttccatattgcatttttatgtttgaatttatcttcatgtcttcctgctccaaaaagtgtgttagcactttttttagactttcctgtgaaatgtaggtaagaacgttttagagattttgcaggaaacttgacgtaattgctaccaattgaagatattacatgcccaggtcatttgttccttaagttgatgttttggaaaggatacatagaaaaaaaagaattaagaaattaagtaaaatataagcattcagttaaaaatggctctacagctttttccttcagttttttttttttaattttgtaagctacctcaaaatctagtattgtctttatgattgactttttactatgtgcgatattgacatttgtgtggaggaaatgaagacatgcttagctattattggagtcagtttggctactaatggtactgatattcacatattgcaatctttttttttttttttgcagttttactaaagggaggaaaaagagaggaagagaaaccatttagagactgtgcagatgtatatcaagctggttttaataaaagtggaatctacactatttatattaataatatgccagaacccaaaaaggtaaaaccagaagtgtttgtttacaagatgtaagccagatcccagttgaattgctggataatcagattgatttgtgagcttgttaaactggaaatatatatagagatgcctgaacttttttctcccagagatactctgtttcccaggtccataaaggatgaaaaccctattgtacagaaatccccaatccacacaccttttctttcacacaaaattttgcatttattccctggtgtccctaggatgtccccttgctcatacatgtttgccttgtacagattacatgttgaggtcatgtctaccgtgagtctatgggaaagagaagccatcttccaaagacccaacaatccagagaacacacattatccaaagccaaatactgtgaggagagggaggggtagatatagctatttgcaagttattgctcctgttaggataggagaaacatttcctatcttacttcataatcttgaaagaatttgctttccatatttacataaaagagtgggttggaggatcggattcatcagtatgttgaacaggacccaaggtaaactttggagtaagcaaacattatcttcctgctgtaacatctcttttgtatactgtcttccaccatttattcattaaatcatccatctatgccttcattcaatactgttaagtggatgtcatgcatttgttaggaacatgaatatagagcaaacagtttctagtgtaatgatgaagatagacaattatgcagatagttataaaatgctatcaataagtatagtgatagaaatggtctgtgtaaagcagggtatatgggaagttttgaggtgagacagctgaagagagtgagattaggcaagaaccttgctcttcagtgtctgtgagttttaactggaagcccagggtcccaagaggaccgcatgcccttacaggataaaacaactgtcctcccctcatgcccccacctaaattacttgtctcttatccccatttcctctggggcctgtgcaatgctcttggaatcttctctgattccctcaggcaactttacatgactttctcactaccagagttctaaaaggcagagattgtgccttttatctttgatttcctggaacctagcatagtttctggcacatagtaggtctcaatagatatgtgctggaataaatgagtaagtgacctgctgatggcaatatcaacacttccatgcagtgcatagtaaatcagtctaacttacttagtcttcctgattgttagtctcctttgataggcaaaggaaatgaatcctggagcccagtttgccagatgccacttaattggcaacccaggaagtctggactatagtccaggtctgatacaattctattttcccttttaccactgtcctctgtctctcttgatttccgtaatgaatagttgtttatgttagctctaaatggtttctttttcccctttgctgggacaaaattttcttcttgaaagatacctttgatgttgtctataagggggtaaaatgtaggagtggagtgggcacaggagggaggacaggcaggaggcactcttctgtactttgctacctcagccatctaccagagaagtgtggttttgctgtttttcatgtttgatttctgtgcaagattacattgaatcccatggcttaaagaagcaaacaaatgaaaaattgaaatacaatggcaagtctgggaatgaggagatgaagataacttattctaaggaagatatcctaaaatcacacttaagcttaaattcaattcacacacacacacacatcataaacacacaccatacacacagcagatgaagtatgtgagaatttgatctggagtaggaggtggagttaaaacatttgctttatcatttacctacagtactactcaagacctgaaagaacctctaaattattgtcagttccactagagcttataatctgactataaaaataaaattaactaaaaatactaagcgaacttccatttagactcatagtgattctgtgatataaatgaatcgaaaaataattcccaaagttttcagatcaagaatattcacaattttagaatttttttgacttcatcatcagtactaccatgtggtctgtgggaaggggtgcagtacaaatacagctttagtcattctatggactttagttcatatataaccacaactacactctagtttgaaacattatgagatgcaaatggtgcacaggctatttgcagaaccactgcgcctggtaatgtgaagaaaaagatcccacctcaattcataatcctgaataggtttgcttttcatgcttacataaaatagaatgttggagaatccaatttactccttccatggctggctcctgggttggtttcatcaggaaagcaagattcaagcttacgcttctacaaaatggtggattttaaatatgatggagtttttgggttttcttaaataaataaaacttagaatattatattcacaaatgtcaagtacctactgaattaacttctgatatttaggctaagaaaaaataataatctgaacaggttagcagtaacatacccatacgtacccataaggagcaaattttatcactgctgaatggccaccatggcttttcagagagaagaaggagaagttccaatattacctggtcaggactattgttagatttagatttagttttattgaaatactagcagagtgtggtgagaaggggagataactgagctgaagagagaaagacctggccttcttctggacttagatgttcattctcttgttttattatttccctattataatcatagattctcttacaagtagtaacattgttctataataaagatgggtatttcagactgacatacatacacatttttgcaggtaaaaaatttagtgtttaatcccttagtataattgcatagcatagcactggtaagaacaaatattgtgtgaatttcctcaaaagtaatttacaagctgattaacaaaatagctcaaatgtattgagcatttacagtttgccagtcttcttctaagcatatatatctctatatatagatagatatagatctctatatatagatgtatactatactatactatatatatactatatatagatatatagagatatatatagatctctatagatatagatacctatatctagatataactatatatatagttatatctagatataactacatatctagatacctagatataactagttatatctagatatctagatataactagtatatagtatatatacagtatatctagatataactacatatctagatatatagtatatctagatataactacatatctagatatatagtatatctagatataactacatatctaaatatatagtatatctagatgtaactacatatctagatatatagtatatctagatataactacatatctagatatatagtatatctagatataactatatatatagtatatatagtatagtatagtatgtatctaaatatactatataactatatatctatatatagatatttatatctatatatagagatctatatatagatatataatatacctatatatctgctgtctatatctatatatgctatatatatctatatatgctatgtatatctaaatatctatatatatgcttagtgtatatatatgcttagtacatatatatgcttagtatatatatgcttagtatatatatatgcttagtgtatatatatatgcttagtatatatatgtatgtttttatatatatatnnnnnnnnnnnnnnnnnnnnactcccattatccctactttagaaagttaacctgccccatacaaattcttagcaaatattgaatattgactttgaaacaaaggaatctaattctaggatacacccttttaatcagaggattaagcaggatcattatttatgttaacgataattgaaattgtatcatttataattttaaatatgaacctgttgccccatggggtggtaaacacatggtgtgacatgtgagctacacaggcaagggtttatttttagaaaattaggtaagttgattcatgttctcattataacccacctcattctcaccttcctataatctcagttttttccatcttgaaataaattgtcagcattctctcaatcctataaaaagtgctagcaaaattcatcgttaagactttcacccttccatgtagactgtacattgtaaacaggaagtttggtgctacccctgggtaggcttagccaaagcattgctcattataatgtttccagaagttttggcaagggtaagaatctcaaggcaacctacacaaaaaccgaagcatcaaatatgcatggtatggacgaaaaaataaactagggttattaaaggaaagtgacaaaccaatgagcagaaattattcatcttgtagtcagtgtgtgagttgcaagtataacaggattgtagtacagtaattttttcgattgacattgttccatgccaaaaaaaaatgtctttgaaagttagagaaatgttatcttttcaaatgtggaagccaaagacggttttctaggactatttaacttttcaagcagaaagaaaattagatttaggtcatttctgtatttactttttgcttttatgttattaatggcttgtgtttatttttctttctgaattcccttcaatgtatagtagtaggaaacaagactttccctttcattttatgtttccaaaaccaaatgcctagtttcatccaaaaaacaaaccatttaatcattactctgcttattgtaaaatattaaaaatttgattctgaactcgtaattcccctaattcttggaaaagtactgtaacaaatgggttaagcccttttcatttatggtatggaaaaataattaacattcacaagtctaatcattccaacttctatggaacataaaagtataaaaactatgtgaatcaaatttccccgttttgtttgggtttaagcctccgtattatgttaaaaggtgtttaatgcttgaaagctttgaccttgcctgggataggagccagttcagtcattttcttggatagagttaagcccaagtcatatgatcaataaatgcaataggcatagttaatgtagcagggtcttgtccacaggaaggacactgccagatagcacagaccacacaatactggcaaatgaacttttcaagtctttcatgtctcaaatctttctaaaacctaccatctatttttttaaatttccttcatctgttaagcataggcttttatttttttttctgactaaaaataataggcttttgttttgtctttgctagagtgagtccaacctcttaaatatagatatatgtatgcgtgtgtgtgtgtatatatatatatatgcatacataatacatatagaaaggtggcatgctcaaagattagtgatgccaatattataataactagagcctagaaatcataattataaagataatttattgaacttctacatgttttggttttgtatattttctattatttataataaattataaaatttgtatgcaatgttatataactatagtatattaaatttaaatattatatacatattaaatattacattatatacatagagtgtataatgcgtagcataaacatatattatgtcatcagtaatacatgtaagagatgggagtagtgtcaatgcctattaagtgccaaatgctgttctaaaaattctatatgcattaactcatcaaattctcagaaaatatctaagaggtacatacagagagcagaggtggattttaaattcaggcaatgtagcactcaagttggcgctattaaccaaggtgtcattcagctccattgtgcctatataacacaaagagcagctgttatcattgatgttattaagtctacataagaattgggaagcatatgttcaaccctttaacctctctgtccctcagcttccaacttagtaatctgcctgggtaatttatatttcccaatggtttttcctctaggtctttatttaagaagcattctcagcacatctgaacatttacaagtcactggattcctctgtttagaaggaaagttgtctttttcaaaaatttccgagtgatttaaaagctaagatgcctctgtttagaaggaaagttgtctttttcaaaaatttgtgagtgacttaaaaactaagtgcatagagttttaataatctaggtaacagtaatttaaaaactgtacaatatagtttcctctctgcactctacatttataaatgtagtgattcttttccctgagtatgtaagtggactttacagctttgcaaacacaacttggcaaactttcaggcaatcagtgtccattaggaaataaaaatttgaataaaaacattcattctggattaacaagtcagggcacgataaaatttaattgagaaactagtgatattagctgcttctagaaaaatgtttccttgatattttcacttcccttttttctcatttgaatttcactggtaaagctccactttgaccacttctcttgaatcaccacctatgccctcttgaaactatgccatctgattttattcccacaggaatctgcattctctctcaccaaggtcactaaaggcttcttcattcaaattgaagttatattttcttaatcattttttatcttgacttttctgaaacctttgatgatcacctccccaactctaaatccatctttcttagcattccattaatcaaattttcctattttatctctcctgttccatctctatttgtttatcaaatattcattcagtacccgctacaggctaagcacacctctaggtactggggacagcagtcaattgaaagaaatccctgcccacctaaagtttcctgatgtattctgtccttctcaggtgttcaccaaagcccgttctttgacccttctcactccctgccacacacatctgtttccacctttttctttacttatttaagtaattgcatttgtcttcatgctattaacaaatgcttttaagcagattattcccaataattttcaattaggtagacataggattcaattctgaatccagttcaaatcaattttaaatcccagatccagagcttattgttgagtataatcactggtaagttactgaactactctaaacctcagtattttttcatctgtaaaatggagatgatcatcatacctacatcctactaggactatcatgagaataaattagaaaatgcatgtaaggtgtttatattatttggtccttaacaagcatgtcattgttaatagcaattcctttctttcttccttatgctcttatccatatttttatccttggtctagatcatctcgaagtgctcgataaactttttctttggatatctgtgctacctcaaaggctaaggtgtccaaaactacgatcattttctttgctagcctttgaggtatccaaaactatgatcattttctttgctcgtgttttctttcttaaatttctcatttagattattgtctccatgattcttcaggctattagagctgaaaattgtgaactctgtctccttaattctatgggatcagtcactattgaaacttggagatgtttgagtacctgacccatattttatttataataatacccccagttgtaagtgaaaactgatgcccaagaatggttgttgagtaaatcaaaaaataaatgaataaatgaagtagaattacggaaaataaaagtgtagctcgaggttatgttgactgagagcaggtgcagaaattaaaggaatagtggtggtggggactactgggacaggaatcaacatttcaaatgtacaatcttggaggtgagtcaattcctagggttaatgaagacatactgtatgtgtggctgttgtcaaagtagggcgagagccttgggaggagagttgtcctatttcatatgcccacaagtaggcatgtatatcttggacccttccactctgaggaagtacatggacaattcgctctttgaatgacatttcttgccactgcttttataccctttttgctacttgtgttccaaatgcaatgcctcagggaaaacacttgaggttttttctttaatcagggcttagctctgtgtcctcatagcctgcttgctgctgttgcatcatatcccacctttagccaagcttcaacatgctttagtattcagttgttgaggaaatagtgtttcccatagtccccgttgaataatcaagctgccacattcatgctacatcaattacagtgattgctctccgacgataatcccattacagatatgtttctcttcttgggtagaccctgggggaaatgagtcaatttctaaataaataccattgtattttgaataattaaaatatgcataagtctttgaaagatttgtataaattttccacatgggaaagaagttattgtcacagtcagaagagatacaatatgtcatgttctcctgttattgttcgtgactaaaatacaagcaaataatatattctacatatgctatgccacaaatgttgcctctagtgaaatattgactcaaggatatctactgtaacatgtacatatataagaattgataggcaatgaaatatgtgatagttaaagacattatattttaaaaattttttattcttattgtactcccatttcaatcaatttaaagttttaaaattctgagtcatgtgttttggcaatcaaatggtctgtaactttggaaatttggtagcatttccaaaactttgaacatactcaaatgcttattttcatttaaaacaaagattttttaaaatgttgtatagtctgagacaaagacttaattttcagctgactaaaatttgtgcacgtaatttattcatcattgatggaatttaatcagaaataactcaaatatgaatcagaggaagaaataaccaataatatatctaaattaacattgttcaatatagtaatttcggtttttgtaatctgcagacctgttcgccttattcctattttgaaacatgtaggatatatgttttttaaagtagaagtattttttacttgactttgttttccatttgtcaggtgttttgcaatatggatgtcaatgggggaggttggactgtaatacaacatcgtgaagatggaagtctagatttccaaagaggctggaaggaatataaaatggtaagatgcaagaatttatggtgctttttggtgttttatcttgaagttatcttctccatactatatgatgaatcttggtatttttaggtggttttgagttatttttgacataaaatgatacattagtattattttcattagacacaaaacactcataaatcactttcagtaaatgatttccacgtgtgcgtcagaaagaaaaacgtattactgaaattatttggtgaactgttgtgtattgtctgtatttgttcctagttgcatgagggtgggggaagctagaactcagaccttcgttggatacgtgagcctgaccaagggagctgtgcagggttgcaggttgtggaacaggatgggtaatagcaatggcctcacccacataactggctaattgttgctggctgttgactggaagcttctcccatgtgacctttccatgtggctaagctaagcttctttcagtaaagtgatccagggttatcagacttcttacgtagcacttgtcatcctccaaagacaaagcaggagctttcagccttttttagttttattagacccagaaatgaaacagtgttacttccattgcattctgttggttatggttggtcacaaggaaagtccagatttaaggcacgaggagtacacaaaggtatgaactgtgagccatggctcactggggtctgcaaaataacagcaggcatcatcatcatcatcatcatcacagttcttctcttttttaatgctcaatatgtctgccctatatgtaatttcttatcaatttttaatatcagccctattaactaacactatgcccattttaaaaggaaacagagatgagcaagggttgaaataatccaaaatccagtaatcacatagtcggtgcctacaatattaactattaaaatctgctgacagaatgtaaaggcatagtaatgcaggagaatctatatttatggattctcattcttttgcagctgaaacctctagataattcttgtcttgactttttgacaaattttctctcaccaggtagagagaaagaaatgctatactagcctcagttctgtcttgatattcttgcagacaatttgtaaaaactatggttgatttgcatcagagtttgcccattaataggctcatagttggtcaaatgacagtaaataaggggttttaataaatgaatggaggtttctagtggtgtcactgcatctacatttttatcagatactcagtcgaacagtctgaaagcacgtttaaaaagtttggacttacacaaagttggaatcctgatgtctttgttatttcataaactcaagatggaaaggtaggctgaagccagcaagatataattccacagagatgattgtagaatatttcacctagataaaaaatacctaaattaactctgagaaaacagggtaagggtgacaaattgccttaaggacttagtatttgaaagagaggtttatttggttctaagctcattttgaattaacaaagattaatgtactcagtgtacattactagtagtttagggggtcacataaaatgcagaactcactggtgtctgccatgttctggttacatcaaaaacatagtttcaattctagaggttttcaaacaagtgaacttatcctaggggttataagcaggatgggaggaatttagaaattacatctgtaacaggtaaacacctggagaaaaaaagaattaggcataaacctgatagctattttagttaactggatggaggtaggtgatagtagagcctgcttctcaaaatgtggtccagggaccagcagtattagcatcctctggaaactgaatggaaacacgaatctcaagctctggaccagatttactgaattagaatgtgcatttgaacactgcctgagaggggagtgcaataatgaatggagtaatattccaagaaggcaaaatttgaccaagtatgaacaaaactctctaatgattaatcccaacatcaaatagactgcctattagtggggcaagcccccccccccccccatcttcagtggaaatagaaagtatatcattatcttttgggattggtatggagaattggaatgctaggtcagatttgaaggcctcttcctacctaggtgattctaaaaatatatgagggataaaagattatctatattcaaaaacaaaaagactttgaattatgtttatattaacagttataggccaggcacggtagctcaagcctgtaatcccagcactttgggaggccgaggtgggtggatcactaggtcaggagatcgagaccatcttggccaatatggtgaaaccccgtctctactaaaacaacaaaaaattagccgggtgtggtggcacgtgcctgtaatcccagctacttgggaggctgaggcaggggaatcgcttgaacctgggaggcagaggttgcagtgagctgagatcacgccactgcactccagcctagcgaccgagaaagactctgtctaaaaacaaaacaaaacaaaacacaattatagtcttcactctgccatttacaagaggagagattttcgacagatcacctaacctgcaccttagctttctaactagttaaaataggacaatgataatacttcacctgcctcacagtgatgtttcaaggattagaagtaatgtaagtaaagcactttggcacactgaattttcagtgaacagtagttatttttattatccaagatgaaaacatcaaagcaaaaatttcacttaactatgccaaaaatactgttttgcaaaccatctgaattcatgattattttcaccactaaaatgtgatgtgaagaagtcatctgaaaatcagactgtagatagagactcaggctaatctgaaatacattattattaaaattaatgataacagaaaaataaatataaagttgtcatcatggtgactttccaaaatggtgaattcttaactgtaaacatctgctgccttggcaagctaggcatgttaagtaagagatactgacttgttaagtatggaatcaattcatgtcttgtaagtatttaccaaatatatccatttctaagcaattcttttttcattattggaacaaaactgaaattctttaatcatcatgttttatggagtttacccctcctcccttttttaaaataagaaaggctatcatgctttattcaaacttgaaacatttatcagatgaatgtcaattttgcatgatcaaaaaatgagataagctccaacattttgaaatattctggctaaaaatgaggctgaatttttttaattgaaaatattcatcatatgttacaagatggttaaaacacatggtagacagtgtttcggttctttctctagagtttttctttcacctaaagacaaaataacatgactccaccaggaatggatatagactccttatgccagttcttatcaatcacacctacttctatttcctgcatccaaagaactgcctgctcacttcttcagctaagggtgtacatccttcgggataacaagaacttggcatgccccaactcttctccagtctttaccaatctactattatatatactaggatgctacatttcttccttgggcaatgagtgcagaaatcaagttttctctctctttcctttctgcctttcctctctccttccttcccttcatagtgattgatatctatgggctgcctcttgcttcataagatttccatcacatgtaattacaaatatatactatatattatcattatttttaaacctctgtcaatatgaaaggtttaccactttttggattctcggcattggctttaagcctacaagtatcttacctaagcttagctgtcacttaaccttcctcatgaggagattcagcaaaatctggtttatggatttgtaaagatgtttgtctgaaaggaaagtctggagtaggctttttaatgaggcacttagggaagatattagctccttcaagtcataaggataccctttagtggcctccagcagtaacacttatcagcagtactttcacatataaaacgcaatgaggctaggagttccagatagtacccaaaatggcctaattttatactgttgtaggcaatgactaatgtcctggaggcaaacttgctttattttgagaacaattacccccataaacagagcttcctatccactcaaaaatttcagtgtgagcaccattccttctgggagttctttgtttctggaaagaagttgagagcacattttcagctatattttaacatcttcacattaaaaagagaaaaatgcatatgaaattaaaaattttgaaatacaaaatttgtttcagtctttcttgagttgcacgtctcagcatttagaggagatgcacaatttaactgcatatgaaagtgccctgaaagccacagcgctgtcttatctgttttttattttttaaataatttgtgtgaaaaaagatgcaacccatggaatacatgggctgtgtctggtttcaattttacttcatctataaaaagtcaacgcttcctgagagcattatcagacaaaacaaataaagtatcagagacaattattttattaacttggaaaagcacaaaccaaaattgaacatttctgcaggttttggcaaaaactaacaaatgttgatctttcctttgcatgtgtttttgagtaatatgtgccttttaaggccaattttaagtcagcattagttcagattaaatttcagtgtctttttatccttttattagagcgttagagaagaaataaaatcaattaacaatgtatctgagttactgaatcaaaacctttcaggtgattgtgtttgacatcattaaacatcatttttacaaaagtacatggcatagtatccttagattttattcatgaaaaagaggaaattgtattgtaattgtttactcattcgttgctgctttttcaatatcagcacagaatttcatatatactttcatttttatttttatggaagttacaggctattgggggtaaaataaagacctgtggtaaactgttatgtgccataatgtgtaagcctattttggagcatatgcattggttgactctgtcttttaggcatgaatatgaatttttgaaggacagtcccagacatgtaatcaaaatttgcctccctatagggacctcagtatgaagatgagattttactcctgcattttccctgtataccactcaaataatttgatttaattaatatgttctttttagtttgcacttggaatatctattccacatcatatttatatggatctctaccttcagttcatagcagacttacatgtgcaaccttttacatgtatagctctccctctgagtccaccccagacatactgaatcagaatcttcacgggggacctaaccatctgtatttttttaaaacccccacagctgtttctgatatgcattcctggttgaaagcaattattacaaatattaacttattagcatggtataataccttaaaaattacctcttgtgtagctcctaaaactcgtgagatatggaaagagagggcttgaaagagatagcactaagggagagtcgaaggaaacagatacttaagtacttggaagcaaaggtaagaataagaaagtagtctgtgctttcattagtactatagtttagtcccaattgaaatcagttggttgtaatttcttatttaataattaactttttggattaaaatgacaatactcatttgtataaaccaactctcaatttagtaaaatattacattagtcctctgagagccttttaaataattatttcagtatccctttattaatttttgggctaatacaagacccaagattattctttttccttttcttatacaaagtagaaaggaacttgtttccccacatatgactcacagtctcatggaagagaagcaactaaccagaaaattactgtgtattatgacatatattttaactataacaacagctagatttttaagtgttttctgtctatcagtgctcagttaagtgcttcggttatattatcaattttattctcaaaaccttgtatatgaaaatgatgtctgtaatccctgttttgcagacagagaaactgaggctcagaaacaaagtcgatatttctacagcaaatatgtggcagttcaaggctttaatctggagccagagataaggggtagaggttatttcatccaagccaagcctttgtcctacatatcagatctgtggtcatgcctggtaaactatccaaaagacagtttactaatgtgggaacacaattccccttctttcacgtatttttcatctttataatgaaacagttgtttctggatcactgcacttggctattagaaggtttcctccctatattgcagccattttgattcattgtactcaaaccttttgctctcatactagagcatgcttggacagttttttgggaaggagctcgaaataaatgttagtttctaaatgcaaattatactgcgttctttttagtcacttcttcctgaaagacaaaaatgcaaactgtttaggaagggatatttatttccatttagagggaagtacaggcctgcatgtggagacagggatggaggctgtcctaggaatgaggctaatgcttgtccatttctaaggctcacccaggatcactgcgtgtttccctggggaagttggagagttttatccacacagcgctttcaacagcatggaaatatgtgacccaaaacttaacacttcatcattcccagcctctttattcacattgagtataagtgttgaatcccttttcaatgactgcacagaaaagggaatcatcaagtggcaagagggagagttttgacatgtctgagctgcaaaaaaatgcaaggaaaatcccagtggtcttctttttcttcccaggggctgttgtaattgataaagtgctaattctttgactttcagcctcctgtaactttctgttttgtttatgctttggagaaggtaagctttgctcttctccttagtaggtagcattggctgccataaaaatgtgtaaaattcttagcacaccagaaattgctctaatatttcctgccactgtgaaacttttacaaagtgtgacttgagcatcttaggaacagagaagtaaagagccaatggagtactaacttcagtggtcttatagctttactgtgagctatgggtggatggtcttcagaagagtatatactcaatgcaatctggaccaagcatattcagcctatcaaaaaacttagttaaattggggaataactttaaaagtgtacacatatgttaattttaactttaaatataacagtatacatcacatacccattaataaaaaaaaataaaacgagggccaaagcctggaattctgtgtcatcagttctttcctaaaactttcccatagtagaatgcatccaatctctagtttcagttttttaaaaatagaacagtacatgaagacacatgcaaggcaatatgttaaaaattctttaaatttttaaaatttttcccagtcttttagagttccaacaattcgtaattttaaaaaaagttttactaatttgcttttattgagcaaatccggatatttataaaaaattaaaactctcttttcccactaatatttaacttatttgcataacattttataaatattgcaataactgaactggcataaatgggtttggtaccaaacacctttgaactttggtaagtaactcagttggcagaggaggtagtgcgcaagtgacccagttgggcactttaagaaacatttcaccaagactcaactgtactgtctacaacaagaattgtgctttaaggttacttttccatgtgttattgtaaaatgctgtaatattttgttttccttcctccttacctccatttctctctccctttcttgcttctttcctctatcctttcctttctacctttttctttgaatttcaaaacaaccctattggaatgctcagtgcatgtcagctcttcactggtttttggaaattcacaaatacaacacagtttctatcatcagggagctcacaacatggccagtgaaacaaatatgtagatcaagaattacattgaacttcaagcactgccaatgagtattttctgaggcaattgtgaatactccaaatctagaatgccagcaagtttctaggggttctttcttttcctatcactaacatctccaacattaagcgctggctttcttttgggaccacttttttctccctacaaagaaactattttgaatacttaacaaccttgacttcccccaaagagaacaataaagtcatgttgacattcagaagccaagcagtcagctaggttcactcaggagcacttacaaatcagccttctgcctcaaaattccaatgccagtgcagctttgtaaataattacagtcatggatttacagggttgcttattaatatttaaaaataagaaagttaaagctccaaaagtcatggttctagtaatctattagtttggtgcaaaagtaattatggtttttaccattgaaagtaatggcaaaaactgcaattacttttgcaccaacctaaatatgaagttattgttgaaacataattgcatttgtgaataataatagtaaaaataatattgttaaataacttgtctaatatcactctcatagtgttcattgaaaaatctttaaactctattcaaaatattttgttaactagtaatttagaaacattttcaaaagcaaaccttgaattgagaattgttttccagttaaacctattaactagatttattttatacaaaatgtctcatccacacagatttgaataacagaggttttattgtactaagtaagaattagacagaagctttgatgaagagacacagaattattgaaatgtcaatcactggagaaaaagtgtaaaatgtaaaaaacaaaaacctttactttttaataatttttaattattatttagaaaatagttaaatgctgaacatgaaaagaattcctctctaaagtaacaactgcatctctatattgtttcccagggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttgtctagacctattacaaagaggtacaaaaaagcctgtaaagactttttcaaagatttaaatttcagttttcgtaggttgactatctttgatattggcttaaattttagggaatggtgaatgaagtcaagcatactgttgttctgtggttatcatgcagttgcagtgaattcatatatataaaactgataagtttcatactcaaactcattggcttaaataatctctttattctaaaaaaagattttctggttctactttttttgatgacctttcttgaattagcatttttcaaatgatcttgaagatgacaaaagtaaaatttttttatgtttgaatgatttacataaaagagaagatgaggcatgatttagagggttttcttggtaaatctaaaaagcaaaaataaattgtaataatggcatcaatatacataatacatgattgcagatgtaaaaatagataaactatacacttaatgatacatgtttccaattatcctttttcaatgagaagctcgtctactagggaaaaataaacacacaaaaatatggctaaggaaataatgtgatgtggtggattcattgcacgaacacttattgtgttacttctgtgttcctggaattctactgggcgctggtcttacagacgtcaaagtcaagctttgttactaactaggtcactaaaaactggctggcattccttgggaacagggaagatattttagttactcttctactgctactcattaatgcaattcttgatgcctagcaggtctttaattgtgtgtgcctcagtttcattcttagtaaattagagttgtaatgatttttaactctcaatattgtgactgctctacctctgtcttgaaaatatgattgtatgaattaaagggtgggcacattgcttcaagtaattgcaacaatagcaacccaacccttgcgtgtgttttgtttcaacctgtgtggttatctcatagttcaactgtttctgctgcttatttgtcttttcaagacaaaccttttttttttaattttttaaaagtttgaattctgcatattttcataggcacaactcatttcattttaatggattatgtatggggttggatccttggagacataataatcattttctcgacaaatagtaatgatgtcaccacaacagagaatgagaaatagatctaaaagagttgatagtctcatggtgggggtggaggggaagcgagggtgtacttaatggcagctcaagaaaccaaagaagagacatttataaaatgcaatggagtgtaagaagaaatgtttccaaggaggtcaatattttgaaagttttataacaagaaaaccactgttaaacatcagggatactcttatgtaaatgttttgacctgaaacttgaaactatatgaaacttggctaatgtcagacagcctgacaataggactagcaaataattagtctagtcttttcctaggctcctgaagaatttgctttggttcctttccaaaatgtctctcagtttttcataggtnnnnnnnnnnnnnnnnnnnnaatatatatgaactcttcaagcctcacacacatgcatatgcatgtgtacacacgcacacacacacacacatacacacatatatatacatatgagcctcatatatataattttgcccaaaaagggagaaagacttaaataagggatgtctaactcctgcctcattcaatgtggtttctgttctgtcatgctgctgacatgaagttagtggttctggcctctttcctgcagggacctaacagaaagtagatgtgcagtcatcattttctcatgcaattcaagtatacgattcacgttgacatgaaatgggaaatgagaactcattaaaacataatgcttactctggtgaaagattcattaaagtaaacacactataagatggtgttattcgctttttcaaagaaaaatggaacagaagcctgaaaacagaagctaagcccttgcaacttttctccctgcctgtatcatcacgtatgcccagtactgcttctctaggcccattaatgcctcccgtggcctgcagttagaactcacattgtccatcactgcctcatgtgctttttgtccattcatgtctcgtccctctgaattggcgtgtgtctttgtgatcaattgtttcaagtattaatactaagatttgcacagtattccataacctatgaaatgatttttaacactacaagcatataaacctcttttggaggtaggtattattagacacattgtttttttgagacggagtctcactcttatcgcccaggctggagtgcaatggcgcgatctcggctcactgcaacctccgcctcaccggttcaagcaattctcccgcctcagcctctctagtagctgggactacaggtgcctgccaccatgcctggctaattttttgtatttttagtagagacggagtttcaccgtgttagccaggatggactcgatctcctgatctcgtgatccgcacgcctcagcctcccaaagtgctgggattacaggagtgagccactgctctgggcctagacacatttaaaaaataagaaaactgaggttttggtcagttgacttggtcaaattcaactaaattccgactgaaatataaaactatgaaattcatactaggtttttgttttatattttttgttttctataacttttctcaaaaattaaattaaattaaattaaattcagaattgtttgaggttttattttctaaaacatattctatcatggaaattttgtttgaaaattcttgtaacaggtgtggtcctaatgtttaaacctaactgtggtgttgttttttaaaaaaacatttatcatgctcttgacatattaattaaaagaaagtgttgtgaatggatagatgagcttataaatgtgcatgtattacacatatttttcttttatcctctaaggaaactccaaataattttctcagatagaaaataaaatctgtagaacccaagagaatataaataagaaaaaataataatgtaagagtgtcatgataagcatagcatatgaactaacatgtatcaatgtgaaattatttaatacttcctctagagaggtagtattatccagatcctcatcatctaacacccaggcaattatagaaccttcctgcctctttagtcttcatactctcatatatatcttccatgctgttgttgagatgatttttctaacagacaacttggtctttccctccttcatatatttcaacagtgttcaaatatctgcaggtaaaagtctaccactaagactcttcgtgacctggccactacctaattatgcacctatggctgccatacactctccctaactttacctacctggatacccttctcattaacggttatgttctggtaactatttgcgattgccctaaatcctccatgcctttgtttatgctatattcttactcactcaacacataaacttaactttgtcacatggatacatcttaaatctttaagattctctcttattccaagtcttccctgatacctactgtggtagatgtaacgtgtcaacccattgcctccttcaatactaaagcgcttctttcttccacttctgggaaatgttgactgacaggttgcagctgaagtcccctttccaggcactgtttgtagttaaagaaaaattagccgggcgtggtagcacatgcctataatcccagctgctcgggacgctgagacaagagaatcacttgaaccccggaggtggaggttgtagtgagccgagattgcgccattacactccagtcagggcgacaagagtgaaacgccatctcaaaaaaaaaaataaaaaaagaaagaaagtaacatcacccaagattacttcttgcaagatacattgtatctaatgactggtcaatataagaatatgaagaccctcttgccccaatttggggcaattctgaagagcccctcagaatccaaaattccacttcagattagttgaagtcttcaccatgacagcatgtgagccctgaatctccctttgctgagttctgcatgcttcactctgccacggatcctgggacctctcccttctcaacctccctacactgatttcccagagaaatgcatcaccctcattcttaggccaatttggatactctgtgctcccattgacccgtagcactctggataactatccaggatccaaatcctgttataagtcattaatgagtgactgttaactatctttaacttgtgctctctctctcccccccccttcctttgagtgtgtgtgtgtgtgtacacgtgtgtgtgtatgtgtgtgtgttctaagcttttaaagtgtagaacccattttggaaaaattcaagatatgtaactaatttagccaaattactgactaagctagctatatttgaggcacacatactatacaccagatgtcttgttttcacaagagaaaactgaggcatagtactttgcacaaggtcacaggcactgataacgatgagtaggagtccgatttgaaatttggtcttataactacccaccatatgggcatcctcaaataaagaagttcatcagttaatttctagaattaaataaacccaaaacacatactctaagatatagtatatgtttattctaaccctacttctctctttaataatttgaatgcctttggacacattacctatctttccagttctcaattttctattcttacaagttaaagtatttgtaaagcaccttgtagctcaaaaattttctacaatagaactacctttacctgtgcatcactatttttattacctttcaattctttgataaaaaattaaatttgatctctctaataaacacttgagagtttattatcagtttaaaaaaacaaatacacaaccaccactgcaacaataaatgctttaaaaatattttaataatagcagatttattgtagggttgaggagatgctatgtccactggaaggagctctggagtcggaatcaggatgtggaggctgagaagaaatctggctctaccacctgggaaactggcatggttgtatttgtcagtgttcagtcaggggagcagagccatgatgagtcttacggaaataaggttaaaacatatgcttgaaatttggcatggcagacaagccagagcttgtgaaaatctaagaaaccaaacacgtgtagccaccaaagtggaaccacaaaaggggaagatctacagaaatttgttgccttgctgtagttccattaaatgaggttgtgcagtcaagcatcttgtggtgggtctggagctgttgccagcatcaggaagacaagctgggtgctaagtgaagaaatacacaatgtagaaactgtcaggcatctctgcccctggacttcaccatatctgatgacgttctcagagtcaggccactgcttcactttcgccttccaaatctcacacaaaattctcttttagccaaccccagcttagaaccttacaatgaaggggattcagggaaatggagtacccagattaaccaagttgatattacttttatgcctcagttttcttatctttcagtgggaataatatcctcgaatcaaaaagagtgtacatatataccttgtatttggtaaacttaaatatcatgctaatacgaaagctgtttagagactgggtacagtggttcacacctgtaattccaccacttagggaggccaaagtgggaggactgcttgaggtcaggagtttgacatcagcctgggcaacatagcgagaactttgtctctattaaaaatttaaaaaacaaacattcacttggcgtggtgttgcacacccattgtcccagctacttaggaggctgaggcagaaggattgcttgagcccaggaggttgaggttgcagtgagctgtgattgcactgctgcattcaagcctggctgacaaaacatgaccctgtctttaaaaaaaaaaaaaagaaaagaaaagagcaaacagactttttaaattaaatttttatcatgcccaagaaatatattattgagtcaataaacaatttttaattatatattctatatcgaaatcaccactattgtctccaacaatgtccttggctggttgatagttgtttatttacttggattcaggatcccatccagcttcactcattgcatttgcagtcatgtctcttgagtcgccttttacctgaaacagtctaccactcatctatcaattacatttttcaagactttgggtcagcttttcccagaacagctctttctgggcttatctgactatttctttctgattagattcagattaaagctttcttgagaagaatactaaataaatgatattgtctatttcccattctatcacatccaaaggcacaaaagattaatttgttccattattgattgggctaagcttaatcacttgttaaggttttgtttttggttttttaatggaatacctattctctccaaaattcttacaaaggatcataatgtatgaaacacgtaaagctgatctattttgaaatggttgtgggaaggtagtataatatttcctcttgctattatctcaaacattagtacagcacagtttaaaaaccattgtgttatattattataaataaaaaagtagaatttaccagttggaaataaatttcactgtactatttttaaatgttaaaagaaaactatataaaaatttttctgccttaatattaaaaggacacaattttagtgaacatattccattataaagtcattttgcaggtaatttttttcagatcttgggaacagtttgttccttacagttcattattttgttgtcttttatgctattaacttaattagtaaatcctctgtcacagatggtatcatgagcctctcttttaagcaatagaaaattagtattagttaagtccgaatgataatgtttaacattttttaatgcacatcttgtcattataatcttactacataatttataatgcacattttgtggatatttatattttattgactttatattatttattgaggataaatgacatcattagattagaactgactgttgatgtctatcataagccttgttctggaaaagattccacatgaagagatgaacagaattttaaaccaaaattgtgaagaaaacaacctgaaaataatttggtcattaaatatctttttgcgcaagtttgtttttggccaagatcttcattgggaagtagtttgatgtaatttgtaaaacactgtatcgggaatccagagacatgaactctagacttggatttgcggttacttttctgaatgaccttggacaatttgcttcacttttctaagtctcagatcctcagaagtaaaatgaggaggtaaggctgaagttctttccagttccccaatccatttttttttttaaatcattaaagtactcccatgccgtgtatgtatttcaaggacaaaacaaattcatgtggattgaaaagaattctctcgagcctcccatgtaaatttaagccctacatttttgtagatattgcaaaacttgtttcattttttttttctttcagtgaaatgtttcttatttctctgatcctctgggctacatagtcctggatggaaccagtagcaaatatgttgaaatactaagaggaaagttatttttttacagcagttctggactgatcaaggtacgaaaaaatatgtaggaaatctcctggcagtttctacttccctcaattcctaacataggttttcaaactcaaggttttaaagagtcttatttgtgttttcaaataatttctccaacttggaaggtgcattacttttatttagactgtgatttttgttgtggttacttcctaaaacagagaagttgttttaatcatcaaaatttatattttaatccccttgactgagatgaattactgaagacaaaaaaggcttcctaggtcttcagaggcacggatgagcacattcttacagtcactttgcaccttctttaggtcttttaagtgttgggaaaatctcttcacttaaaaatgcagttgaatgtcagtctctagagtcttggatatttttcaagctgatgaaaacaaatgcctgcatgctgttaggtctaaggattcccagaggattcctgtcacagaatgggtaatgctaagactcagaccactgctgtcctagaaacttacaggttggcaaaagttgccagaaccagctagcaagcactgcctccaacaaattatctaaggtgatgtcctgtgatccactgctctaggttcccctactgctgttcactatcaaaaagatgatggctccatgaaatatttgttatgcatccatcatgtgctatcctaggataaaatgtccacagagatttcagtacagtcatgtatacgtgtgttcatgcaggtgcatacccatatgtgatggatatggagtggggtcggatggttgcagacagccaaacaggcaattacaatgccacgaacacagtcagttcacttacaatcacaaatatgctgtgactaaagagggctaaccagttttggaaggttgagaaagcttccaaatagtggcctaaagtgacataaatgtggcaaattggtattagttggggaatagttcagagatgggggtagaagagggattagctcagaagtgagactcagcacgtcttgctaggaaactacaagtggttaactgttgcttaagcttagagcgtaagggggtaataatgagcaatcatgatgctaagagaaaggagaaccgctgcttgtggcagacttgggacaggtaagcagccatggcctctgggggcaatattgctctgatacggccttttctcacatcaattttttcacactcaatattttgattactctgtttggtaaatatgagcaacaacaatatgcaagctactgtggatgaaacaaaaccccacagaactcaacctctatttttcaagattttattcactttgcctaattggattttcttgatcctttaagtcttagctcagtccatagagctcttcgtccttgattgggttaggagccccttccatgtcctcccactgtgctctgggcatgtctttatcagagtacacatcacactgggttgtaattgctgttccctattattagactgtaatctctaggaggacaggaacctcttcacaatgcttggcacatgtctcgaaaaaaaagcatttcttaataggtatataaaagacatattgacaaggtttttttgtgcattcaacacaggtgatttttttgtgcgaatccacacagctgactaatacatggcaattcttgatctagataccagaaattcaaagagcaacaagtcaaaaatcctgcctccaaaggtttatggtataaaatgacagttgccactaagatttctaataaagtatcatgtccttaagttccctggattgttgttgcttaaataagatttattttctagaactattaaactctaccttcttttatctttatctcttttatctttaactgcaaatgatatgcaagaatttctatattgcttgttggcaagtaaataaaaaaattaataaaattgtcccacagcatacattgttcatttctcttaactggctacagttttgcttttacctacataactttactaaaattactctcttaaaagttattatagttcttttgaaatcagagtctgccttcattgctttatccagccagccaaccaccatacacttaccgtgttactattattttcctggcactatgccagttgttttatttcttgaatgtgcatataggtaactagggtgcctgtttaaagtacagatttctgagtcgcacctaaagagattcttatcctgggttaagacctagagctctcagtcctatcaagtgcaccaaagtgatgctgatgcagaaataacactttggttacaccaaacagacacaccataccttctcttgtggggctaatagtttaggagaaggaaacaaaacatggaatagttgactcaaaagttttagctgaagtgatttagcatgtctgtttgatttttcttttgttttgttttttgatcaaggaaccatagatctttttttttttttttaatgatgaagccaaggactttttccctagaatgatgaagaaacacaaaattttgtataaatttatgtgtaattcacctttacactcacagtccctgggaaagaacccttggaattaggctatcattggttacttaaaaaaaaatagtggtcaattctactggagttgggaatggatagggttcattggaggagattaaatgggactgggaaaggcttcatagaggaaatccttagagatgtgtgaaatgagtaagcgctcatgaggcaagtatggtagttaatggcaggaggaaggacttgagatcccagccagaggagcaatgtggacacacatgcagagatgagagacagtctgccttatttagaggacagcaagtatttagaggacatcttgtatgcagggctttactgtgctacatataacagagggctagaatccatgacaaagattttcgactctagcttatactgattgtggagacaaataagcacactgatgactttggtcatcagaagaatctgctaatgcatgctggaggcttatttgcagaccttatagcaacacaatgtccaagtacaacaagggaaagtattttctctttgcaagaaacctcagacaatgcatctcaatggttttcaacattttgcttaccctctcctctctctatctaccccaagggaatgctggaaagaaagtttcttattgctctttaaacacaaataaaaaatgagaacaaatctacctcccgagaatttgtttagactgaaaaatcaccaatttcaatcacaagttttacaaggtcctgacttaatttttggtaacaaagcaaaacccataaactctctgagatggccattggcctggtcttttaggcaccacaagagggtcagaccagagagtcactcactggaagctgactctatcagtcacacatgatgccaaggaaatccaaatatgtttaagggactgtttgtgttttaaacaggggtcttggtgtcacgtgattcattttggcactcagttttttttttttttatgtattcttaaaaaagggaaggaatactggaataactatttatcttattttgaactaaaaacataatcactgagcatgtatttctgaaatttgggaaatatttcattgtcacagatctcatatatatacatacatatataatatatattatatatgtatatgatgtacagaatagagagcactctgtcagcactattgaaaggcacacaacaataacagtacgtgggtttgctattttctttggaggaaaaatttatcatgagttttgagcatatgcaagcttcatgtctatcactgcaaaacactaagaactgtattttaccagagttttgaaacaaaaattactgctaacactgttcctaatgtcaagagcttgggaagacctggaaggttgataagctcattttatctaaattctacaagatattaatgtttgtaagtgaaggggagacattaaaaatgtatattatcaaaaacttacatggaaatccagagtacaatttatacaggtgttatacaagctaatatctaaaacaatcatatgagaatcagagattaagtgaaactcaattttctaaagatttttcatcatttggggtgaggttttctgtagctttggaaatttatcttccttaatcatagcacagattcccaggaccattactatctcaaacatttttcatattttttcacacttttgtgtacatcttccattacacatattccaaaatgaatagcatatctacctcaggacatctgtagcttctgaaacaaataagataatgtcttccttcttaacataatggtaaaattattatgcacaaattctggtgattcccaattatccagttccctgttaaaacaaatgacaccaattgtggaaggtttaatgagaaaaagaaagctttcagcaagtagtcatgagaattaaaggctaggttggcatggatgatttttccaggaatttttttttttttttttttaccagtatcaattatgagtaaagaaaggaaaaccaaacaaatatatattggattcattcaacaaaatattatatgatggcaagaaaattgtagggttctcaaaagtctgaaattttaatttattaaaagataaacattttaattgaaggatatttattcagaccatctagagtcaaattaacatagatcttaactacatagtcagtcagcaaagcaactctttggtttcttgtccttcatgtttagtactctgcttcctctatagaaaataagaaaaacttccaaaggatatggggcctcatgggtttgagaaaattgatccttttcatctttaatttctctggcttgttgcctccatgcctgtcctcatgagctgtatctctatgtcattgtttttatcactctcagaacacttacatatgtctatcaaggtcatatgtttatacctgtgtaatttagacttagtcattcccgtaattcatgcctattgaactactgtatattttatggttattgcttaaggaagtttgattactttaatttttttgcaaatagtcaagtacttactttattttgcatgcagcagtctttttaagggctttccgggtatcacctcatttaatcttcacaaaatattggcaggacatagaggtattttacagatgaggcaactgaggatcagaaagaataagagctagattgcaaacccaaacaggtacactacaaactctgtgatgtcatgctgtctttccagacacaagtggtcatgacacagccttaatttgcagaagccaatggcttatttatttctccatttcgtgtgtgtggaggaggaggaaaaaaggaagagttttggttaatggctttatagagggttatttctttcattcgtacttattttgtaccaaattacctgtatctgcttgatctgtatatttttaaaatgtttttagatatctataagtctttatcacagccttaattcttgattagtcacactttacattatcaattcttttagtcttcctactcacatcctcttttctttggaaacttctttcaaacatttcttttctggattatagattattgtcatataactgaatgtctttaatatattcactcactttttcgtaagtgtattaactttgcttcatatatttttctagcattttctcacatattcattgataggctattgcaaataagtaaagaattctgttcatgtatggacaatagagttatagaatatatctccaggatgtgaaaaagtcagtgctaacatacatgctctgacatccctcttggctaatggtgcccagttctttcagtggaaagggggtaggattggagaggttgaatatggcagagacagcccagaagcagcaactagaaatcatagccacatcaggaaactcttgtcagattgagccattgctaccagcctctgaaagagaaccatgaaggtcattttgaatttcttagtaattgtgagaaagataaactagttccatatggtggcagggagagaactcagagccaaaataaaaatctgctcagcttgtcagtacctacgaccttaaagttcagatatctgcgagtctgtctactgtttaaaagggttgaggccaaacttcaatttgtcatacaaacaactcccactgccttggatcatgaaagagacacttggccacctgagtatggtgaagatgcaaaaatgtgaagagagtgagtctcttaagtagagaaaattagtaagaaactgggttcatgagattgggctgcccattttaaagaaaagaaagttctagaatctcttggatgatatataggaatattttgaagcctgttcttccataatagaactcactgttgtcctatattcattaaaaaatgtgatgatttagtctttataattactgaaatttctaaaagtgattgaaaaggagtaacttttatcaaagatgactagagaataatgactaatttcaatggacatcagttttcccatgatatgctaattgaaaaaataaaaatgctgacattctttatagtcatccgtcgaagggactcatttttttttctttattaggagaaaatacatggatgagaataaatgccataattctatgtcgtggctgctttttggtcacatcaaattagattctctggagttttttgttttgttttgtttttcacagcttccttatgtctgtccctaatgtttttttctggaggaacattttgtttttatcttctaacatatcgtctttcatacaggccatgtctacactggctgaacacaagaaataaataaccaggattcccatgctgttattttgggagatgtattctaactaatgtttcacacttccaattcactgtcacggtagtcaggtgcaaagccatcctgtatattgatttttctttgataaactgaaagtctatttggaacaattattagcttcatagagaaagccacagatgatagttaattacacataaggactagatattagccagaaccagtgttaaaaagaatcatccaaatgttctgtttgagcctcaactcaaagaagttttttttttttaaatctaattacagaaatacttggcactaatgagtgactggtccttaatttacctgtatcaaataactagctgtggtcgttggctttgggccaaaaattgggactctgagctagctaaagagctgctaagaaagaatgagcccctgaactgtgcaggagaccttctctggactgcatagtttctcccagagtccttctgggattccacagaagtacagttgtcctcatgtgcaaagtttttaaaatattgtttagaagaaatgatttttatgacatttcatctttatctcccagtgcaagagactgtgtgtctcttccttagaagagcataagccgctcctctgtgacatgctaaggatataaacatggggggatgaatactacttcatgtaaattacaagtgctactaagtatccaacagtgaaacattcattattcctcaatatatcagtcccttctacttgtacatcatttcaaccaatatatgtcactgtttacattgcacatcttgagacttctctctacttctgctttatgttttaatgcttaatctgggcaggaccttaaggaattatgttcacaccttattagaatatttcttttttaaaaaataattttagctgaaacactaaccttaagcatatttttattttgaatttgctttcaaattgttttcagttggctattcatacaatacaaataaattgttcaataaaatgtaaggaataataggaattaagacatggcctttttttcctttattctatctgcataatgccttgctcatgtttttatattctggagtctctgagaaaataagaacaaaaacaaaactggaaagataagaaggatgtgagagactgtatctatgtacacacacacacacacacacacacacacacacacacaaccctacatgtgtattttttaattatttgagttggatgggcaatgaagtgggtacccaggtaggtatgttgagtacctaactaaatgagatgtaaaagctatacttctgaaatgtagaccaagtatattttgatattagagttatttatatttgagtttgcttttgcttgctaccttgagcttaccaaaaattaatcagttagtaaacccatcatccatctagtcaatgaacattgaggcctttctctatctcagagactgttcaagatttcaagattctgatgattcaaagatgagtaagacatagtctatgcctcaaggagctcacagtttattatgggaaacagaaaagtgaaaagacaattaaaatacagcaagtaagtgtcatcatgaagatgctgatttgatgctctttgaggttatacttggaacaaatcttaaaggatggataggagttcagcagctgttcaaacctggagagtaccttctaggaagaggggatggtacttgcaaatgtatggagaaataagagtgttgcttagagggaataagtgagtgggtaaggctggagcactatgtgtacgtgcagaaaataacaagatatgggagggttagggtgggtgagacatgggaaaaagtagacagtaaaggactagacttcaaaggccttgcaaatcacagtaaaaaatttggactttatctttgaattttggaggaacaaccgagcaactttaaccagaatagaggaatgatgagatgcatgtttttgaatgagctgcatggacttcatggggaaggggaagaagaagtgaaactcaaggcagggagactagttgtaagtcttctttgataatccagagaagaactgccaagactagaaactgacctccaagtcttaaatagatctggaaagatgtctctttactgatagcctaacatagcattgataacattcatacggggaaaggtcaggaaagaaatgtggattatattgtaatcctaatacctatacctatatacctatacctataccagcacacatatagagagatacctgaaggcagccttagtcttgtgactattgatgatatattcatacaatattttccaaatgattttagagaaaaaaatgtaatgatatgaaaaagtggtcacaaatttgtatttgaaaataatctcatacagaaacatgtaaagtataattctatttctatttgtattttcacatggagagaggttgtttttgaaggatacctctaaagagggagatgaaatggggctgtgggcagaagctttacttatagtgttcaaaaattttataagaatgtgttcagatacgtatatatttaaaaataaataatattttatatttagaggggagaaacaagtaaaatactaaaaattgttaatatgaaaagagtagttatactcagtgatgagatttgggttgatttttatttcttctttttgcttttcttctcaaatttataatcatgcatttgtattgccttgattacacaaataaataattataaattatgagacttagattgtaaatcttatgtgaaagggtaaaagtataaactatgtattcaagcacatagcagtctcttatttaaaatcaaacatttgtgctgaattccctgcaaagacactatagaaaatcattacatcctggaaagtctgtctttattagtgagcttaaagctactgcggagaaaatggcattgacttaccgtaaaaaggaaggccattacaaatcacagagaaacaaaaaatcagagttaaaattgccattgctcattcaagagcgcctatgggctaaactctcccaggcccagtagagcagatttcacgctaggagagacgtagctacttaattttggaatcattcacttattctctcaattctgattctgtcttcaccaaacaagtaactttctgattataatttggctttctgtgtgaaattctctctaagaagaccatgagactgggtccccaccatattcctacttggactgcaaatggaggcctgacaaaagtctcttgttagttttgccaatgtgtgtctatctttgggaggctgaggacctccaaagaagtgattgaattgaaagttctcaccagctctggaaggtggcgaattcacccaggtaacatgtcccagaactccctttggtgatctgtcatcttactttctcctggtgaaacccacctccacgtgggctggctgcagcctcaaatgtgaattggcactttaaaaaattctacaattttgcatcaccagttacttgtagtctgcctctcagagttttaaaatacaagcttgtatgtgataattcaacattagaagattatttgtactactgtgaaccagaagttccattaattattgaaaccaacaaaaactgactgaggtttacttgtatactttgctctggctcaaaatctctgcagaatatttgtaaaatattgcacaaacatccaataatattgttttttgctaaaaataatatcaaataccacaaacagtaggatatatacatatacctagatgaaaacacaagttaaaatatatctccaaatattaattgatctttattattctatttcataataatgtaatgttttgctcagagccagcctaggttttaggagtgtctcactcatacagagatgtgaatcacccattaactatactgtgggtggacaggattcataaataagacccaggcatacaggtggtgacctatatgaatttgaaggggatattactacatgattctgatgaaaacattgtgctggtatggagaagcagtgttaggtagagttagagagagaggggctagagtcttagccagagaacaccttgagcttcaagctgtcgatacgacaacttcagtttagctactctaagccctatggagccactgaaggacgtgagcaagtttacattagttctaagcactacgttgcccagaaggatatgaaagcagcttgtacgatcagtaggaaatgagcagacatcagacaggtcactacatttgacaactattgtgatttgcccactagttctcggattctaggacaatacttgtcaaaatgttctctttggacagtctgcaaagagaaatctgagatgctagttgaaaacaaacattcctggggttagtaaataggccttttaaacaaaagatcagatgatttgttatatgcacatccattagagggccactgatctaggttaatgcaagttttatataagaaatgtttctagatagtaagagaggttcttcgaagaatgccatattaaacagatgggattttgaatttaattttagggatacctctagaatacaagtccctcaaaagcacagatttttgttttcttttcttatatatcttaagtgcctagatcaataactggtatgtagtttgtgctcagcaaatatttgtccagggaatgcataatgattcaaagcttgagttttagactcataccagctaaattccagcttacatagcttccctaaaccttagtatacaaattggggatattaatgtctggatcacagatttaatataaaaatttaatcaaataaacactggaaatcatttaacatagtgcctggcacagaggaaatccccaatcaatgaaacttcctccttttattgctattaataatgtttagtacatctgcactattagatattaatggattaagggagtgacatgctgaattgacattgtaaaaagcgtttatgtttagaggttaatacctgtattaatacaataaacccaagtttttatgttttctggatcctgcagtatcagagaaccacatgagtttgagcatgcataatgaaataaactttttccttcctttgttcttttggttcagatagcttgggtctcctagaggtttgttggaagggctgagttcaaagaaagaagaaaatgatgaaaaaggcaaacattcaacaagctggtcttctgggttctgttattctgtcgaatggcttatctttcttttttttctttttgacttcaggttgtatttaaaaggtcacactgggacagcaggaaaacagagcagcctgatcttacacggtgctgatttcagcactaaagatgctgataatgacaactgtatgtgcaaatgtgccctcatgttaacaggaggtaagtcctatggggccattctctaagctatgtttcattggtttggggcttaaggtttcttatctatgagaaaggagtatgatcttatggtcaggaaacttaagagcaagtccctagagatcattttgttctgcccacgaatttaccctgcgttcttgtgtaagacattgctagcatatttagaggtttgcgtcctcccccaacatcaagagtgaaaatgtgctaagcttggttctgaatacatttttcagtctcttaagtcccagatattctactttctaaattagtatcttgatatccttagtaaaatgaacaatagtttgggaactcagcatatacagcaattacttcttataaaatacttcgcaattatgtagtaagttaattgatcattttgttgaaatgagataagaaaaataaagaggtgtagttaaaccaaaggtaacacagttcagaccagctataccagagttttgcattacataatattaatcattgcaagatattttagctagtataggagataccattaaatagtatcatatcatagagtaagaaagttaatccttttgtacattttaaatatttttccagccttctgatagccccacagagaaattctcaatttggtgctctcatttctgtaatacttcttcagtgatgtaatgcatcacttaccaatgatgcttcttggcaaaacaaacaaacaacaaaaaacaacaacaataacaacaacaaaaaacccttatccatagtctcagagccttggttaagcaatggcacatacctaaaattaaataatgttagtttgttttaattttatgagttttttatctacttccttttttttttttttttttttttttgaaactgagttttgctcttcttgcctaggctggagtgcagtggtgctgtctcggctcactgcagcctccacctcctgggttcaagcgattctcctgcctcagcctcccgagtagttgggattacaggtgcccaccaccacgcccggctaatttttctatttttagtaaagacggggtttcaccatgttggccaggctggtcttgaactccggacctcaagtgatccgcccaccttgctctcccaaagtgctgggattagaggcatgagccaccatggcacctggctatatctaacttctgttacagcaaatgatgctgatttcctctttaaatgaatgatataaacttgcattttagaatgcattcacaatattctgtatttaacaaataatagatttaaagaaaaaattgttacatattaataagagttataaatggatatggcaaaactgtgaagttgatacatgactgtctgaagtttgggaaacactaagataaaacccaatggcaaatgatatcactcaagaatgttataggctctggcaggaaaggagttgacaacaaacaaaattgtaagagaaattcctatttcagtgtttctcctctcacagttttagtgctgcttctctcttactgtaataatcactaccaccttcaattgttctgatatactttctgtcttattctgttacaaaacatgatttcatattagcaaggaaaaaattgttcaaatctaatattttcctttcccaacactacgttactaccattattaaaacatattacgtgtttctgcacatgttgtactatcttacttgaactccagatccactctgtgagatagcagggagagaaactcatctctatgttgtacatgaggaaaatgaatgacagctagcgtttgccatttcatcccaaacatctagcacagctgactgtgacacatagaaacttattagaaaatgtagtacctgaattagtgaagtagtagtgtacatgaatgagcatagtacatgaattaccatcttttaactcttgaaataactttcaaattttaaaaccaaataaataaatcattaggttgatgttatcttcatccacgaatagagcttggtagagtataggtgaaagttttggatgatgatgattatcatttttttgagaccaagtctcactctgttgcccaggctggagtgcaatggcgcaatctaggctcactgtaacctccgcctccctggttcaagtgattatcttgcctcagcctcctgagtagctgggactacaggtgcgtgccaccatgcctggctaatttttgtatttttagtagagacagggtttcaccatgtcaaccaggctggtctcgaagccctgacctcaggtcatccacccacctcagcctcccaaagtgctgggattacaggcatgagccaccacacccagctggtttgggataaatcttttgtcttcctccctatccccaacccctctattactattatcaccaaatcacagcccattgaccccatccatgccacctatgttgatatcttttcaatatgataccagccccaatattatcaaaactaacctattatgattctgcctctatcatattctatcatattctttctttctttctttttttttttttagacggagtcttgctctgtcacccaggctggagtgcagtgacacgatcttggctcactgcaagctccacttccagggttcttgccattctcctgcctcagcctcccaagttgctgggactgcaggcacctgccaccacgcccggctaattttttgtatttttactagagacagggtttcactgtgttagccaggatggtctgaatctcctgacctcatgatccgaccgcctcggcctcccaaagtgctgggattacaggtgtgagccaccgtgcccggcttcatgttcttttccttaatctttgaactatccttttggcatcatatttaacatcatcaaatattaaaaagtctcctatatgtaattttatgactcctccctcagccctcacccccaaaactagttgctacaaatctaatattttttttttaaatggtacacacaaggtaggtcttgagctttttcctgatagaaaatttttatttttattacttccctgatctcataaatgaaattgtcagcaactttatacaaagacaaagggactttgatttttcagtttcctgcacattttaatattgaaatatgctttattttctccatgtctattttcacagatattttttcttaccaaataaatacaatacatgaaaaaaccaacagtaaaatctttcaaatgtgtccttagaagagtattccaatatgttcatatttctgtcataataatgaaaatatggagtgaagcaaagagaagaatgtacatcttggttttcaatgagaaaacttcactgctcagatttatgattttatttctgctttaaatgattgaacttcgtcatgttctttcatccataattattcttggacccaattcttactcaccaataaacacatatgtttgggagagaatatttccgcttattgcttgggctggaatagtctaagtaaatgtgtttttgtaataaacgccattaccttatcaaatgtccctttgaaagaatccaggtcttgcaaagctatttattatggaaagctaaaatgtggaatttagatagctaagaactggagaacataaggatgaatgtcattgacagtccaggtaactggagtattgcctggaacttaggtcctacttagctactccccaccactactacttattctctgtcaaaatttcccttagagccattttcctcatctaatgatttttcctttccttttttttctttttaaacttagtatttgagcctgttgcctatttaaaataccctctcttaagcagtgagacttcatactctttggagctagtaactcatagctctttgtcatcatcaattaaagctttgttttatcttgtttatttatatatttttcctttgtttcttctaaaagggattaagagtaaaataagatttattgcccactaactatcctagttttcttcaagtacatagaggaattctagctggagaatctggtatcattacccttatcggtaaaagactgaatggcaggaaataggcttaactgaaagcagaaggtatttcagctagacccaaggtaggacttgatctttgttcttcatttcctaacttccttatttcttggctttcttctatcagtttaagggggttaattactattaaacaaatgagcaagacaggctagagcataagtttcattaaaaatttaaaagaaatagttttatctactatttaacattaagaaaatgaaaatgaaatctcattcaatgcatactttttgtatagatttattgtatatggagataaatatgtgaaaaattctgattccaaaattaagacagtgacaaatttttgttactagattgtcacattcaaaacaaacttaccttcagctaaaaaaaaatctttgatactaaattaggagttttcaaagtctgcatttctgaaagtttgcttaagctacagttaactaaaattattaatgttataattaaagaattatttctaaaaatctttcataaactgtaattattaaaggttgccaacaacaaaaacaaatatgttaccgttttacattccttactttagtttcagtataatttccatatttagtacataatataaaggctatgtaaaaatgtgacctaactttctgtagaaagaatctattgaagtagaaactctcatttcttttcccaatgcataaaccatgtcaactggtagacaagactttctaaagctaacgaaggatatttttcagttcagtccttaaataggggataaagccatacacgtaaatttcttagtacatctagaactttccagatgctaacagcagacagttgacaaacgctcactttgcctactatataatcttaaagaagacaaagaaaatgatagaagctagcagttttttcaactggtgtatgaccttgaagtgacaagatctttgggaaaatataattgtcttagcatttttgggaacccaagaaagacctgctaagcatgatcagataactaaaattctctgtttcaaggtaaaaatattgagagaaaagaagatccatatgactaatgtaagattgactatagaaatctacattgcactacttttatttcaacccaatttctatatttagtacataaaacgtaagcctattctacacaaatgtaagttctgtgaatgcagggattttgtgctgtccactactgtatccccagtggctgccatagtgtgtggcagatagcatatgttcaataaatattggtttagtgagtaaatgttagcagagactctgaaaggacatggcaaaattacaaattattctggtgaaaagacataaatgaatgttagtataaacgtgattcttgcatgaacttatatttaaaatgcctaatacatacatgtatttatatgcaccagcatggaacaaagagatgactatcaaagactgaaactaacttaagaataaccaaaccccaaaagactgaactgcagaattataaaaatttgagtgttaggttcctgactgtcaaataaatttgagcttcctaaaatgcaaagtttaagattacattcctattttctcgggcaaagtttcatttcttagaaaaagagcaaagagtatcagaaaatgtcttttataagtttggaaaaaggtgaatcagaaccgatagtcctctcgtgcaaggctacaaccaaagcttaataattgacagtggatgagaaataaccaattaattttgtattgtactcagtaataatatttaaaaacttattgagctctttctaatggatacgtttatattattctaaatgatttatatttaataacatatatgaagcttccaaaaactcttggaaatacagactacaataatacttttggcaagaactgagatacagaaaagttagataatttgccataggtcacagaattttgtcagaagtagaatttaaatgcaggtactcaacctccagaggcctttgttctatctactctttctactgcctccattaaaagggatgacattcaaagagaatgacagagctctattgtaccgtttgcagcatctttttgcaagcatttcctcatttaaacatggttaaaagcaaaatgaagtatgagggagaagagaggaggtaaaagaatacctagaagttttaagtgaatttgatattcctagccaggataaacaacttttcatctttagaacaaaaagaagagaaaggaaaagaaagaaagaagaaaggaaagaaaggaaagaaagaaagagagagagagagagagagaaagaaagaacagtcaaaaacaaacaaacaaacaaacaaacaaaaaagaaacaaaaacaagtccttggcctgaagaggatatattaagagatgacagaaggaatggacttctagcaaggttctttgcctcctgcatgcaagacccatgcagctgcttcttgaggcttgctttgcgtagggccaactttgtccacataaactcaccaagagattttttccattatgatcccattgatggcaccaatcaatttagtttaaactcattcttagttagtgatgaaagatgaaaatcttaatttctgtgcaagctgttttgcatactgctgattagaatgcatgcattgaaaacgaacaaaagaaatctacaaaaacaaatataccttttcattttgctgtacattttaccacagaaaagaagtgttgagaggtgttttgtttagaatcagaagaatttaagagttagatttcctgatgttcaaataaagttgaacttcctgagtacaaagttgagaatcaaattcctattttctgggcaaagtttcatctattagcgataaaatgtgaattttctgcttcaaagataaaagacacaaatgattttaaaaggcctgggatagttattactaaactaaattttaatgagttaagtgtaaatgaattggaaacatgaatctcagatttcttattaaaatatacatgaggttacaggttatgaagaaaaatgcttcgaaagtacatctcagcagttgccaaccttaagacatttgaggctgagcgcggtggctcacgcctgtaatctcagcactttgggaggccgaggtgattcgatcacctgaggtcaggagttcgagaccagcctggccaacatggcaaaaccccacctctactaaaaaaaatacaaaaattagccaggcgtggtagcggatgcctgtagtcctagctactcaggaggctgaggcaggagaatggcttgaacccgagaggcggaggttgcggtgagccaagattgtgccactgcactccagcctgggtgacagagtgagactccatctcaaaaaaaacaaaacaaaacaaaaaaaaaaacagaacaaaacaaaacaaaaaaacatttgagacattttatcagttgtcccaatagcagagggtaacttttttttcaatcctttgcttgcatcattgagttctttcaggcttgaagtgccttccctaaatgaattgctctaggatatttcttatttgttattcccaagcataaacaaaatacaaagtcagtgttttcccaggattgcacagaatatataattcagctattcagaatcttatcagagaggaactgtaaactcaggcatactcttctgtatattcatagaacatcttcatcccatgcagatttaccatatgtactgagtatctatgatcacctgtaaatacaaggaatgcatatgagtaatgaggagtctgctatacttttgcctgcattgaaaaaatgctttaaaccacatattttcaggatttgtgtttaaaagacttggccatgcttaatttttaaaaataaaggtagaaagtggacaaactgtttgaaatatttgatacgaacaaattatttagtttgttttaatgtatatatcaaagaaaacagagaatccttgcctacacagaagtaattacttcttctaccttgaagttaggatattttataataaaactgaaattgtcatgagaaataattgctcttttatttcattttcttccatcttaattcatcatctttattatcagttgctctgagatagatcacagaattcatggcccactagtcttaagataaagagttaattgaacatttcaaactccttgatttgtcatgaaatcaaaatgaaacatttaaaaaaattaggaacttaaatgccaagtttttataacatgaacattgtacagttgtacttatttgggtctaattattttcatatttctctaataaaccccactaagcaaataagaaaatatgttggcactgatgaccttgtctttattattaaattactgtgatgctccacaaggtcttgtctcttttttttctggcctaaacattctgccccattttctagataacttacagctggcactttagtaggattttacaggctgtaatagtgcattatcttatttgattcttataactgtgctgtgaaaatggttggttagctcttagaatctatgtattatgaatgtgaccttaaacagttccttaaactctgtgagcattagtatctttattatggtacttgccacatcacttaaggctgtttgggggataaaatgagaaaatgcatataaataccttcatatgaacgattcaataaatatcaaatactattggtactattgtgtaggatctcttggttatttattgatgaagtaagcatgaaaagtctgggtcttctaacttctgctccggcgctctccaggcttcccattgcccaaaagaaaatgtctaaaggtgtaataaaaacctttatgttttccctcctgtttattttttagccctatattctccaaccctttaacccactggcactccagccaagccaacctgctggcagacactctcccctggtcttccagagtacagactatatagaagctctttctgtccagtgaactcatacccatctttcaggacccagagcagctgttgaatgagtgagctttgtggtccctcagacagttagcacctactgcctctgtgtttccatcaaattttcttcttctcttagtttaacggctatcatctcaatgtgtagcattttgtttgtctcctacacaaaactgtgcatgctttaaagtcagaaattttgtttccaaaaatttctgtcccctatccctatccattggttaatatttgcagaattgattctagactcaattttctcctttttttttttaagctgtcacatatgctcaggatggctttggaagatcgtagagaatgaggactctaaaccatgtttgattaaacatttaacctagcagatctggttcttctggttcgattgtggttcccatctgtagagaatgttttacttgtttgcctgatcatggacaagcaggctggctaaactacaaattgttccataaacattgaacttctcaccaggactgcctattcctccaccttcatttcctgcaagtcatttcttgtttactgtgcaccagttgcactgatgtccctacacatcccaagcttgttttcttcctcatcgcctttgcaggtgctgtattctgcttagcagggtcttttcccatcttcttggggctgtctctctcctccttctggtctcgttaaatatcagcttctttcacaaatgtgaaaagtcaagttattctccttcagagctcctacgtattttcttcatgacattttaagtcataatttatattaggttggtgcaaaagtaattgcgttttttgtcaataacagtcatggcaaaaaccgcagttacttttgcaccaacctaatagttattttatgtgcctgcttacatatattcatctgtttctcccattagaagtgagtttcatgaaggcaaggactatgtctgtcttgagtattgtgtaacaacgtttcacaataattatatattgaatggatacataaagaaaaaaatgaatacaataaggacaggtgttacattttggggtatctatcaaatacagcattttagtaagctaaacaacttcagacaacaaagacttcacaaggagaaccaatcagagagtcaatcagttaacaagcctgcagtgacccgccggtcatttgggaagcaaacttcgttaggtgtcctactaagtacaggagatgggccaatatacaaaccatggctttccattgtttttaggatgatgaacaaaacactgggtgatttgcttcagaccctcttagcttcaggtgactatccccctcgttgattgtgacccagccatactggccttccttcaatgtctccaaaatgccattctactcattgcaaacattaccccactttattccttcaaaaagctacacaagatcaatttacctgactctctcacaggctcttactgtttcttgtctctttcctaagttttcccaaagtttcccaatgagcgtatcctttagcctgtgctctttattgccaggctgttgttgcaacagacgtctgtctttccgcactcctctgggactcctgtgactttctataaaccaaataaacaaaaacacacattttaccccaatgcaacttggaagagaattctatgaatcattgtcagtctcaacaatagagtaagtgtgtttgcttgagagaccatggtgcatatttgaaagactataaaaaagttcattaatgcaatggaaaagtgcttcaagaaggtcacagaaaaggaggagaaaagttaaaaacagaatcaatcaagttgaatttcatcttagagttttattttagtcctttagaaagagtcttttgggcaaataaattcactaatattagaatgctttttataatataaacagcatatttaacagctgtactgatcaaaaattagaagaattaatcttaagaaaaacaaaggtaggattttacttgcagttcctccttcttttccaaacaagaacctttttgtccctcatgttttgactacattaacatttatgttgtttgcatacagttgataaaactgcacggaatataatgtctttccaaattcatcaagacataccttgtggttccccactatgaactggtgattaatgcagcttgttacgcctctagtgtgactttataaacacaagccagctgtactcatcttctaaagttgaaaaatgagaactagcttttctccatttgacttcttctaaagtttctgcaagattgtgctcatgttacagttaaacatcagctgtacagctttctctttctttagctattagtcccttaggtataagtctgtaatcaaagagaggtcaactgtatccaaataaaaaatatgccagaatgtctctggcataaatctctccctaaagattcagtagtgttacttcagcagacaggaaaaaacactatgctttatctaaaaatctaagaacttaatttatttaaaaaataaaactgacttatccagttatccttatagagagctatacaagcatagaatttccatgttactcatcaagttgtttttctttttactaagtttggaaagcacttaaataaccatagacaaaatatggctgtacaggaactgaatggctactattgctgaacactttttctactgttataaactacagagagggtacgttaattaaaagcccttttgagcatcatagtcattgcacagtatccaattaattttagaagcagcttagggccaattattgacaaacatatgcagtagatggagaatatctttctatttagatctcagttgcttgtctaagtttctgcatttcttcactaataattaattgttctattcccaataacagtcttaagatggaatgcctcttatgggtatatgcattttccttattgcatttgtcttaaatgtaaatccatctcttatgtagattgtatcttgaagcccagaggcttcccatcattacaagaagaagtgagttccagtggagtcacactgaaagctgctttccatgagagcattgctgtctgtgatgggtcatacaaatcttaaatcagaagtcatttaaaacagtttcactactgggaatatatttactgatgcctcgtaattgcaaataagcataacaagaacaagcaagtttcccatcatttaatgccattaatttccaaatattccatttacttaaaattgttgcctctccttctctcttctattatgaattattttttcaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaaccaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggatatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgcaacttcattttatttttaatacgtattttgccaaatttaaattagagatttatgaagatatagaatcattgacaaaaacctaccaaatgaactaaagcctcaatcttagaacaactttcagtctgggatgaaataagaaagcttagcctcattagaatggtagatcaaagcagtggatctcagtcccatgtccctacaatatgattgtcatgtcttgccaattattacatgccatattatcatgtggcaacggacaatatattctgggaactctgaatgtagaataagaggatgtgtgttaaaaatctgagcttggtatacagggggaaaaggaaggagcgtaaagaagatgctacttgtctcactcacctgacatgccatcagcagtcttatcagtccttgcattcttacctttggccttgattctgctcctattgccattacattgattcaaaccttccttaatttccacctagatgattggaaaagacactctttcatcctgcctctctatgctgttgttcacctcgtaaccataaaagcttattccttctaaagccagacttctgaacatggtttttccctgctcaaaacacttcagtgtttcctcactactccctgaacttaaaataaacaggtcaggttaatctcagcctgcattgccagacagcttcattccacctactcagtattccaatcagaacaaagaagccccatggtcgactacttgcaaaaatgatgcctattcttcccctttctgtattcataccttttgcaatgcgactttgcagcttgttccataaagagataaactctatttccttactccctgaatggctaactctgaccttctgtagccaataaaacacaacagaagtgataactatgtgccagttctgagtctggtcagaaacattctacctttggcatgaaaaaaagtccagcatagcctaatggaggattagagaccacgtggagcaaagcctagtctaccagctgagaccaccctagaccagccagcccacagctgacccatgggtgattccagatacatgagtgatctcaactgagatcaactgagcctggctcagatagcagaactgctcagctaacgtgcattatcatgagaaacaataatgggttgttgttttaaaccactgcattttctttttcagagttttgttaaacatcattattgtagcaatagctacctgatacagaatacagtgctgcagtccccacctacccttctgccagccgtgtgagttttatgcatcctgagctttcaggaccgctatcccaaatgtcccttccttcagctcagatgggcaaaacaatcctctaacaaccctctgggatgcataaaaacattagctgcttcatgaccccttttctgatgccctctattaattgtcaccttctcaatacatacatacttttacagctcaacatattttgcttgggttttataaaaggctgcctcttacttatttttttttaattccccacagtacctaccagaaacttgttatttgttgaatggaattgaattgctttgaaagactaagaaatcacttctacctataaaaaatccaactctcagatttgaccactatgttgagtcatttattttcagactttaaacttaggccattctcctccagaaaaagatgtccgaatttataattttagttatctcagatgtctagtttattatcaacttcgctggaacatatgtattatataaattgagggaaacctacatgcttcttttaaacttaaaactgtaaatatagaaaatgtaccattgaacggtaattactcatttactctttacacatatattattgctggggccaggcacggtggctcacgcctataatcccagcactttgggaggcctaggcaggtggatcatgaggtcaggagttcgagataagcctggccaacatggtgaaaccccagttccactaaagatacaaaaaatta

SEQ ID NO: 11900 - DNA, 89716 bp, Human
  misc_feature (1)...(89716): n = A,T,C or G
tcttgttttgctgtctgtttttaacccattcaatatatgtggacatccaaaagggtttaaaagccacctcctgccctggcccgttttctctcccttcattcttctgttttcagaaatacatgttgaatgtcagcttctgtattatttctattatatgtaatctgatgacttagaggaggagattaacctttcaggctcttttgaatttggtttttataatttggttttaaagatcacttactcttccagtaataagtagtaataaatcctgttcatatctgagatcaatacacagtttattgaattcaaatgactactcaaactctattccacctagatggaaaacttttttagacaatatctgaccactaacgcggtgggcccagaaatctgcatcttaatcagatgcttcaggtgagtccgtccgaggattgtcctagtaccacactttgagagactgcagtgggggtacagagtgctggaggggtttagtcaatagctctagtgaaggatggatagttttattcaaagaatcccagttgatgaatgaagaagaaatgctagaattagaaaaattgcaaacccctattaaaactaccgctcaggcaatgctcaacaatggatgtaaaacaattaggtgaaatgttgatggagaaattcattacaaaggaatagccctctgaacccactgatcaatgttagcatcattacgaatgaaacaaccagacaccatatgcttcctgctgtgctgcaatattaattatatggtaccacctatgaagtgttcttgccctctcccccccaaaaaattgaacctgaatttaatcaaagctttagatctaatatttagtgcataggaaataagtagagtagaaaaacaataccagggagaagcaattagccaaattcaaaaaatggttcatttcaatagaacaactgacctggtttctttttcaatgtgttaatagtgttaaaaagtctgttttagatcaaaagagactgatgagaccacatgcaaatacattgcacagctcttgtttgattcaaagaagtcaagtgtaaaagacattttttagacacgtgaaatggtgttgcggctgactaaaaggatgtgtatgtgtgtttttgaagtatttagggctaaaatatgtccaggattggcttttaaatactacaaaaaatggagtatgccaaaaggttgaccattgttaaagctcagtgaagggcaggtagatgccaattgcactcttcacttttatgtgcaaagtttggaaaatttcacaataaaatttttgtgtttacataaatgaaataacatgggaaaatgttctaaggtatggcaagtgaaaagaagcctggaaaataactagtttgtcccacttaagtttttaaaggtgttaaaagtacatgtttcaaaaagtaaggatagactaaaaaagtgaacggtggtaagttctaagttgtgggcttacaggtgttctttatttttatgctttgctgtattttccaagttttttttttaagttttccaagatgttttacatctctgttcttatttaccagataaactttgtggttagttactggataaactgtaaatagtgataaaatttttaagtttatatcaagatagcacttcattttaaaaccagtaattattaggttggtgcaaaattaattgcagttgttgccattggaagtgatggtaaaaaccgcaattacttttgcaccaaccttatatttctaaaagatcaagttgtaaacctatttgttttccctaagatccgctcttgcagagttggaataaatatgattgtttacacttaagagtccaggactacagcaggcctggttggaggggagttactaatgttcccagacttaaatccagctggaacaccacctaaaatatgcagtaacataagaccatcaaaagcaatgtcccaggacttacaatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggccggggcagagaggagcccctgccgttcgtcccatcctttcgtgcccgccgtttaaggcactcaggcacggactggctttctcctgtaacagcggctttgccttcgcattcccacccctgcctccggggcagctaaaggctgcgttttcagggactgtcctggatctttgggcccccaccttccttatgttcccctttcctctccttccaaggctcacaagctgatttccaaccacacgccctccctaaacagtaagataaaaagtattcttgcccatcaggggtcagcactcccagatcttcgttccctcaatcccagccgataacgggaacgtccccagtacactgagagcagcctacagaaatggctgagcctcagctcgcggggtgcgtttggaagcgcagagagcaacttagattcgggacaagaccgtagagacgaacacattcaaaccacccccatcgtttctcagatgaagaaatcgttactttccaaagtcacagctagttcctggcagagctgaacccaagtcaggctctgggggctccaaggtcctcacgggttccactgctgggtgcgggctctgtcgcctcagaagctgggctcgctctgcgcaacccgagggacagttccaggcagtgtccgatgtttgggagaagcaaagccccctgggcatcctttaaaacaccccccttaatgtgagcatcaactctgctcactcttaatgttccagtttcattgacattactctgaaggaggaaactgaggcaggaaggttaaggagctcccttgagagctgtggctcacgcctgtaatctgcactttgggagaccgaggcaggaggattgcttgagcccaggagttcgagtttagcctgggcaacatggcgaaaccttgtctctacaaaaaaaaaaccaaacaaaacaaaacaacaacaacaaaaaaaaaccggtgtggtggtgcgtgcctgcagcccagctactggggagggtgaaggaggattgcttgagtctaggagttcaaggttacagtgagctgtgatcacaccactgcactccagcttggacaaaagagtgagatcctatttcttaaaaacaacaaaaacagagctaacaaccaagcaagagcagtggcacctgatttccctggtgctcgtgttggtgccggttcattcagagccacctgtgaccactgcttctggctaagggcagccacaacacttttcccgacgggcaccagctgcctcccctggaagctaaccagtgtgaagcaccaggccctagttgtgaggcctgttctaagaccctgagcctaatttcatttgtggttttgtattatgtttcttaaagaggatcccccaaattgtacattaggcccctcaaaaactttgtctgcccctgctgcctgggttctacattggataagatgagctagtttttcctgatctgtaagggtcattaggaccccttcacaggactgctgtgagggtgaaatatgacaatggggtgagatgattgacattatgtcatttttttcttcttttgcataatagaatggtatagtaaacacaacactggctttgttgtttagacaaacaagtcttcaattccaattctaattctgattgagaaaacctaacctctcagaggcccagtttctctgttaaaaggggatcataccacttacttcataaagagtgatcatgagcattcaatccacttatttgttaagggcctaccgtatgccagtcagtgttccaggcttatgagatacagcagagcacagaaataacaagtccttgcgtgcatggagcttacattgtgctggggagatagcaagcatataaatacgtggaaatgtgtaatgtcaggaagtgagaagtgctaatataaaaaataaagcacagcgtggggacagagagtatgcaggatacttagaggggatggatgttttggcctgtctgaaagggtggcatttgagcagtgactgggatgcagtgaggagcaagccatgcaaacatctggggagacagcatccaggcagtgggaatggcaggtgcaaaggtcctgaggtaggaggatttctgtgtgcttaaggaggtaggttggtgggcctggcaacatgggcagtggcctgattactagggctttataggtgatggtaagggtttgggttaaatgaagaaacagggattgtgagtctaacatctcctcgcttctccttcccccacttccaaacaaatattggtatttttaacataatggccaacaagtttgtgctctattgatttttaaaattagataagctagttcttatctacggactcactttgtctatgggccaaatgtcctgtggttatttgtaaagtataatctggagatattgattctgtttttgcaattacccattagaagaaattgtgttaatctttccctttccttctcctcccttctaaattctgttaggtgtgtgcttcggtacttaataaacaagcctgattacttacatggaaagaactagaataagctttttttttttttttttttgagatcgagtctcactctgttgcctcctgagtagctgggactatgaaactgcaagcacccaccaccacgctaatttttgtatttttagtagagatggggtttcactatgttggccaagctggtctcaaactcctgaccccaggtgatctccctgactcggcctcccaaagtgctgggattacaggcttgagccactgtgcccagcctagcataaactttttcgttccagagagtaagggattgttgagaagagtgtgagagaaaatccaccctagaagagggcttttgaagtcaaacacaatctctggaattaaaaactcacctttgaaaaagaagcttagaagtgaagccacttaggagaaaataggtgacatgattggcttctattctgctttttgctaaattttctcaggtcaccaaaagttgtcctcaggcagaaggtaacgacatctggaggcaaggacagcgcacgttggccagggacctagttgcagagagatttctgaaatcttattcactctaccaaggcccccagaagaacagatgacccatttaacatggagtttaagggaggaagagcccatgaataaattctgccatagatgccacataacaacctcaactcaggaaatgaagcatgtcatttcatgaggcaatgaggtgtggaaatcaaaggtatgggccttagaactagtcagggatgggtttgaatcctgtgctatctgctctgccacttggcgggtctggggcctcgggcaaggtacttaatgtcgctgagcttctgttttctcttttgcaaaatggagctaataacagaaccttttcccttgaaattggggctgattaagttgcatagagagaggttagcagggtgggtgtacacagtaaacagattgtaaattgatatgtggaaacaattgttgctatctggactataaaataatctgtttcattagcagagccagaacctgcttagaggtgtcaaggatgctaagaagcagtcatcctgcattatttgcacaatgagcatagacttttggtactggtgtaggaatctggaaagagcagtttattggctagcattctctaaggttcttggtttacaaggctgagagaggaaatttctgggcttctggaatggctgcaatgattcagagaaaagtggagaaggtggaggcaccttaggcagaaagaagtaacaagcaaaatgaattttaaaagcaacctaaagctcaggaagatgtgtccccatggctgttccctgaggcttctttctctcctctgaggctgctgtagattattgttctctactaactgcatctcacagcatacacccctttctttcctcctcttctacctctcagccttgtcccttcacatgcacctctaccccttccttattttctactctctctcctcttatctctctcttcctttctctttctgactctgtcttggatctggcagggcctcctcaggcactagtcactggcagtacacagagaaaagtgatttcttaaccaagtacagcatgaacttggactctcccaaaagggctggcagtgatacagaggggcagattccaccctcagattcaagactatgctgagatgagtacatgcaatgaccctgacctgagaactggcaacatctctcaaatccagagtcaaccagaataactgttacccatcccctgtatgccttctagcctccctctgagtcctaacctccctgtatcattcccagagctgccaggacaagatgcgtgctagatctctgcccccacttcctccaaatacaaccctcactacatcaaaacaacaacaacaacaacaacaacaaaacacatttcaaactggtgggactttgagccagattccaatcccttgaaacatttcctggaacacatacccaaacaagcatgaccaccttcttccatgaattctttcctcaaatatagaaatattcctcaagcctaaaatgctattctttactaactaggctacccagaccctgtctatccattaaaacggggcttctattgtttaccatcatatctaggaacagacattgtgaggttggggcagaagctttatggtgttatctgagacccacgtttcttctctcttttttctctcctgccattaacatgttgcctcatggtctaagataactgctggggttctagccatttcatccctattccaagtagcgggaaggaaggaaaggagaatgcatgccaggatagacaacctacagtttctgccaccaataacttctgtgtttttctttatttttcatctattcagatgcccaagtctatgagaaattccttccttcttggtatctcataccaaatcatacatagcatgttccagtcattcatttcattaattaacacttattacatcctgtgatatttccccaccaccaagctcagtgtttggcataaagaagaacagcagaagatggcttctttcaggatcgagatagtcttgtacacacacaaataattatgatacagtgtaaaaagtgtcataaaagaagaggtgaagacatcagccatgggaacaaagaggaggatggttactttgagatgcaaaagggtattttaggtggcagaactctccatagagaacacttgagcagggtggtgaatgacatacaaaattctgccaagaagagaggaaggattttcaggacagagggaaccttgcatgcaaatgcagtgaaggtgaaagtccaacgcaccccctggactgtccagttcatccgtgtggcctgagttcgaatttcttcttgtattccggaaatagttggttattaattcacctaagatccactcagtgtactcatttaaaaagcacattttctggttccctctaccagaaatcctgattccatagcggtttcattttaacaagcatctccatgattcaggaattcccagaatggcagtttggcagccaggagccacgttaaatttaggcatatacatgagacgatcaggcttgggttttacagcagtcactctggtcgtggtgcagaggacgatattgcgggtaccaagagtggaggcagggagaactctcaggcaggtcttataatcattcagacaataggtgatatgggctcatgggcagtgacagtagaagagaaaggagtttagaggaacattggaagcccaagtggaagaacttggtgacactgattgtggtggattggaaaaaaaaaagttgaaaatagctcaggttttttagcttaggtgacctagcagatactgaggccattaaaaggttaaggaaaagaagggaaggagtaagtaagtttggaaaataaaataaagagttccatttgagagccaattaagttgaagatacctgagaggcaccccatattttttcttatcacatacacacacacaaacagacacacatgcaccaatctttctatattgcggactcttctagggcacagatctgaccttggcaattggcatatgccacaccttgcctggaatatagcctgttagaattgagggtgaggcagcagccctagaataagcatatgtccactcctcacctactacttcccaggagggaaaattactataatatggtgaaagatgaattcagcttctgaaatggcaaagcaagtcatgcttctatgtgttctatgaatccaaaagaaatgtcaaatttttgtgaaaaaagagaaaacatgatcactttggaaaacataaccaatcttgacattttgatgtcatccttgagaaaaaacagcatgctgttctgctgctatgctgccaggctgctcccatgaacttgcctaagtatgtccttgctgcacagttttgcatcacttagcatacatgttttatcttcccctttgtttatttgattggggccatggctggttatcttttactggaaaccacaattatttgaacaagataaacaaacaagtctttttaaaaattaactatatcaatttctcagaggctattctattccagcaattcccctccctcctttcctttcttatttcatccactcctcccccaagtctgaatgttctactaatgtctttactctcacctgctttaaactttctagaaaaaactggacaggaggtagtgtttctgttagcagaaacaacaattgccttagagaacagcgataattcaggaccaaggacaggagcacaattgtggtggggctcaagattacacataagagtggtggtttgcatatcacagctgttccataaagctgaaatctacttgaaaatatgagtaaaagggctaattaacatgcatttccctcaaattagtgtgatcctaccaatgtgaatttcatattagctctctcaactaactcttattttccctttggtataggtgatagaaaaaaatgtcgatcctgaaacaatgctgttgccttatttgaggaagaagcgtatccttttctttactttgactgtgtatgtgtgtgtgtatttgtataactccaatatcctcattaaatgatatttcaaatatacattagagacactgagacatattccctactatcatggttttatgctcatatttgagaaagtcctatcattttataggcagtgcacaaatgtggccgtcagaagaaccaattttcttctagtctctgtataaaatggggaaactagtaatggaaacttaatagacgttaaaaggacctaactaagcatcctttagaattagagtcacaatatttatactctgtccttaaggactaattattatgcccattaggaaaagagagcacagaagtcacctgaaatgaaagtaaaaggaaaacggaagaactaaacctgaaaatgttatcctagaaaaacttgccaaataaatgccatcaaaggaatgtatttttagcttgctatgcatgaactccagtgggctacccgacggtgaaagacactactgaattatatgcaaaattatgtttcaaagagggtgtgtacatttttccccctggagagagtaaaattaccaaaagagtacataactccaaagcatcaataattatttttcagacacatgaatatgtttctgaaacatgctcatgaaagtcattcaagatctttagacataaaaaaacaatgaacatgactccctgattatccacagtacctatgtataatatttaaagtttggttcactatgagtgacagaaaactccacctcatggtaaacaagatagaaggtaggagtttctttctttctcattgtgttagttcaggttcttcaggatgtggacaccaaaaatgagattaaatgtgccaggattttattaggagaaatgcctgtgggaaaggaagtagggagtgaatcagaggagacttagggagccatttgatcaccgtgtaagtctgaccctggagataaggttgagtggaagggccctagactgctggtcagtctaaggcatgttcttcagaaccactggggatggttgacaaggactccatgtctctccatagcactaagccattggtggagagcagtccatgggaagcatggtcttaatgaaaactggagtgatcagtattaaagtacagcaacagggtcccttggtcagttaccctctgtgttgaagggaggtctgtgaggcatgtttgcatggctatcacactcacataaaggaagcccacaggtaggtggatcagagctggtaaagcagtgtcacaatgttgttgaggaaccaagcagcaccttcctcagcacacagctttctccccaccatcagagatgactaatggaggcccagccctcatatctgaattccagcaaataggaagaagtaatgagcaaagaaagaagcacccctctccttttaaggacactcttctcctggaagtcatacacaacacttataattacatcctagtagccagcattgttaatgaccccacctagctgcagaggagtctgggaaagtctattttttactctgggaagccatgtgtgtggctaaaaatcagtgtttctatttctaaggaattatgagagaacagatattagggaacagatggcagcttttgcgactgaaaggcagagaaatacacaaacatggctaagatgacacaaatattccaagcattatctacaatttaatattttgctttgtgtcatcaaagacagagataaggatgagaataaatgtgcaatgtgttcataccttcaaatactcaagtgcttacatatatagactcttcttttttcagttcagccctatttttggcaacctgacgtccagttgttttcaaagggagaatgcaagatataacacacaaaaggaaatcaagaatttacaagattattatagcttctataatagtaattaagacataaacacattatttgatgaatatgtattgaacttaactaacatttaagagtctgtgatattactgtctcctagtggcagggctattctagaaagagaattacataacacatatgatctttaactatacctcttccagttcgactcacaggaactaagtatggctgtggaggaggaggctgtggtgcttgtacagtgatgatatcacgatacaaccccatcaccaagaggataaggtaccgtgcagcaaagtccagatatggttgaatttttataattttgaactttgttatattccttcatttggtaaatatatattgagtacctaccatgtgaaaagaactggccacttggcgtacaatgatgaacaagacagacatggtcctaggaatatgaatgttttgggaaaaaaatgtagcatcaatgaggataacatacggtcaaagaattccccatcaaagccaggcacagtggcacacatttctagctacttgggaggctgtcaggaggattgcttgagtttgagtccagcctgggcaacacagcaagaccttgtctctaagaaaaaaaaaaatcccctgtcaaaacttgaatggctccctaactccctgtctggggaggaaaggcaaggctgaaattgcagtggaggataatgccatcatcacattcatatattactcttccagcccctaacttatctccttcctcccatctggtgcattctccatacatcagccagagtgacctgctttaattatcatcagatcaagtcattcccgtacttataagcccccaatggcttcccattatgtttaacatctgtttatgtttggtatttatccttcctcacatttgccaagtttcttggatctgtgtgttgatgtcttctggaaacttctcaaggcattatctcttcaaatatttactctgtgccacacactcttccctctgttcttctgggaatccaattatgctaatgttagacgattttacatcatttcacagatcgcacttgaaggctaaggatctgagcactggtgaggtttcagatatctgcctgtgttccacaccaaactacctgctgtctgaactctgagaggttcctccctgctttacggcctggctgtcagctttttagttcatgagggatttctctttgcttacctctctcaccttccatgctttgggagatctgtcgcagccatgttgctctgtctttagcctctagggagtggcgactaccctatgctctgtgaagtctgagtacctagggtttctctcagttctcctgtctctcccccagccttctttgtttaaggaccagtatgcttggaaagtttcttttagctctccttccctgcctattttggggaactacccccggcactcagtgatctctggtggggaagagattgaagataatgcatcccagctttgtatttgaatctgttgttatcagcccacatgcaaccattcaaaatttgttggaagttggtctggtttctccttattcctgtttaaggcaggttccttttcctccttcaatttcaggaagagaataattgtatctcagggatgagagcaactgtatcttctctcttatgaaggggttgtcacatcggagtttagtttatttatttattaagttttgctcataaagtttctttgtgtactcagcatctgatgagctttgaaaatgtgattatgttcctcgtatggtttactttggtttttagaatgggagtggcagtctcttacaactcttaatggcttgtttttaccttctggtctttgtactaaggcaccagtttctccagttctttaatgtttaacttatgcatccatcagcgtgacagtgaggtgttggtgaagtctggctgctctggttgctaatggagacctggcctgccataggtgcatggttacctgtgactagagaatgtcaacccctcattcaaaagcaaaaaccatcaaagttgtgacagtttttgataagtggacaccattctggaattagaattaggaggcgtaattttaatcctgcctctgacactctggctgtgaccctgagtaaatcactctgatcctcagattccacttctctaaaatgggcctgtgcctgagctaaggaggaaatgtatgtgtaaaacctgggtacattatacaaaaacctgccacagtggagaagctcagtgaatgcctggcccctttcccactgtatgcgacataatttgtaatttgtgcttttcttttgcattctgaaggcatcacccagccaatgcctgtctgattcccatctgttctctgtatggtgctgccgtcaccacagtagaaggcataggaagcacccacaccagaattcatcctgttcaggtgaggatgtgcctcttccttataggctttctgtgctttagaaacctcatgacattgagtccctgagattaagagagcggagcagcctggggcctgctggctcggccactccaacagatacaacctagctgggaacaagagtgaagcctggcatattgggatatgtgagtgtttctgactaacttgttggaaaaatgcttttggaaggctagaaaaccttttcttctctaagaatgccctgacatttgtgggtttgttttttgtgttctaattcgatgggacctatctatttgacatcttccaaactcataaagaaacaagagccaggtgcagtggctaacacctgtaatcccaacactttgggaggccaaggcaggtggattgcttgagcccaggagtttgagaccagcttaggcaacatggtgaaacatgtctctacaaaagtacaaaaattagtggggtgtggtggtgagcacctatagtcctggctactcgggggtgctgaggtgagagaatcacttgagcctgggaggttgaggctgcagtaaaccatgattgcaccctgtacttcagcctgggtgactgagtgagaccctgttgtaagaaagagaaggagaaaaagagggagagaggagggaggaagggagggaaggaaggaaggaaagaaaagatgaaggaagaaagagaaagaagagccatgtgcattgagggatataattttatttttttttataaagtggaaaacaacatgatcttaaggctgagtgaaaatttcagctaccaaaaagctttgttatatttagagcttgtttggaagacagatgataggagttgtcaataagttttttggcttttctcctaaagaagcaccttgttagagttttagactcaagtaaaaaggcatcttcagacacctgagtctttatgtatatattgcccataagaatgccatttctaggccaggcgtggtagctcatacctataatcccagcactttgggaggcagaggtgggcagatcacgagctcaagagatcaagaccatcctggccaatgtagtgaaaccctgtctctactaaaactacaaaaattagctgggcatggtggtgcatacctgtagtcccaagctactcgggaggctgaagcaggaataatcacttgaacctgggaggtggaggttgcagtgagccaagatcatgccactgcactccagcctggcaacagagcaagactctgtctcaaaaaaaaaaaaagccacttttcctcatttttattgaagttaatgaagatcaaatatgagaaaagatagaaggaaaagataggagcaacatagaaaatgacccaagttcaaattttctagatttgaaggaatcttggattctgtttatttgaaagatcattacccagagggagagaattttgcctggatcattatgacatatcattaactagagggagagaattctgcctggatgcccatgtgagacctggtcatacacaggcatacaataccctttcatttcttcattgatgcggaactcccattgttacaatgttgccagaagacagcttccaaaatcgacttgaaccttagaagttagactccaaagcaaaaatgctagggggagggaaacgtataaaagaaataaaagcattttattttttatttattttttttccacttctcaacttgagtgtaatttggtttatttctctgaaggatttcttttatctcagtaattcacaaccacaactgcacgttgaaaccaaccatgtgggaatctttaaaagatgtatgcccgtgccccattcccagagactctgtcagttggtttgtggtgctgtgtggggcttgaaatcttaacactgtccgggtgattctcaagagtggtaaccactgccttaagtgaagctcaaaagcagataaggcccaacctcacaacaacccagccctggggagggaggtgcctgggatgagaagggctcccaggggcctctgctgcaatcttaacatgcagacaaatcacctggggatcttgctagaatgcaggctctaattcattaggcccgggatggggccccaaattctgcatttctaacctttctgtgcttccaggagaggattgccaagtgtcatggcacccagtgtggcttctgcacacctgggatggtgatgtccatctacacgctgctcaggaaccacccagagcccactctggatcagttaactgatgcccttggtggtaggttatatatgcatgcttttattttttaatttttatttatttatttattttttgagacggaatctcactctgttgcccgggctggagggcggcggcgcaatcttggccccactgtaacctccgcctcccaggttcaagcaattcttgtgcctcagcctcccctcatgcttttacttttaaacgatgatgatgataatgataacagctaatattggatacctttcatgtgccacacacatttaatagtattaaatactatttgaagattatctcatttgatcctcacaaaaaatttataagataggtactattgttatccccatttcataaatggagaaactgaggtttggggagagtgatttgttcaaagttacacccccaataagtggaagaattggtttgttcaaatcaggattcaaaccaacccacacattgcatttggctgatgtatttctgaagtctcttttgtttttataatcattaaaaagccagttattcatcagcccttgggaagagtcctgttatctccacatgctgctccctcaccactctccctactgggtggtgggtgctttcaggaccatattcaacatcagagggctgcgatggttacagcataaagtcagagactgagatcttatggtgaaacttgatacttattgcaaagaactgtctatccaccctagagcgtttttgtcaagttcaggagctcagtgtgtatgtggcggggggggacatcctcatcaacaagattctaaacacgtttttttaagtgataccctctcaagttctgtttctggtgaacttctccatggctccgtttgtctttgtctcaggcctcccgaagacctcatttctctgctagagaacatgagcctaaagctcatatgtacacttactctgcaaaaatgttccaaggaaaaccagaacaaatggatgtagaaaggagagacatcgctcataaactgtcttctgcctgatttccttcagatcttatcatgaatttgatttcatggctgtttatgatgtaaacaagtgataaggggttctcagatttcagggtacttaggtcatacatgggaatttgtgggtaatgaagattcctgggacccacccctagagagtttgactcagtaatattgttttttaaataagacttcagatttaggggtggaggaggaacaccggatcgcactgtgagagaaacgctggcctgatgatttattataaataaataatgtgcccgactgctttcacagtttaataactacctttgctgctgtataataactttgatctttctgtcagctgaagcttagagtgctttttttttttttttttttgtcacagtaagtgttaagaatgaggggttttttccttagaaaaagaagtatagcttgctatttgcaacaacgtaaatgaacctggaggacattatgctgagtaaaataagccaggcacagaagaacaaatactacatgagcccacttatatgaggaatctaaagtagtcaaactcacagaagtagagaatagaatggtgattaccagggcctggggaacgggaaaacaaagatgtattcgtcaaaggtaaaaagtttcagttatgcaaaaggagtaagtcctagagatactgtatagcataatgcttatagttaacactgtattgtatactcaaacatttgctgaaagggcagatgttatagtaatcacaaaataaatgaataaataaataaatgatgggagggaagttagaggtaatagatatgtttataacattgaccgtggtgatggtttcatgggtgtaagacttatctccaaattcaccaagttgtacagctttttgcatgtcaataacagctcagtaaaatggattttactttttaaaaaaaaaattagtttggctgaacacagtggctcacgcctgtaatcccaacatttagggaggcctaggtgggtggatcacctgaggtcaggaattttgagaccagactggccaacatggtgaaatcccatctgtactaaaaatacaaaaattagcctgacctggtggtgcacacctgtagtcccagctactcggggggctgaggcaggagaattgcttgaacccggaaggtggaagttgcaatgagctgagactgcaccaccgcacctgcagcctgggcgacagaatgaaaccctgtctcaaaaataaaagtaaaaataagttgtttttaaaataaggcttagctcttgaatgtgactgtagagcaagtttttggcttgaaattattgtgttgtttgagcacctgtcacaagcagaaggcataactttacaggagaaagtacaaatacctgagcttttaaaatctgcctcaagattcttaatgaaatatcccaagttgctgttgaaaagatctgactttgtagattaggtggactaaaatgtcaaacagatctttcctctatgatagggtcctcatttccatcacactcttggtagactgtgcctctatctgggtcacttggctaacagagctgggtttttctccttcaggtaacctgtgccgttgcactggatacaggcccataattgatgcatgcaagactttctgtaaagtaagtggaaaggaccacatgtttgagtatgttttccccagtgaaacgaaatggtaatggttgtcagtgattaggggggcagccatcttactaatacatggctacttcttatctccaggtttctagctgctgtttgttatttgatcttgagcagggcacttaacctcattcattgagcttgccttggtggtcgcataatgaacacctgagcattttgacactggctgtgtgtcattgcttccaagaggtctttcctgacctctttgcctgggtcaggtaccctggcctggtgttcctatagccctctgcgaacatgtgacgggcatacacatgtcccgtcacagctttggtcacaatgtggtgcaactgatcatttgctatcccatgtcttcaccagactgtgggctgcttcacagtagaggctgtatatctccgggtccagtcaccatatagtcattgagtagctactcaatatttgttgaatgaataaatgaacaaacaaagttgaaatgaaggatataagattgccctctggaagttaaacaatgaattcagtatatcatagataagaacagtgatgacaataacaatacctgttaatatttattattaatatttaaaatactaacaatattaacagttaatcattattaatatttactatttaatgctatgtgccacgcttagttataagatctttatgtcttttaacttatttagtaatcactgctattcaaaattttctgtaagctcaggtttttcattaatgttggtttggatatgtttaagtacaaatggctctctttcatggcatctaacgatattgattcagcattatgtttcaactggcattcacctgctttatttactagttagtagaatcagcaataaattcctagtgatttgttttttgtccactagacttcgggctgctgtcaaagtaaagaaaatggggtttgctgtttggatcaaggaatcaatggattgccagaatttgaggaaggaagtaaggtcagtgaaatgtaaagcttttataaggctttctcaggacatgaacaggagccaacatactcttaggaagaacaaatggctacccaagttgactaacttgaggtatgtcaacatgtgccctctcccattctcactccatctctctataaaaaaaaattatatcgcagcaactttgtcctcattccagatattattcccatttaaatacagttatctacaggagggaaaacacattggttccttagtgtctcttagcttttaaaagcattttttcaagttatttttcaagggccagaagtaaagtggagatgtcatgaaaataaaagaacaggtagaacaagtagagacaggagaggttcagggagccgttcttgttccagctgtgtctgcggctgctgcctcctcttctactgtccccagactccaaagagaaggtacagggagttgaggcctccagaggcccattggcatcagcactgagttgctgatgacaaggtttgtgttagagcccttggtttggagcgcggggattgtggctggccagtggacttttttgtcggtttgctgtatctgactgtgtatctatatcttttgaccttattccacaaaggattttaaagttgctcgataacagtaatttctgatatgttctctttttagacaagtccaaaactcttcgcagaagaggagtttctgccattggatccaacccaggaactgatatttcctcctgagctaatggtgagtaaagcaatgttgagctcatcctagaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaagcagcagatagcttctataaaatcgtgaaatcacagtgtttgtaggtatagacatgtgtcctactttcacttttgctgaagtttattcctccatagaatgatttaacaagattcagcatgttactatatttgctaacattaaaatgatgttctttgagacaagagcaccaaagggagacagaccaagcagttcccaggagtaaagaaccatcgtgcttttattctgaattctaattccttgtaaagctctacttttaggtcactttgtactttattttttagaagatatgtattttctcattctgtatctacagtgctaatgattgagtggaaacaggtggagatggcatcattgggtaccttgaatccctattgctttttcaatagataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtgggtatgtagaaccccagggattttttatagggaaattgagaaaaagggcttgggatggggccggggtgggctggggaaacttcatatacatgtgttctcaggaaaagcagtctgaaatagcatttttaatcatttgagctagacttcctgagcattgctcaagagactttctaactgttattaagtagattcctcttgcctcttattggagcagtgtcaagagttgtaccgaaggggcttgctccatagcaaaccagcagcaggagcttcagtgacagctgtcctgtctttccttttggggactaatctgggcctcaaatttcaaattgctctttgtttcctctctcagggtgtctcaataggtatatgttttacttaaacaaccgctacagggtcttcctgttgcatccagtgtgtgctcagcttgaggagcagcccctagagtcttcccagagagaattttgaacatgccatatggcccaagtttcaaggttgacaattccagagtcttccaagtttgatgaaaatctatccagccattctctctgtatgtgatttggcaataaacagatgaatagaaagatacaatatttttagatatttaaagatattagtttaataataatttcaaatttaaaaggcagttagttcctttattctagtcttattgattttttttttttttgatcctttagggcctgaagtgaaatttaaaggcgtctttcacccagttataatttctcctgatagaattgaagaactgagtgttgtaaaccatgcatataatggtgagttctcaagtccctgttttcttagttaagatgcattaatcaatttatttaccttgcccagcagacaagcagaaaaagaatgattcctaattataatacacacagagattctcttcttataagaatgatatgtttgttggccacataaatgtcttcttttgaggagtgtctgttcatatcctttgcccattttttgatggggttgctttttccttataaatttatttaagttccttgcagattctggatattagacctttgtcagtgggtagattgcaaaacttttctcgcattctgtaggttgcctgttcactctgacactaatttcttttgctaggcataaactctttagtttaattagatcccatttgtcaattttggcttttgctgcaattgcttttagtgttttagtcatgaagtctttgcccatgcctatgtcctgaatggtattgcctaggttttcttttagggtatttatggttttgggttttacatttaagtcttcaatccatcttgagttaatttttgtataaggtgtaaggaaggggtccaatttcgttttctgcatatggctagccagttttcccagcaccatttattaaatagggaattctttccccattgcttgtttttgtcaagtttgtcaaagatcagatggttgtggatgtgtggttttatttctaaggtctctgttctgttccactggtctatatatctgttttggtgccagtaccatgctgttttggttactgtagtcttgtagtatagtttgaagtcagatagtgtgacgcctccagctttgttctttttgcttaggattgtcttggctatacaggctctttttggttccttatgaaatttaaagtagtttttctaattctgtgaagaaagtcaatggtagcttgatggggatagcattgaatctgtaaattactttgggcagtatggccattttcatggtattgattcttcctatccatgagcatggaatgtttctccatttgtttgtgtcctctcttatttccttaagcagtggttggtagttcttcctgaagaggtccttaacatcccttgtaaattgtattcctaggtattttcttctctttgtagcaattgtgaatgggagttcattcatgatttggctctctgcttgtctattgttggtgtattggaatgcttgtgatttttgcacattgattttgtatcctgagactttgctgaatttgcatatcagcttaaggagtttttgggctgagacgatggggttttctaagtacacaatcatgtcatctgcaaacagaggcaatttgactccctgtcttcctatttgaatacctgtatttctttctcttgcctgattgcactgggcataacttccaatactacgttgaatagtagtggtgagagagggcatccttatcttgtgccagttttcaaagggaatccttccagcttttgcccattcagtatgatattggctataggtttgtcacaaatagctcttattattttgagatatggtccatcaatacctagtttattgaaagtttttaacatgaggagatgttgaattttatcaaaggccttttctgcatctatagagataatcatgtggttttcgtcactggttctgtttatgtgagggattacatttattgatttgcatatattgaaccagccttgcatccctgggatgaagccaacttgatcgtggtggataagcttttcgatgtgctgctcatcatcactgatcattagggaaatgcaaatcaaaaccacactgagataccatctcatgccagtcagaatggtgattattaaaaagtcaggaaacaataaatgctggcaaggctgtggagaaatagtaatgcttttacactgttggtaggggtgtaaattaattcaaccgttgtggaagacagtgtggtgattcctcagggatctagaaccagaaataccatttgacccagtaatcccattactgagtatatacccaaaggattataaatcattccactataaagacacatgcacacttaggtatattgcagcactatttacaatagcaaagacttggaaccaacccaaatgcacatcaatgatagactggataaagaaactgtgacagatacacaccatggaatactatgcagccataaaaaagaatgagatcatgtcctttgcagggacatggatgaagctggaagccatcattctcagcaaactaacacaggaacagaaaaccaaacaccacatgctcttactcataagtgggagttgaacaatgagaacacatggacacaggaaggggaacaacacataccggggcctgttggcgggtggggagcaagggaagggagagcattaggacaaatacctaatgcatgcaaggcttaaaacctagatgacaggttgataggtgcagcaaaccaccatagcacatgtatacctatgtaacaaacctgcacattctgtacatgtatcctagaacttaaagtaaaataaaagaaaaagaaaatggggacagaaagcataaaaaaaaagaatgataacattctggaggaagactgagggaagaattctctaaagttaatctaaatactaattgtctgaatagttcagtttttactgaagaacttcttctgtctgcaatatcagagaaatgtaacaactattcaatgaaggatacggtgctaagtgctggacagaagataaagatgaatataacacagtctttgctctttaaaaccacagtagcgagtttatgtattcaacagcttacagactggtttttctactcctgtagaggaaattgatataatggcaatgataagaagcaatagaaatgtgggtttgcagtacagcctctgaaatctaactcttgacaatggcatatattagctgtcagatcttaggcaagttactcaactctcagtttcttcatctgtgaaatggggctattaatatctcataggtatgttcagatttaaggagattatctaaagcattcaacataatactcaatagagtgagtgttcaaagaattcagccttcattacctccatcaacaccacttacatcactaccaccacctctatcattaccccaccttcatcaccaccaccacaccaccccctcaactgctatccctaccaccatcgcctcaccaccactttcattactaccattaccttcatcaccatcaccaccatcactgcccatcaccaccatcaccaataagcagggcagcatgtatccagtataaagattctatgtctgtagctttggtctaatggacattttcagatcagcagtgatcacactgtgttatttacaaatgacttcatttcaggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggctgtatgtatctgatgacagtaaactctggtatgcatcccttgggtgactctccctgatgaatcatgacattttcattcttttggaacagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaaggtaagtgacagcccctacttggagattattaagctgtttctctacccctttttctctctggggaggcaggaaatccagtcttgaaaatgacttttccctataatatcaatacatttctctgcttttctggatactggaaattttgtgagtcttgtcttaatagcacaggctttcttcccctgtgtctttctggttttttgtttgtttgtttgtttttcctcatactggtcaccctacactggacatgtttgtgttggttaatgtccggatgtgatctgattattgctgggaactacatgctattgagaactattgggtccctttgttgaagacattctccaggtggtacaggagtgttgtggcacccacatcgtgctttgagctcacacttaatttatcattgatggaaacgtacaggtctttttcaggtgaaaaatgattgggcctcattctatatttatttacttgatttttgttattaaaactaagtccacaacatctaatttatcgcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatcttttttttttttttgaaatggagtctcgctctgtcacccagtctggagtgcagtggcacaatctcagctcactgcaacctctacctcctgggttcaagcgattctcctgccttggcctcctgagtagctaggactgcaggcatgtgccaccatgcccagctaatttttgtatttttaatagagatgtggtttcactatgttggccaggctggtctcgaactcctgacctcgggtgatccacccgcctctgcctcccaaagtgttgggattacaggcatgagccacagtgcttggtcacaaaactatcttaaagaggaagatttgcattcagggttttcaatttgagtaacatcccctaaaagtcatactatgagaaacaggtttgtgatgtgaatatagacatcaaaagcttcttagctttcagtattttgttatagttttaaactgttcctcttccttatatattaattaaagaactaaaattcttcaggtgttggaacaagatataaaaaagtaagataacatctcagtagtatacaaatttattaaagataatttcttattcatgactgtatctagtggggttcctggttataaacaataaatatttgttggctgacttgatcagaatatcaaaagagatattaatatttactccctacttgtaaagttttaagtgaattgtgttgtcaggaagaggactgctaaggttctattctacctgaaactctgggctactctgtgagatcttttcatctattttttaaatctattttttatttttaaaaaaattttttagatggagtctcactttgtcatccaggctggagtgcagtggcatgatctcagctcactgcaacctctccctcccgggttcaagtgattttcctgcctcagcttcctgagtagctgggactacaggtgtgcacaaccatgcccagctaatttttttgtatttttagcagagaggggtttcaccatgttggccaggccggtctcaaactcctaacctcaaatgatccacctgccttggcctcccaaaacactaggattacaggtgtgaaccaccacgcccggtcgatgtttttatcgatgagaaagcaaggaaaacaaaaagagatggggcctagactagaagaaacattgcaagacgcattatagggtaaaagatttgcgaagcataggaagagcacctgtttccctgaacaaccggtttcctcaggtatttggtagaattacttcctaagttttggaagtttatttaacagaccaaacagatcccagggaaagtgtcatttctttccacagaaggaaaacgacagattcctttaaatgagcaattcctcagcaagtgccctaatgcagatcttaagcctcaagaaatcttggtctcagtgaacatcccctactcaaggaaggtgagaacatcccactgtcaatttcccagttgcacctgtgatgctatggcttgtttattccagtatatggtggaataagaaaaagggtgaagtgtttatgtgggagataaaggctcaacttcaggaagtggtatgaggtcattattttaagacttgtgaatagttgccttttccttgtattacgcatgcccctatcattcctcgaattaggagattttttttttttttttgagatcgagtctcactcttttgcccacactggagtgcagtggcatgatctgggctcactgcaatctctgcctcccaggttcaagcgatcctcctgcctcagcctcccgagtagctgggattacaggtgcgcaccaccatgcccagctaatttttgcatttttagtagagacggggtttcgccaagttggccaagctggtctggaattcctgacctcaggtgattcacctgcctcggcctcccaaagtactgggattacaggtgtgagccaccactcccagacttatctctgccattctcgctctttctccccctaccccaagctctaaagtaactttctaaaaggtttttgtcccataagcctttctccctaaatatgacatgaagagtatgcctctacctatatcttgggttttgaaaaaagcctaaaaatacatttgcaatagaacttattggaaaaaacatgaggctttgcatgagatagagtcaggtttgaatcctggtttcaaggcctgaactaattactgaatccttctgcgccttggattcctcatctgtaaaatgggaataatcaagcctgcctcagaggatgtattagtttgctagggctaccataacaaagaaccacacactgggtggcctcaacaacggagaatgattttctggagatgctgggggctgcatatctgatatcaatgtgatactcaacatacacataccgtccagcacgtaggtgatgctcaacacacacacactacctggtgtgtaggtgacactcaacacacacagactgcccggtgtgtaggtgatactcaagacacacagactgcccagtgcataggtgatgctcagtgtttctacatgtgccacttaactgtttctttcagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggtaaggcattagaagtaagggctcctctaatacttgtccttagactccaagtattagaggagccctttttgtggtgagatgtgattacaagaagaaaagtgttccatacctttctatttaatggctgggaattccaataagattttgttattatttccatatgtcttgatgttagtgaattctgaagtgggaattatatactctgtgtgcgtgtgtgtgtgtgtgtgtgtgtgtgtgtgtggagagagagagagagagagacagacagacagagaagccctccctcaacagtgcaaatttgtattctttattttgggagaataatttgccatgatgaaaaaccaattatgtgagtttgttctataataaattgttaaaggcatttgcttacctgacttcctatatctaaagatgacactaatagctaatatttcttgagcattacttggtatcagctgccataacaaagcatagtgattaaaagcatgagctttaaaacttgagaaaggcagactggccaaaatctcagtttaccctctgttaactcctccatgctctcagtcagcttacttaattatattggtactttggttccctagctgtcaaagatgggtgatcatacctacctcacagggcagttgagaggattaaatgagtgaatacatataaggtgctaaaagcagatcttggcatgcaataaatgtcctagtgaggacatttattagtgagtaaatgagggtcagttactcctggactatggattttatatgagttgtcacttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataaaaaagacaatccacattagaaacacacgtacttgctgaacatccctcagcctgtctgtgggtgggtatgagtttagggaagaattgaaagtagagccaagagttgatcaggcttttatttaacaccactcaattatttggtttctgactgttagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccgtaaggtggccatgatggcagccactgcacaagatgactgtgaaatgcgtcattgtaggaaaagggcttcatatggtccctagtgcttcagaggaaatctgtagtagtagtcataataatagtagtgacaatccatgcattcttttgcctggtctctcttagggcaaacaattaaagctacaagattcttggctggggaggacacaactaaaaaaaattctctgaataaatccattagacccaaaggagacttgagcctcattggcctcacaaaccccatgctataaccagctgaccaaaacagactggaagccaagaacagtcttcctgtggtatagaagttagtatggtcactttaaataggagacacaaagtcctctcttatccttgcttttgagggtatcttctcagtgtaggtgggagcaactaggaaccagaagggtagtatcacattattaagaatgaaaatttgaaatcatagataagtgacatattgtcaccaggtaaccaattatagactcctccaattagtagcaaactaatataatttctgggtgactcaagcgatgtaatttaaaacttttgccttgtagtcttatacccctcctctctttaaaaataatagcttttgttggttttatttaattttttttttgagacagggtctctgtcacccatgctggaatacagtggtgtgatatcatagctcagtgcagcctcaacttcctggactcaagcaattctcccacctcagcctcccaaatagctgagaccacaggcatgcaccaccatgcccagctaatttctttatttttttggagagacagagtcttaccatgttgctcaagctggtcttgaactcctggactcaagcaatcctgctgccttggcttcccaaaatgctggaattacaggcatgagccatgacacctagctggttttattttctattaaaattatgtaaattagaaaaaataaccaccatgtgtattgttgaaagcctttccccccatccggctctaggctgtgcaatgttcagtcttgtgtaaagaaccaaatgactcacttccctcagtcctgaggaatgttcttgctggggaccagaatccttcccctgtagggcagcgacagggatgcagcctgtgtccccctttctacacagctggcaggcaacatggaacctttatgcttatttgcaatggtgtactttgactctgatgttttcctggcttaagtattttcttcctttctattttatttacttagcttctatcttcttgttggatcagtttgtaagtcctcatatcatttaggagagtatatgagagaatcataagaaacatagagctggtggaagccagttacctaccgtattcatctggctattcataatatgaggaaatatgtatgcacctttcagagtatatgtccttgagtcagggagctgcttgtatttctggggttctgaatagggtgagtgcttaatatacgtgagacttcagagtagagatgcttgctaagactcatgctagcctcacttccaaaatcattctggtgcattcaaactatttaaaatatctgcaatggttctacttttcaggatccagttcactatcctagccttgcagacaagtatgaaagtgctttagaagatcttcattccaaacatcactgcagtacattaaagtaccaggtgagcggtatttcttgtttttaaaaattcacaatctgggctatagtgatttgacctggacattcccactgtctctccgtgaaactcaagctctgtaagtccaagctccacttctggtaaactcacagcctctttatgggtaactaaaattccaaaatcaatgaagaatttgattaaagacaaatctagcagtggtaatattaaagaagaatgttgatttgggtcttaaaggttacgtgctttgcactgtggccttgtaccacagacacgcatgagatggccaccttgtcacgtgttttctgccctgggcactgcaggcatcagagtccaataaagccacgctctgcggcaaggccatgggctgctttgctttcattttcagaggaaaagacacagcccctagaggttgatgaaaattcaataatgcttttaaaaagaactgctgatttgtttagcttgaatgttaagatattttactcccttagtctctattcttctagtgatttttctgtgagttacattttagagttgaatcaaacgtaagtactaagagctttttgtgctctcgtaatgaaggctattagaaaacaggattcctaactctcaaatggaattttctgccacatcataaaaatatgcctgaagtcaccctgttggtaaagtggatacagtttggtgggtttttccttgaaattattatcaggaaacttgacctcgagagttttagtaagtcaagaacatgaaaaggctttttaaagcatttgttcactgaaactattgttggatttggttgtgaaagcttatagtatgtcgtaatgaacattgacgttggtgtgtattccttgaggttttaggttcaatatgtttaaaaattaaaatgcaccaaactccattgaaaatgattgttttgaaagttaaaaacagctgccatctccccggtgttcttttcaaatatgatagttgaaccctttggcttataaataccctaatatttcttagacaatggaataaacttcagaaagaaacaacaacaaattaatggatattgaaatcatccaaagaaaaaggaaaatcttcacatagtgcatgatcttgaatgagagtttatcattgattgcaaaacaaagttttagatgcaatatgtctgccacatagatgagttttgtttttgttttgcccgtggtttttcacacacacatacaaacatccacattgctagagcaacgtcagcactcacgaagagcatttttcccctaaatcagttcatttgctttgaaaatattttgacacagcttcaaaagatcaccagtttgaggagacagcattcttccttccatagtatctttagccaaatactaagcagaagcaggtaattgaggacagcttctttcaccagtagatttatcacaactaactgcaaaaaaaaaaaaaaaaaaaaaaaaatgtatgatatctttgacggtaggacaaagacattttttggaatttttcctcagttttttggcaggcctcacacaacatggtttcaaaagactttttttcaatgtgatgaagtgttttgtttgttacagtgaaatgtgttatgtcagttaactcccagacccattacagatacctatgaatgtctttccttaatgtctgagcttatgaattatctggaattttgcttttcaggatgaaaaaacttcttagggttttaaaaagaagatgtgggtgattttttttcactcaaatgtggttcaggttgagagcccaagcagcatcacagctcagcactttgggggatattttgcagaggaagtcaattcctaccatctgcaacatatgaaaaaccacacctggtagaacctcattgttggtttttccttttcatcactatctcagctcctcgaagcagagggggaagaggagaactgaggggattcctttgccatggggacagggcagtgtgagctacgtcaatagagctggagtgttgggactgtctccaatctgtgctcatgcctgaaccccaataagtaaacttttctctcattttccctagtcccctacattcgtggcctaatatctacctttatttaatggagccctgggccaaggtctaaattatttttctcgatagtctcctgctttctagctgataaagtcaggatgactcaacaataactgaaaatgaaaaaacaaaaacttagtcaatactccgttttttgttcactgtattatactaactacaaaactgaagtttacatttaagtaaaagaaatatgaaattagaacaataaatgcttatcaacagtgtttattttgcagcaaaacagtaaattttatataaaataggaataaatgcatcctacacacatgtcttataccaagttaattgtagaaattacactactttctgtgcatagttgtcagccacaatttggttgacattttacttcttgtcatttatgttatgaaaataatatggtttttttattttcaaatcaatgttgaacatgttctgaaataacacatgccactctgccgttctctcctgatattccagccctgccacctgcctggagaatctctgatctctatctccagccagaggttttttgtttttttgaggcccttaagtagttgggtagtgagtggggagcactcttctcgagttcctggagcagcagagggcactggagaactgtacatttcacagctgtcttaagtaaagctctcattataaccagaggtctcctccatttgtgggattagatgaattaaatccaaatgttcagaaaggaaagcaaaacatctgcatgaaaaggaaatgtgttaatcggggggatccagacagcttgtcttcagttccatagagcaagagccttggagcactttcactggaccagggcggactttgaaacaggaaaccctgcagtgaagagtgagatgaaataccattttagatggattcaagtatctaacttattgttcatatgtgctgaataggctttctcaaactgcacattctggtaatcaaatacaaaagaatttagcttttctccccgctcagatgccttaaaggatgctatgttggaaataggcctgtttcttcttttttctcccagtaaagatttttaaccagtatgtgttggcgacttgttctctcttccctcctgccatatgatgtgtagcctggcattgtaaggctcatctaaaaggaagatccagggctcagggtgatcctgtgagctgcaggatgggaaggggaggtgtccatagcttttctctgacctcaacctggccaacatgactgcatgcccctcacccccaggtcttccagagaaagcctctgggagtctggcctcagtcccagtaccgagtgcaatgttgacacagtgagttacagatgggggtacccaccagggcttagcaggccactcctcagccacagccttcaccctggccttatgtctgtctcttcacctgctctccttctttcttcatatcttcagttcttttcacaatacacacccgactgggaaagccataaattcccatatttgaaacaccagggcagacattgtgctgattaatgtctgctttgattaatgaaacacatttaaggtatttacagagccaacagcaagatattctgctccatggggctctaagaaagagcaacattagtggatcattactccaattgcaggtccctttggcttcattctctatcaggattgtctaagttaagagttttgccaattatttcttatatttcctcactcaaaattgaaaaaaagaaggctattctggttgaagtaataccctcagtattttctacaaacatagtcacgatatcatcatactcttctgtaaaatattatatgtatcgtgcttatatagaaacagtaaagtcattttgataataaaatttaaagagatacataagcattagcaagaggacataattttgtattgtcaagaagaaagatttaaatttgtttacttacacaaatggaatttccatttgagatgtttggggtctacattcaaaaaaagtgaaaaataagaacaacatcatggattgacataccagttggcttattgaattactgtagtaggtttattgtcttggtgttattaatagtgacttttttttttttttttttgatggcgtcttgctctgtctcccaggccggggtgcagtgctgtgatcttggctcgctgcaacctctgcctcccaggttccagcgattctgtagcctcagcctcccgagtagctgggattacaggcatgtgccaccgtacctggctattttgttttgttttgtttttttttagtagagacggggttttactatgttggccaggctggtctcgaactcctgacctcaagtgatctgcccaccttagcctcccaaagtgctgggattataggcatgagccactgtgcccagcccaatagtgctttttcatatgcaaaagtattctggtttgagtctaaattatatagctaccttcttatgggaaatgtgcataataataattcctactttctctatagaaatgtaaaagtatattttggttatttattaaacagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtaagtggtaaaattcttactcaatgggcataaatgattgtcttttcatctaagtcacactagtgaaaagtaatggtgtgaagaaataggctatttgttggtgatatccaatgcagaccagaggtgaaacaggatcgaaatgtaggatttactacaacttcgttgtcccaagaattttttcccaattgtctggcagagactgttggacagttcttacctctctcatatcttattatccaattaaccatgttcttggcctctatggccactctaaggagctctgctgtgtatatcatctaggtctattgatctgtcagaagctctcagcatgcccggtgtggtggacatcatgacagcagaacatcttagtgacgtcaactccttctgcttttttactgaagctgagaaatttctggcgacagataaggtactgcatttttgctttctatttgaaaaataactttctcagttaacggtgcttcatattttcttaaagataccatctactttggcacaccatgaaagactccagtattcttagaatgcttattataaaagtatattctaatattgaatgaattcaaatatattcattttctgtacaagtaaagacattaactagttatataaaagattatttggtgttttacattttctaatagtgagatggcatactgctaatggtataaatgagtaaatgaagatggaataatggtaaattttatatggaaatcccttccctgagaagcccttattattgtcccagtctcagtatggtcaaagttcaactacaagttcaagtggtatctgcaccatgaagccttttttctcattcttcaatccagaagttcattcattctctctctctctctctctctctctctcaatttattctgatttatttatatttccatgtgttaaatgcgctttttattttttattttattttattttattttgaaatggagtttctgtttgtcacccaggctggagtgcagtggcatgatcttggctcactgcaacatccacctcctgggttcaagcgattctcctgcctcagcttcctgagtagctgggattacaggcacaaatcaccatgctcggctaatttttgtgtttttagtagacagcatttttgccatgttggccaggctggtctcgaactccttacctcaggtgatctgcctgcctgggcctcccaaagtgctgggattgcaggcatgagccaccacgcccggcttaaatgggatttttaaaagtgagcatctatgatgtctggtcaccatagctgaacaagatatgtatgatctctactctcatggagcttaaagtctagaggagaaaacaaagtgacctttatgtactttctaccttgtgttaagcttgtttattttgatgtcttatatatttcttccacctagtataaattccttgagtgaggacccatgtctgattcatctgtgtattccacacactgcttctcacattgcagggtgaatgagtagaggtatagtgataacattgttgccttgtgaaaattacaaatgattaaaactttggctacagcaagaacagcagtcaacaggttttctgcataattcggactgctcagttcagtgtttacccaaaagggcttcataatttgaaacagtcccttcctctggctctccttggaagatactcccttgaagatattatctgtagaaatgaaagcttgatgactgagagtttgaactcaaggttgaaactcccccaaagcagggctgtgtagcactggcagagacggtgagaatttaagccctttgcataaatgtttactaaacaagtgaaactgatcttggctgcatgatagtacctgctctttgaggtgtgcttatgaagatcataagcatctcaggggccacatctatgtgccaggtcacaggagcaaaatcaggagtctttggagtgccattgtgaatgattgcctttgttggtttaatgctttttaaaacattcatttatggcacttaatggcttttaaaagtcttttcattgtagaaattgtaagcatacacaaaaatgggaaagtattatacaatgaaccccatagatccatcacccagcttcaacagttatcaacacgttaccattcttgtttcatttttctctccttcactgcccctaccccaaacaaacacactttttttgtgttcatgctagattttatgtttttaatgcctttttttcgatgataaaactactttatgttcattgtggaaaagacataatagttcaaagtcaatttttaaaatgagtgattacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagcctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgttatcacaggggactccccttcccaggtcatcccctttttctctctggttgagatgatctgtgacttcctggtcctccctgtccgtgcaggcagaggctgcctctctcagaacagctctgattgtcgtgtgacagccaaacatcaagccatgggacaggctggccctcacacagcctcataggcttggcctggagcctgagcctgctgtcctcaagacagcatcactcctgctcctctgatacagcacaaggatctaaacttcccccagtgcctcgggtcaggaggccagctgtggttatagtcatggacagatgtggaggggtcacacctgtgtgtatctagccctagccctactgtaatcgagtactaggagggaggaagaaaatgaataaaagagaggacctgatgcctgccctccttgacaacaaaggtctttctgtgtcgtaggtgttctgtgtgggtcagcttgtctgtgctgtgcttgccgattctgaggttcaggcaaagcgagctgctaagcgagtgaagattgtctatcaagacttggagccgctgatactaacaattgaggtaatgagttctgtggaatggtggtgccagttgggagccagaacaaatatcagttaaaatgcttttggctactgtaacaggaaaatgtggctcaaagtggcctccaaagcacacggactttattaacctctaaccagtctcagtattaacaatttccccaaggacatggcttctttttgccactcttctctgctgcccacaatacaagctcaattcctgtggtcacacagatggccgccaggacaacctggacttccttgttcatgttcaaggagtaagaggaaccctattgccccagcattctaagcacaaatcctgagatccagcctaattaagccacttaggtcacatatccatctccaaattaatgactggcagaggaatggaggagctgttggttacttctaggggtaggagttggggtcaggtttctctgaagtaagtgggctatgtaggggagtgtaggaaactgaaacaaatctgagccctgtttggaaagggaaaggggaggggatgctagatgggaaacagtgatgtccaggaaagtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaatttataaaggctataagactcatctccatgaaatgataggatgttctcttgtgtgcattccattggttcttataatttcctggatgatgaaagaatgaacactggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaatttttcttacattttaaaataaaaataaaatcatgtcaaatagacaaaaacgtagaagtctaattggagtcgaagtgtgattaggcctcccaaattttcctggccagtttcaaattcaaacactctgttcccttctcaggcccttttcatttacatgttgcatgctgctcttgcttcatatattctgtcccctgaagtttgctggagagttagaattacttattagaaattatttacgtaacacttcatcaatattttgtttataaatctttgcccaatatcaggggctaaatatctactctccactccccctaccttccagccaaataaaagccccaataagcaaatataatagatgccactccccccaccctcaccacttcaaccagcagactcgtgattgtctgccagagaatcccagcatcagatacaagctctggctttgtggaaaagagttgcctcacattgtgttcagagattaagctctcaaagtctaaagatcatcaactggatcagagcaaatttaatcaaagtttagagcagggaaatatgcccctctccctatacattacagttcttttatcactttcctgactaagaaaaattcagaaaattggctcaaagttattcaaagagcaagcagccagtgaagttgaaaaagatgaaacttttaaaaataggatttataaaacctagcttttttttcaacctggaatctctttaatcttagattaataagaaaagcacatgaacagattccaataggaagtgtgttatcaatcaaaatagaacaaaaacaaatatatctctgtcactatcacaaagatttaatctggcacatgcttttcgagtttttagtagattgaatggggcaacgatcaaaactcttgaatcaaggggtaaggctgatgaccataatggaaaaaaatgtgttccctaccggaatctgtcctgaataataatcatcaacaacaacatgagcatagctaggacctatacagagctcactgtgtggtcaacatggttctaggtcagtttcacacattaacttactaaatgctcaccacaatcctatgaggcaaaaactatttttatccccattctgatggggaaactaaaagacagggttacccaaggttacatagctagtcagtaacaaaaacaatcaacaaacactctgtcaaagaacctgggccccaccggtgctataaacaaaccaacccagtttttgaatgggggaaatggcagaatcacaatagcccatccctctaaggggtgttgtctagacacctactggtggccagaaggaaacagagataagagaatccccaactaccaacagaatggaatttcatggatggacaataacccacagtagataatgccagcaggagctggcacaccacatttgccagtggacacatggattactgcaagataaattctcagggatagctaaaaaccaacctatgttattgtaactacatctctggttatgtgcaccactgtacccttttactgggcacccagggagagccaataggagctagtgtataaatggatttgtacacccagctcccagacagggcttgtctgaaatcttacttccagagctggaggtcccaggtgctctactgccctgtgcaaatgaaatgctcatccccgcaaagaaggaatatggggctggcaggcagagccaccatgatcccaatcactagagtcttttcaactagcaattattgagtgtttactatatgcaatataagctcttcacgtcttatttcattttatcttcaccaaccacgatcctattggagctatatgcacacctgttacttccattttacagacaatgataagagaggtgaagtgataggcccacagtcaaagctggtaagtgggaaaaatgtgtgcacaatgctgactgggtctagagcccaggctctgaagccctgtgctgtatggccttggctacatgaaatggattgtggtgtgcagacaataacctgcctggaaaatactagtttcattctgggatcacttagatgccagtttttttctgtgcatattatttcttcagactcagtaggcacatttacatttcctcactggggagtctctctgcagttggattcttagcttggctcaccagggtcatggtgaaagtgcacggaaccacaaggtgaagggagaaacaacccctgctcagaggatgtgcagtggggtgtgtctgctgccctagggcagggtctcttgcccaagctgcctcattcctctgttctctttctaggaaagtatacaacacaactcctccttcaagccagaaaggaaactggaatatggaaatgttgacgaagcatttaaagtggttgatcaaattcttgaaggtaaaaagtaatggaagagtaaacaaccctggaagtcttctaagcatgtcagtttaaggcttcctttgtcttctggaaatcatcgggcagcctaggggggtgttgctcctcaggaacaggcagaacaggcacctcattcacaaatgtgtttccctccgtctctggggtaggccaagagccaatggggaggcaaaagaggaggcaagaccctgcccctcttccctgaccccccttccctcatcaaggctccagttgttagagatgtcattttctttcctgttcacaaccaccctgcaagagggtattattatctcaatcttataggctggaaaatggaggctcagcgtaattatggagtgtgaccaaggtcacacaacaactactaaataacagagttggccattgaattgataggctttattaggatttccaaagcccatgtttcttcttcatcctttctctctctgattctccctctcttcctttcttccttctctgctttttcttcccttcctcttcccttccctttctcctttctctttcttccagacttctttgctgtatgtatgtatgtaattaaaattaaatttgcctcttagaaaatagttaattatagctttccagtacaattccttaacttttggctttgaaatattttaaaacttacataaaagttgcagaaacattaaagaaactcccaaatatttttcactcagattccccaattatacacacacacatacacacacacacacttctgagccatttgagagtaaattgtaaacatgatgtatgtctctttacccctaaatagtcagcatttgtttcctaaaaacaggatgttgtctaacataaacatagttatcaaaatcagaatattaacacatattctattaatctacacagtttattcaaatttcgctagttgtctcaataatgtcctttatagcagaaaaaagaggttcatcataagtcttaaataacccatgctttccccgccacactctgctgtcattgctgctgtgaaagctgtcctaatgcctgcctcacaagatctctgatttacagacatgctattgggtgggtatgggcagtctgtgccacatctcagagcagagaaatcatccggcattatctgtctttaagtgaatttccagggcattggcctctagtgcatgttaaaaactcccatcttctgggctgggcatggtgactcatgcctataatcccagcactttgggaggccgaggtgagtggatcacttgaggccaggaattcaagaccagcctggccaaaatggcaaaaacccctctctactaaaaatacaaaaattccaggcgtggtggtgggagcctgtaatcccagctactgaggaggctgaggcacaagaatcgcttgaaccctggaggcagaggttgcagtgagccgagattgcaccactgcactccagcctgggtgacagaaggagactccatctcaaacaaacaaacaaacaaacaaacaaaaaacacaactcccatcttcttaatttttctcaccaaccttgatcacaagaataggaagagtcctaagacacatcccatcctgagtgcacagccagagctgtgtaatatgtcaccagtcagcccagcttcttaagttccaagcccatcatgtctcaactctataggtgcattaaacttgaagcgtgtcaggggctgactggaaatgtcacctgaaagctgtaggaaagacacctggaactgtcacctaccagttttccttggcattgtgtcttattagctgtgtaacctggcagggcacttctcagggctcagtctccctgttttaatattacatggataaagtaaaaacaatttcaaatgtgaattataaagattataagagataatcatgtgttcttggcatatagtaacaaatcaataactgtgagcaatgattattagatttagatgtttttgttgttttcctgaaaatgttgtctattagtgagatacgttggcaggtgttcatttatcaaacccagtgtttccaagattttctccttataggaatcactgaggatatttatgagacctagagatccctgtgcccttttttagaattgtagaggatccaaaacagcccaggaactggtcttaacaagttttccaggtaattcttagggctagtaaaatgtggaaaatactggaaaagtgagtttgatttatgggaatgaagagaaaaagagggtacatttctatcatagagcgttcccggcatgagcatgttggaaatatcaatatttaggggggttccttgtctcatgtttgtttcctgacataatgagtatttgtgcaagaattccattgttgtatttttccttgacatcttctttaattatctaattcaattaggtgattgatttagtctgcctcttacttgaatttttgttattgctgcataccccattgataagtataaaaatgatacgggaatattaaaaaggacatttatactacttttcagtataaacgccagctgcagtagctcacgtctataatcccagcactttgggaggccaaggcaggacatttgaggccaggagtttgacaccaacctggtcaacgtagcaagataccttctattaaaaaagaaaaaggaagccgggcatggtggctcatgcctgtaatcccagcactttgtgaggctgaagcaggcagattgcttgaggccaggagtttgagaccagcccggtcaacgtagcaagactccttctatttaaaaaaaaaaaaaaaaaaaaaaaaaggaagctgggcacggtggctcttgcctgtaatcccagaattttgtgaggctgaagcaggcagatagcttcaggccaggagtttgagtccagcctgggcaatatggcaaaaccctgtctccaataaaaatacaaaaattagccaggtgtggtggcaaacacctgtaatcccagctactcggaaggctgaggcaccagaatggcttgaacccggtaggcggagattgcagtgagacaagatcaggccactgtactccagcctgagcaacagtgagactgtcaaaaaaaaaagatggatggatggaaggaagggaggaaggaaggaaggaaggaaggaaggaaggaggggaagaaaagaaaaggaaagacaagggaagggaaagacaagggaaggcaaaagaaaaccaattttcatcctcttgactcacaagtttgagtctagcttttccctttgtctgctatcgtcttttggattatgagtttctcctaatatctcatgatatttcaatgcgaggtaattgcaattaattatcatagcaacactttatctgtcttctaagaaaataagtgtcccacactggggcctgtaggagtgggggtaaggggagggagagcatcaggaagaatagctaatgcatgctaggtttaatacctaagtgatgggttcatctgtgcagtaaaccaccatggcacacgtttacctatgaagcaaacctgcacatcctgcacatgtaccccagaacttaaaagttgaaggaaaaaaagaaagaagataggtgttccaagaaaaaaaatatttaaaagataaaatatgtggagcattacatcaggtcttagaatgcgttcttggagggagaactattattgtttgcacttatctgctgcgaagatatatttcaactctatctaatcccggtgtcacagcaccagaggatgctaaagattaccattttcaaatgagccagctgaggctagagaggctacctgattgaccaggatgaaatctaagagttttcccaactccaaagttagtattctttcctctacattatcctgcttctcatttatctcattaaaattctgttagctgggatgtgctttatactggagagcacagagaacaatctgtatagaaggatttgcaagagacccagggagccctgaaactgagatgattttccccacaacctatcctgctgggcatggtacagatagacacattcacatcttagcagatttgggactttaagggcctcttattaaaatgtaaatatgcctggaggaatcactcctaaacccatactgggataacattttatctcagggattagttgatcaaattggtttccaacctagagagttgacagcaataccctaaggtgaagagggggcactacgggtgggggctgtcagggtaggcagtgcaatataacaggtttctaaaactttcccttctttacagatttaaacaggaacagctctgtctaatttttttagctctgaatattttaaataaagtgactacttaacaaaataaattctgagtggataggcagaatcaataatactgcaagcttgaatgtaagcctagtgacaatgacatgggtctttagactatttgataagagcttaaattgaagttaagatctgagcttgtgaaattttaatgtttatatattataagtgaagcagaatctattcatttttctgtgctctttttttaaactcagattttcgataagataggaagtccagattgcaatttaaaacatctcattttttatgcaaatagagggaatcctcaatttgcaaatcactattgctgagtaaatttttaatttttaaaagttctgccttccattaacatgatcgtcagtaataattgtattctgtttgttccctctgctttttattcttttccccaccttcctgtgggttgcctgaatatttgcttagaatttcattttgattaatctatagtattttttagtatacctccttgtacagattttttttagtggtagctctagatagtttacacatatacatatacacatcatatataaaataaaatttatatacatataaaatatttacatatataaaatatcacagtctggtttcaacattttacaagttcaagtcaagtgtagaagctttacctccctttacatccctctccctttttataatataattgataattctatttatttattctacatacattgataatcacatgaagcaatgttataattttgcttcaaacacaatttaggaaacccaagaggagaaagaaagtctattgtatatactggtatttttattatttctgttgttctttcttccttcctgatattttaagatttcttcatttaaaaaaaaaaatcattttctgtctgttttaaaaacttccctcagccattatttcagggtaaatccgtttaaaacaaactcttagttttccttcatctgaaaatgtcctcatttccctttcattgttgaaagatatttttgctggctatagaactctgagttgacaggtattttcacactagaaaaattttaccacttcttctggcctccatggttcctgaagagaaatctactgtctttaaaagtgcttttttttttctttctttctttcttttttttttttcagatggaatctcactctgtcgcccaggctggagtgcagtggtgtgatatcagctcactgcaacctctgactcccaggttcaagctactctcctgtctcagcctcctgagtagctgggattacaggcatccaccaccatgcctagctaatttttgtatttttagtagagacagggtttcaccacgaaagtacttttctcctatagatgaagtagtgtttctttctcatagctttcaacatggtgcttttgtccttagttttctgaagtttgactatgaggtatcttggagtgtatttctttgaatttattctatttgggatcactcagcttcttgaatctgtagattagtgtcgtttgtgaatttggggacatttttagccattatttttcaaataatggcttgacttcaatggcacaaatattagatcttttgttatagccaatgggttcctgaggtgctgttcattttttttccagtctatttttttctgcttttcagattggccaatttctattgttctatattcttgtacattaatcatttcctctgttctccctattctgttgctgagcccatcccttgaactttttaaatttttgctgtatttcttaattctaaaatttctatttcttttttctttttatattttctatttctttgctgaggtttctattttttcatttgtttcaagtgtttgtgtaattgcttattaaagcatttttattacagctgctttaaaatccttgtcagataattctaacatctgtgtcatctcagtgttggcatctgttgattgtcttttctcattgaagttgggattttcttggttcctggtatgaatgatatttgattgtatcctagacattttagatattatgtaatgagactttagatcttatttgaatcttctattttattagaatattctgtttcactagagtactttaaccttttactgatggagaagaagggggtgatgccttgttactgctaggtaggggttgtaagtccaggttccccatgtggcatccactgacagcaccccaatagagaggctgggacacctcattgcagcctgatgagggtggaactatagatttcctactcaaccttcacagtaggggtggggctgcagtttttttcatggtgtttgcctggagtagagtgcttattgtcttaatttttttgtctttctagtcttccacttttctggtcctttggctagggagagtgggcttttcttgaggatttttttttttttttttttttttttgtctttgcctgttggagtttttagattgctggcttctccggaactaagtctgggatatctgaggcaaacaacaacaacaacaaaaaaacccactgaactcactgctgtgtcttttcttaggtcctgaagtccctagctggtctgccttctctccacctttcagagtcttcttatgtttgttttataaataatgctcagggttgttatctgtacttaacaggagggacagggagcagtacatctactcctgctggtcctagagctggaagcctccgcattctcacattcctacgcctctgctaacagcgctggctccttatgacctactgaatcaagacccctctgcttttggctctagaaagtcatacacctttctctaggactctgtgacctagatattggcagacacaaaagattctcctatagaactttacttcaaatctgcaagtagactgaaagctaaacattgttgtttgttatacttcactgtgcccagcagaagtactattagtggaatttctgcataacgggataatacctgggggacgctacctgttgcttctgactgcttccttgacttttatgtattttcctgtaacaggtgaaatacatatgggaggtcaagaacatttttatatggaaacccaaagcatgcttgtcgttcccaagggagaggatcaagaaatggatgtctacgtgtccacacagtttcccaaatatatacaggtaacatggggccattgtggagaggacatggctaaatgatttctggccagtgaaatatatcaagagcaattagaggtaaaagtatatttgggaatttgaggtggggggattgcttgaacccaggagctcaaggcttcagtgatctatgatcacaccactgcactccagcctgggagatagagtgagaccctgtctctaacacaaaacaaacaaaacaaaaccaataatgttatttcttcagggactgaagaaatattgagtattaatagccatattgatttcagtattaatagccatataagttcagtgcttttaaaagagtgttattaaagtgggagccttttgtttgtggattgtagctttaaaaccagttatggaatcagcagatctcttgctcagctcttggcaccactgttaggaacacaagagaagaaagaggaagacctgctctccaaagcctatggtgcctaactcacaggaaacagttaagaaacaatattgaaaattatgcaaccaggtgctaaatcagcaaaggcaaaatttacgtgggtggagaaattaggaaagagtttgctgagggctagaatcatccaggaagtcccacaaagaagtcttaagtttggattcagaatgagagtgaggtttgtctagatggtaagacaagagaggtcacttccaggcaattccacagcaagatcaaatgacacccattcatttattttctcacctcttctgcaaacatttgttgcctgtgtcctgtaccctacgcagcatgcatggaaggaaggaggaatagcacaatgaccgccccagctggaatgaaggggtgcctttaggaaagctaggtttaagcatcagggtgagagtaagggaaatgaggcagggggtcttgattctggtcataaggagccagtgctcttagcagaggagtaggaatgtgagactatggagaatgaggcctcgtaaaaggcaggatcctaaagagggtcagatgaactccattccaggcctgcttttctcttcactctccgtgggatgttgggtccataacctcatccgtctcaggcttcccatctgtaagaatcaattgttaagactaaatgacccctaatcattaggatggcagaaaagagtgagatctgcatctaggaaaagaccaactggtcatctttagcagcaatccaagcaagaagtgagaagtgctttttttttttttttttttttttttttttgagacagagtctcgcttggtcacccaggctggagtgcagtggtgccgtctcagctcactgcaacctctgcctttcaggttcaagcgattctccggcctcagcctcctgagcagctgggattataggcacgcaccaccatgcccaactactttttgtatttttagtagagatggggtttcatcatgttggccaggctggtctcgaactcctgacctcaggtgatctgcctgacttggactcccaaagtgctgggattacaggcatgagccaccacatctggctgagaagtgcttattttccagtagagacagtagaatgcagggaaaagacccatgctgagtgaggcttagaagactgcaaaatcccacagctttgggaaacgtatgcctagggattagtgtgaatagaatactttaggagtggttcctggggaaaatacaaaaaagtatgagtacaaaaatatctcactggtaatgaaaacactactaattagttttggcaatgtcattatagccaagtattgctgagatcagttggggctgtgggccagggttgttggacattatcccattatttagcataaccacacagtatgggtatcatgtgcaacattaaagaatcaaaacatctagtgactgtcacagtccatttcaggggacaggttttttgttgttgttgttaaaatcatagatgtgacaatgacagtcacaattaagtccttgctgaagatggatcagattaatcagaactattattgttcacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaagtaagtggagaaaatctgctaaaaataaagtgaagtcacactgaaagttctcactgtcagaatcaatgaggaagaacctgggccaagattatttaatatcacatatacgatacaaacacacaaacaagctgccagcttattacacttacttgtcttatattgtcctatagcaaccaaaataagagtcaattactgaaaataataaaagccacagaaaaaatataatacctagaaagtgggcagaaacaggtcctgaatgggtgggagttacttgtcctcagcacctgctggactgagctatatatgtagaggtcatatatatggctttttgaacaatgtacctatatatacatacacacatatatatttatatacatataaaccatgtacctatatatacatacacacatatatgtttataaacgtatatgtatgtttgtgtgtatatatgtacattcttcaatatatcaaagatatttttgtaaaatggggtcccatatacacacatacatatatacatatatgtacatatacatacacatatatacatatacgtgtatgtatatatgtgtatatatgtatatgtgtgtatatgtatattttcttgatttaaatatagactttgcttttgttatgcttacattcatttgtatcgccattttcctttgaggatctcaaaaaattctcatgtaaaattgtctctggagcaggcacacctagaaggcttaatttgtttgctgagtaatatgggtcagttcctccatcccaggaagcaaaaataccttgattccagatctctcctatcagggagcacttggtagttagatctgcattcttccatttgtggccagtctaaagaccttgggacgatttgcctataataaaggttgttattacaatgggaaatgcccccaaagcaatgtcctggagcccctggcacccaagagcctctgtcccacaagttgcaaatgcctggcattattccctgacctaacgggaggaaagcccacggtgtatgcctgagatcagcagaggataggcatgcgaaatagttgtgttgttctgtgaggcgtgtaggctccactcaggctcttgccaggagttatataaaccccagagaatgcctgctaagtaaaagaggttacctcacttactttttttctgttttagacatggccgtgcagttcgctgtgttctggaacgaggagaagacatgttaataactggaggccgccatccttaccttggaaagtacaaagtgagtacaagagggcatggaggaaggatttatgttgtagatacaacatcctatcagtgcgcagggcagtctttggctactctctagtggggagtaacaatgagcaaatcaaaaacagagcatctatttaactttctattggttgcactgacttttaattactagctggttcaatggaggcttttctgcttagctcaaagatgtcagtttcagaaataaaacactaagtgctagctggtattggctgtacagagcaaataactagaaaacgtgagtgtgtacgccattaaagtagatctgattaccatacttcttcccacatataaaagaggtaaaagtagaataattctcataacagtagtgttatgtgaaattgcaattatttgtaaatgggttcctcattcttcaatatatcaaggatatttttgtaaaatgaggttccagaaattcatagaaaaaaatttgtagtagaaaatagtgattcttttgctttataagaaaaattttacttctcagagtgggctaacttctctaagaaacaacttaaaagctcttaaactttcattacgtcatttcttgctcaagtaacagctcaatataatgctcaatataatcattgaggggggaaaggggaggattctgctttataaaatcattcagggactggagctgtttccatttattggtgccactgtgccctcagactgcatcatccaatatagtggtcactaggagcatatggctatttaaatttaaattacccaaattaaatacaattagaaatttagctccatagtcgtattagctatattccaagtgctcagtaggcacatgtggttagtgtctgccatattggacagtgcagacgcagaacattgccatcatcacagaaagttttattgggtatcactgccctacaaactctgagtcttccaggggatcttttgctgagggcagcagacagggaagcgagagagaagagagcatggagtgtcacctggtaggtgttttaggttttaggcaccggacctgtaagttgtggatctcacttgtatccagatgtcattggcgagacctctgtcacctaactgtaagggaggctgggaaatgtcatcttcctgtgtgcccagaatgaaatacaataggatttgttaaatgcatagcactgtctccatcgcaaaactgcataactaatacatgttttttaggagataatgaatgtttccatttcaaaccacactcactctaaactgtattttgaatttgatttagctcagaaagatttgttacagtaaacttcatcctgaaggagattttttttaataagacatatatgaagtcattatgaaaatataacaatctcaggttaaaagatggagagatgaatatgaattggaatatatataggcactttgttaaagaaggtaaaagataggtcttcaagaatggaggccaggcacggtggctcaggcctgtaatcctagcactttgggaggctgaggcgggtgaattgcctgagctcaggagttagagaccagcctgggcaacacggtgaaaccctgtctctaataaaaatacaaaaaaattagccgggcatggtggcaggcacctgtaatcccagctacttgggaggctgaggcaggagaatcgcttgaacctgggaggcagaggttgcagtgagccaaaatcgcgccactgcactccagcccgggtgacagagcgagactccatctcaaaaaaaaaaaaaaaaaagaatggataggcagaaggaaggcatgccaggtgtgggaatagtaagagcaaaactacagaggtgtaataaacatggcatgtttgatagaggcaagagtaaggggagagggagaattagaacacagagcacttcctggaaggtagtaaaaaataggattgatgggtttaggtgatgcctgactgagaggggcctacagtcccagagtgggaagtttaaacttgatcttaaaagaaacagtgagactgagtggatccttgaatggctcagtgccgtaattaaacacagatgctttggggagggtaacaggatagtctggggaggagagaggatggaagctggtagacagcgggaggcagctgatgcattcagacatgaagcacatggggtctgagatatgacagtaagttgtagaagagatgggtccaagagccattatagtgtaaaataaaagagaattggtgaaaatcttggcaaaatgctatgaagaatacaaccgcaaacatgacttggagggttttagaagaaagcgacaagttggaaggaggaaccgatctggaagaacgatgaagagcttgtttgtgtaaatgctgggggtagaagtgacaacaggaccctgaagcagaaatgtcctttaccaccatgggactttgctgaaaggactggattatagtgacagaagccattgtcataatggtgactaaaactatgagaaaataatgttttctgatggagagtagtgtgaggaaaggtgatatgaatactacttacgatactattattaattatatttagagtacttgctatgtttcaggcacttgcctataattttctatgtgttgccttatttacttccatttcacagatagtctgagtggttacacagcttgcctaagatcacagagctagttatatactatccgagaaatcactgccaaatccaatgtcatgacgcttttcccctatgtgtggagggtttgcaaatgacaaaatttggagagacttggcccctgttccagcattcgatatcggttctcttccccaggctggattcatgaacgatggcagaatcttggccctggacatggagcattacagcaatgcaggcgcctccttggatgaatcattattcgtaagtgttttaaggagcaagttcacattcctgaaaagagtgttatataaaataatttaacttagaaaatgcccaatagttaagtaatatttgattataaaggtataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccccaaacaaaaatgtttcaaccaggccagacgcagtggctcacacctgtaatcccagcactttgggaggctgaggtgggtggatcacttgaggccaggagttcaagaccagcctgaccacatggtgaaatcctgtttctactaaagccgggtatggtggcacacacctgtaatcccagctatttgggaggctgaggcaggagaatcacttgaaccccggaggcagaggttgcagtgagccgagatttcaccattacactccagcctgggcaacaaaagtgaaactctgtctaaaaaaaaaagagtttcaaccaaaatgttaacaatgaaaaatgtctccagacattgccagacgtccccaggagcagggaaaggattgctccccattgagaaccaatacattagacccaatgccaaaacatttttttctgttttcactgtcttccaggatattatattcattacattctatagacccagtgctcagggcctgtgaacatatcaaaggcctttgtatatatttgaaatcttaaaaaatgcattaactccaaaatacaaaaataaaaaataatgctctcaaaggaaaaattattctaatacttaaaaattattttacagcaaaaaatgtgtttaattgggggcatgggaatattttagcatgttagatgagatgaaaagagagctgccattttcggcctggttttggtctgaggtcgtaggatggtgaaacaggttcagaagatcttaatcacatcaactctggatttctccaggtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtaatactaaatcagcttcacagacaaaacatgtggaatgtcagagacggtagggcctttgggggccattcaggttgaggaatttgagacccagaggggcaaatgatttgtgccaagtcccccagctaactggttaatgcggagcccagactccaaagttcagcaatactcaccttactcagactcctgctccaaaatcctgaagcagaagatcctgaggactgagcactgcattctcccctggctggtgagaagcttccattggctgggggtataactgctacccacaattccatcaaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatacacacacacacatatatatatatatacatacatacatacacacaccacagtttctttatccactcattgattggtgggcatttgggttggttccaagattttgttattgtgaattgtgctactataaacatgcaggtgcaagtatctttttcgaataacaacttgttttcctctgggtagacacccagtagtgggattgctgggtcaaatggtacttctacttttagttctttaaggaatctccacactgtcttccatagtggctgtactagtttacattcccaccagcagtgtagatgtgttccctgttcaccacatccacaccaacatgtactgttttttgattgtttgattatggccattcttgcaagagtaaggtggtgtagcattgtggtttcagtttgcatttccctgatcattagtgatgttgaacattttttcatatttttgttggccatttctatatcttgttttgtgaattgtctattcatgtccttagcccactttttgatggggtcgtttgtttttttcttactgatttgtttgagtttcttgtaggttatggatattagtcctttgtcagatgtatagattgtgaggattttctcccactctgtgggatgtctgtttactctgctggctgactgttccttttgccatgcaaaagctctttagtttaattagctcccagctatttatctttgtttttatcgcatttgcttttgagttcttggtcatgaaatccttgcctaagccaatatctagaagggattttccaatgttatcttctagaattttaatagtttcaggtcttaggtttaagtccttaatccatcttgagttaatttttgtataaggtcagagatgaggatccagtttcattctcattacatgtggctagccatcctagcaccatttgttgaaaaggatgtcctttccccactttacgtttttgttcgctttgtcaaagatcagttgggtgtaagtatttgggttctctattctgttccactggtttctatgtgcctatttttatacactactacaccattttgttgactatggccttatagtatagtttgaaatcaggtagtgtgatgcctccagatttgttctctttgcttactcttgctttggctatgcgggctcttttttggtatcatgtgaactttagaattgttttttctaattctgtgaagaacaatggtggtattttgatggggattgcactgaatttgtagattgcttttggcagtatagccattttcacaatgttgattctacccatccatgagcatgggatgtgtttccatttgtttgtgtcatccagtgttttgtagttttccttgtagaggtctttcaactccttgattaggtatattcctaagtgttttattattatcattattatttgcaactattgtaaaaggggttgagttcttgatttgattctctgcttggtcgccattggtgtatagaagaactactgatttgtgtacattagtcttgtatccggaaactttgctgaattcttttatcagttctaggagctttgtgaaggagtccttagggttttcaaggtaaatgattatatcgtcagcaaacagtgacggtttgacttctctttaccgatttggatgccctttatttctttctgttgtctgattgctctagctaggatttccagtaccatattgaagaagagtggtgagagtgggcctccttgtcttgttcccgttgaatgccttcaactttttcccattcaatattatgttgaatgtctttaacttttccccattcagtattatgttggctgtgtgtttgtcatagatggcttttattacattaaggtatgtcctttgtatgctgattttgctgagagttttaatcataaagagatgctggattttgtcaaatgctttttctgcattgagatgatcatgtgatatttgtttttaactctgtttatgtagtgtatcaaatttattgacttgtgtgtgttaaaccatccctgtatccctggtatgaatccctcttgataatggtggattatgtttttcatatgttgttggagttggttagctagtattttgttaaagattttagcatcaatgttcatcaaggatattggtctgtagttttcttttttggttatgtcctttcctggttttgttattagggtgatgctggcttcattaaatgaatttacttaaggttccttctttctctatcttgtggaatagtatcaaaaggattggtaccaattcttctttgaatgtctggtggaattctgctgtgaatccttctggtcctggactttttattgttggtaatttttaaattaccatttcaatctcgctcttgttattggtctgttaagggtatctaattcttcctgatttaatctgggagggtgtatttttccaggaatttatccatctcttctaggttttctagtttatgtgcacaaagttgctcatagtagctgtgaatgatcttttgtatttcagtgttgtcagttgtaatatctcctgtttcgtttcttagtgaggttatttggatttttactcttcttttcttaatcttcctaacggtctatcaattttatttatcttttcaaagaaccagctttttgtttcatttatcttttgtactttttttccagtttcatttagttctgctctgatcttggtaatttcctttcttctgctaggtttgggtttggtttgctcttatttctttagttccttgaggtgtgaccttagaatgtcagtctgtgcactgtcagtctttttgatgtaggcacttagggctatgaactttcctcttagcaccgcgtttgctgtatcccagagattttgacaggttgtgtcattattgtcattcagttcaaagaatattttaatttccatttgatttcatttttgacccaatgctcattcaggagcaggttatttaatttccatgtatttgcatggttctgaaggttccttttggaactgatttccagttttattccactgtggtctgagagagtgcttgatataatttcaattttcttaaatgtattgagcttgttttatggcctatcatatgatctatcttggagaaagttccatgtgccgttgaatagaatgtgtattttgcagttgttagataaaatgttctgtatatatctgtttagtccatttgttccaaggtatagtttaaatccattgtttctttgttgactttctgtcttgatgacctatctagtcctgtcagtggagtactgaagttccctactattgtgttgctgtctatctcatttcttaggtctattagtaattgttttataaatttgggagctccagtgttaggtgtgtatatgtttaagattgtgatattttccagttgtacaaggccttttaccattatataatgcacctctttgtctcttttaactctgttgctttaaaattggttttgtctgatttatatcagacagaatagctactcctgctcgcttttggtgtccatgtgcacgaattgcctttttccacttctttactttaagtttatatgagtccttatgtgttaggtgagtcttctgaagggaacagatagttggttggtgagttcttatctattctgtggttctgtatcttttaagtggagaatttagaccatttatattcaatgttagtattgaaatgtgaggtaccattgcatttgccatgctttttgttgcctgtgtactttgttttttatttttttgtttttgctttttaacatgtatttatgttttataggtcctatgtgacttatgctttaaagaagttctgttttgatgtgtttccaggatttgtttcaagatttagagctgcttttagcagttcttgtagtggtggcttggtaatggtgaattctctcagcatttgtttatctgaaagcaactgtatctttccttcatatgtgatgcttagtttcactggatacaaaattcttggctgataattgttttgtttgaggagcctgaagatagggaacaatcctttctagcttgtagggtttctgctgagaaatctgctgttaatcatgtaagttttcctttataagttacctggtgcttctgtctcacagctcttaagattctttccttcatcttaactttggataacctgatgacaatgtgcctacgtgaagatctttttgcaatgaattttccaggtgttctttgtgcttcttgtatttgatgtctaggtctctagcaaggctggggaagttttccttgattatccccctgaatatgttttccaagcttttagaattatcttcttcctcagcaacactgattattcttaagtttggttgtttaacataatcccagacttcttggagattttgttcctattttctattcttttctccttgtctttgttggattgggttaattcaaagaccttgtcttcgagctctgaatttctttcttctacttgtttaattctactactgagactttccagagcattttgcatttctaaaagtgtatccaaagtttcctgaatttttttattgttttttctttaagctatccatttccttgaatatttctccctaacttcttgtaacttttttaaaatttctttgaattgggctttgcctttctcttgttcctccctgattagtttaataactaacctcctgaattctttttcaggtaaatcagagatttcttcttggtttggatccattgctggtgaactagtgtgattttttgggggtgttgaagagccttgttttgtcatgttaccagggttgcttttctggttccgtctcatttgggtaggctctgtcagaaggaaagtttggggctgaaggctgttgttcagtttcttttgtcccatggaatgttcccttgatgtagtactctccccctttccctatggatgtggcttcctgtgagctgaactgcagtgattgttgtctttcttctgggtctagccacccagcaagtctacccagctcccggctggtactgagggttgtctgcacagagtcctgtgatgtgaaccgtctatgggtctctcagctatggataccagtgcctgttccggtggaggtgatggagggtgcagtggactccatgagggtccttagctttggtggtttatgctctatttttgtgctggttggcctcctaccaggaggtggcactttccagaaagcatcagctgtagtaatgtggagagggattggcggtgggcagggccctagaactcccaagattaaatgtcctttgtcttccactaccagagtgaatagggaaggaccatcaggtgggggcagggctaggcatgtctgagctcagactgtccttgggtgggtcttgctgtggctgctgtgggggatgggtgtgagattcccaggtcactggagttgtgtacctaggaggattatggctgcctctgctgagtcatgcaggttgttagggaagtaggggaaagccagcagtcacaggcctcacccagctcccatacaagcagaagggttggtctcactcccaatgtgtaccccccaacagccctgagtttgtttgcaggcagacagtgtgatgggcttgaaaacttgccctgtgctgcacccctagctgagagagaaaagggcttggtttctccccctgcctgtggagtctgcacaccagatttgtgccctcccactgagctctgaccaggaggcttcttgccccattcaaattgttacaaagttcagctagagatttctttctccctgtggagtttcaccccctacttctctggtcccccgccccctccgcccccaccatggatccctgtgttgttaggcaggaatggcctggcctgctaggggacacagcaagctcctagggcctttctgctgcttcctctacccctgcattttgcttggctctctaaattgtctcagcttcaggtaaagtcggaatcttctcctgcaaacagaatttcagcttctcccgtgggggtgtgtgtctgggagaggaggatctcccttccccctcacagctggggcactcacggtatttggggtatctcctgggtcctgcaggagtagtccacttccttcagagggtttgtgggtcctctcaggattattgctttgttcttgcagtcgatctagagctaaaattcggcgaacttccacaggctgctctgtccagagctgcaatctagtcctgcctcccgtccgccatgatgatccaatttctccttttggttctttcagtctcagccccaactttgtttattgacaacgaccttccccttcctggctcctcctcccagatcctggaatggaattagtgtggggagatggggtgagctctctctcagccccttctcctcccctgtgccttctgctgtgatgctggtgcaaggaggaagagaagaaggaccaggaaaacagtcagtttctccctgtgtgacttctcccggcaagctcacagtcctctctttggacagatgtcacttttcaagtacattgtctatggctccatttctgccagctcttccagaaattggcagtccttggaccttcagcgggcagctggcacagcattccactggtgaccacacctctctgctcatgccccagcagtctttagaaggccccaggtcccaattcatctaccagctttcacccaacagtagccactttctttgcttctcttgaacgtgtgggaggccttgcccctcccttcctggccatcccactaaactctctcctgatgtcctgccacatttggtagcactaaggaggagaattacatccttcccttcattcccagggaagttagagcagggaacagcctcttaaaaacaccactttcccccaaatgagatggcttactaatttccagtgtttctcttacaatgatctgataatttgcttcggagggtggggagagtgtgtctgtgatggctctgtcagcttagggagggggctggccacaagtgctatgagttttctcagctgagaatgtgacatacttggcaccttttattctcagcttagggtcttagtcaccaattctgggaatacaggaagaattctactcagtgcttcagacatcctgggatagaatcttttaatttgttcttcatcctagatattggttatatttaaacgaactttcatgcttgcctgttttggaggtgagtagtcttatcttgcaacatagcatgggagtaatccaaatcatgtggcctagatgatctttcagcagatacccaaatgcaactagaattaagagtctacagtgtacatggactgtgttgagttatattggaacataaggtaaaggttccatcctttaaagttgcacaagagtagcatagaaagcacataagtaattgctagcacgtttgatagaagctctgagtagaggaagaggacaatgttgtgcattaggaaaggcttccacaaggactcagtagaacttggcttggaccttacaggatgggcagaatttgaccaggaggatggtgaatggatgagcctatgtctgctgggtttcccctcccagctttaatctccttttctttcataggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggtgagttctccaaatgcacatgaggatgctgcctggaagcagccctgacaaagcaagaggtgttgaggaaacttctccttaagtcatattagccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgctcatgtggaaagcaggagggtgggactgatgacctccaagactcctcttccagtgtccgcaattcggtgtcgctggaccatgaaatagaaatgaggagctgcaaggttttgggtgctccactccttctgggtgggttggaataaattaaattcagaaaaataaatcactttttaaatagaatttttgaagtttattcaccttgtaccttttaaaactgtgaaaggggggactgggaatctgctcttgcagtttaatttctttcattgattaaagaaatccccttgcttggttgcagtttccacctcttcattcttgacttcattcattcttaagaatgaataaaacttacccctaacggctggtgaaggactgcaacattctagctcattgtatggcagccgggaacccctattatctattttattacatacacacatccatgtacatacagataagctgggaggaccctcacaattgtcactcctctttgcagaattcactccttggttggagtcatgaagaaggcatggcagctgtgctgagcgatcacaaaataggaacaaatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattgtaggcaggtggtaggtcagagaagtgttataacaaatgatgatcttattgcagtcttctcattccttgcctgtttgtgatggcaaaaaataacacagagccatgtagtcatctgcatgcagtttactcaaatgtgggagacagtcaagatactgtggttgagaaataaaagcaaaaacgaggttattacaaaagaagagagaaagaaactaccactgggaaaagggtttgtaagcattgagtcttggtatagaattttggggtaaactgattagctggcagctaccaaagaggtcagctggggctgtctgtccttgtgcagactagtcaggatcatcaggaaaaacagcctccattgttcatggatcctctggaaatcctctcacgtttggccgtgggtaaacatggcgcactgcctctatttgatggctgccattactttatatctggcctccaccatagaccaggtctcacccattttcctcatcagaattttctcaaaaagtagatttgaaaaatatggtgaggtgcagtggctcacgcctgtaatcccaacactttgggaggccaagacaggagaattgcttgaggccagaagtttgaaaccagcctgagcaacatagtgaggccccatctctacaaaaaagaaaaaataataatagtgacaattactgagcactacgatgttgtaagtacttttaggtatttcatttaatcttgggacaacctagaagatttgtatcctcattttaggtataaaaaaaatctaggcttagaaggtttaaataactggctcaaggtcctgcagctggtagaggtaaggctggggctagaactcaggcctgagtggctctgaaagctgggttttctagttacaccacgtggtctccccaaaacaccttttgataggaactgaagtgggattcagctcagctgagaacaaactaggcaacagccagcagtacaaattcattcttgaaggccacctgggaaactgaccaacttacgtgctgaaaatatttacttagggctgaatcaaggagtttgagaccaaactccgtggagggcacatgctaaaagcctccattctgaaacaaactaaatagaggaggaaactagacatgatatttgagtgccttctccatggaaggacctgggctggggaatttgtaatctccacttgattattctctatctcatctctatcaggtaggtatgaatctctctatttcacagaaggggaaactgaagctcatagggattctctctgttgcccaaggacatccagccaataaatggcagaacaaggattcaacttcagcaccgccttcatcgtcccacagggcctccctgagcagaggcagtccctgcccagcagctgagggggtcaaacgtgccccacctgtgttatgcaggcataccttgttttactgcactctgctttattgcacttcctagatgctgcattttttacaaattaaaagtttgtggcaaccttgcttcaagcaagtctattggtgccatttttccaacagtatgtgctcactctttgtcaccttttggtaattctcacagtgtttcaacctttttcataattatggtgatctgtgatcagttatctttgattttactgttgtaattgttttggagcaccatgaaccacatccatataagacagcaaacttaataaatgttttgtgtgttctgactgctccacaaatagaggagcattcttcccccatttctctccctctcctcaggcctccctattccctgagacacaatgatattgaaattaggtcatttaataaccctgcagtggcctctaagtgttcaagtgaaaaaaagagtcacaagtctcacttgaaatcaaatgctagaaatgattaagcttagtaaggaaggcactgcactccagcctgggtgacagaagagaccctgtctcaaaaaaaaaaaaaaaaaaaaaaaaacagaaaagaaattgttacaactacctcctcaatcgtcagcaaccaccaccctggttagtcagcagccatcaacattgagaaaagaccctccaccagcaaaaagattctgactctctgaaggctcagatggttgttagcattttttaacaaagtattttaaaactaaaatatgtacaatctttttagacataatgctagtgtacacttaatagagtacagtgtagcataaacacttgtatgcactgggaaacaacgaaaattgtgtgatttgctttattgctgtggtttggagctgaacctgcaatatcagtgtacttacttcctgcagtctgaacactgaatggcacagacaggacctaaccaacctctgtgtgtccaatgccttactatggcacttggcacagagtaggaactcaaatgtctgaatggctgaaacatttggggaatctgcgggtttgaagctaacttctcatcgataccagtagtatttgtttgaagatttaaatttccccgactaggtcctctacttatgttggaggaccatctactccagctctccagttgtgcttgttttatagatgaagctttgcagaattatcttttgtggcactaacaatgagctgtacagtggtgccacttaactaaaccaaatttgacattttaaatggcccaaggagattgcagcaccacatggaacaaatggctgagtgatatctgatagacatgctgtcttggacatacaggctgaatgctataaccagcagggtcacacaatgttggaaaagtataatccactataattgtagcttaatcacatgggccaagtccaactatgaattacatgcacactttgcgagccaaggaggccaaatatggagtctacaagattaagaaacagattgcatggctatgctactgcaaatttacttaccaaacatttactgagcacctaccgcatgtgtgttgctatgttgcattccgagagattccttaggacgtgatccttcctttcagggggctcatattctagcaaagcacaatgaagtgccatggaatggggcccaggagctattgttgcagctggcatcacctgacatctgatgcatggcccccaggcagccagccctgggctctctgtagaggaaaactcttccttacctttattattttgaggatgaatgtccaggagcaaaagatggtgtttccaggagtcatgagtcaataaacagtaaaaaacactctattacatcttcccaaggtccttgggtgtcattatcatggctactatgccttcctcaagagtctaagtttctcctttggactgtggacatatgtgcctggtcctcagagaaagggtatcctgatgtccccatttgcccagtacatccctagtttacacctgccgaccaaataaatggagtgcattttcactgtcaaacttgccttatttggaatgatagaggtttctggttgtcattcacgggggtaatgtgaacctttggatacaaataaagagacagttctccaagcatggtccacggtccccaggcagcttggaaggcccttctgatgggcagagaattgatctggaaatgcagtctttttcttgggtttatctggtgattaacatgcagttccatcgaccttcacttaatgaccagggttgcttacaaataatctaagtgagcaactaaggcttaggaaaatttttggtttattaagttgacattggcttattaccagaattttctgaagaccttgacattacaaatcctagattattatgtcactctgcctaaaaaattagatgtgaagaaacctagctgacccagaccacacccatgcggtcagcacttccctgctgcaaaactgtaaaggttgccttgcaggctttcccggaccacagtggaaccactgagagatatctgttctaggaggaccattgctgctgatgttgctcttacattgcagagccaaagggaagaagccatccttctttcctgctgtgattttctgggatatccccatattctagtttagcacaggcagatacgcaagaaggcacattcttgttaattataaaaaacatgtttagcttagagactggatgtttctgattataagagtctttaatgctgttagcagtctggttccttctggatccttgtggggagctatacagttagataagattacttccaagttcttgtctaactccaaagctctgtagttctgtgccaagatgatttagggtgagcttagtcattttgcagcaaaacaattttagtgtctatctatctcatcttatatgggattataagaaaatggatttccattttcatttttctgggacatgcctacaactatgagaatatgtgtgcacacaattattcaccctctccctctacctgtctatactttactttgtattttaaaatagagtccccgccctggtttcccccaccccaaaaagaaacctaaaatgttgctccaccctggggggtgcgggattcttggagggaaatatttccaaggaaaatgttttaattgacacgatatgtgataatatcaaaaagatcacagaaacagttttcgtcttttctgctcaggctgctgccttggttcacatttatcttgatggctctgtgctggtcactcacggtggaattgaaatggggcagggggtccacactaaaatgattcaggtaagaatgcaaataactcgattgagttgggtgtgtgcttatagatctgttcatgagagaaaaactatgaatggatattttctgttacaaaatacaggataggaagctgggtgaggtggctcatgcctgtaatcccagcattttgggaggctggggtgagaggatttcttaagtgaaggagttcgagaccagcccagggaacatagggagattccatctctaccaaaaatatatatatatatatatatatatatttttttttttttttaattagcagggcatggtggcatgagcctgttttcccacctacttgggaggctgaggtgggaggattgcttgagcctgggaggtcgaagcctcagtgagccaattgcaccaatgtactccagcctcggtggcagagcaagaccctgtctcaaaaagtaaaaataaataaaaaacaaaggataggagatttgagctttgacagtttactctgttaaatgattagcagaaactgggtaaacaaaccaattttgcaactaaacccctaaaagaatgtggcagaagaatctcgagttgttttattgctaaagaaaattatatgcttatttgctgctttcctttggatatagtgacagttgagttgtcctttctgagtttttcttgggcaataagataatgtgtaaattctgatgtatttggattatttcttgccctttttgtattacaggctccgaacaattgctaatataaatcacctttgatatttacagtcaaactttatctgtttgcttttggctgtcttattttagattaattttaagctactgtttctcttttgttaatcataatagtaacattatagattataaaatatttggaagcagcagaacattttaaaaaacaaagaccctacacagtttcaccacatagaataatcattatttgggagtctttacatcttgtcttttttgcttttgcaaaaaagtcaccaacatgcttttgtttaattttgtattctgtttttccacccactttatatagcgtgaacactttctcctgtcattaagcagtctttacaatcatgaattgtatgtggctgcatgtggatacatatatgatttatttaaccatcccccagttgtttgaatacttcagtgaatatttttgtacactaacctgtgatcaaatcattgattgtttcttaaaatagacttctgggaatagaattactgggtcacaggtgtgaccattttaaattgtttgacacacattatcaaattgttttccagaaagtatccctctcatgacacccctaaccaacagtgaatgttatggattgttgaaaatttgtagataatttgataagtgaatgaaagtatctcattattgctttcatttacatttttctgagtataaagatgttaaatacatattttctctcagtcacttgagaattgactttccccattggagggtaagatttcagtgttttccttattggatcaccagagactttgatattctaagcctattgcactctgtgtggatgatctgagagccagacctcatggaagggctctgtatgcctgtgtccttgtagaagctgtgggcaagcactttcaagccatgctgctagcaggagagaggcaagtttgggatcaactaaagttagcaatatgattttgctctctagcgctaaaaataaagaataaagcagccagctaagtccttgtgttggcacatggcactggcgccatctcctgtgacccacatgttcatgccgttgcttttccaaggccatcgtcctttctcataggaagcactctttccctggggcaactccagaaatgtggataggagatagacatctcctatcattgataaggttctgctagaattttgcagagtgtggtcgtaggagaagcctcaaagatgtcaatatcatgattataaaaacaagaatgaagcatttcttcctgccttggcctggggcctcacctcctctttctgacactatcaccagaaagtcaaagaaaaagaaagtgtgttcaggacttggggtccagactagctataggatttttagaaacaagaaacttttcatggctggaggaatttgtggttctgctcccttgtccctgtcatgggtatgagggtatcacacatgtgttaccacgtgggcatgtgcacaggtctgtgactaatcaaagtgtttaaaaggaaactctctcttaaaattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggtaacagtcactgcagtggcgtccaaatcattaactccctcagggccaaatacgtgggtgggtggagctccaaagatgctgagagttaatccaactcatatctccttccccatcttgccctcagtcagtggtacagcacccagtggttctcctgtgctggaaatgccacctctttttctccctcactcctgacatttttctaatcagcaagtcctttcaagtctactcaaaaatgtctctgtctttctgcttccatattatgttagtatcactttaagacaggctcgcgcctctccccagggccgatgcaggacttctgtctctccaccacaacttcattgccttttgctctagctttctgctgccggagtgaattttctcacaaaataaatgtggccatgccatgtctgaaagcaatggctggtggttttccaagaggttttttattaagtcttgactttttagcatggcttacaaggccagttctctctctcacacacacacacacacacacacacacacacacacacacgtgcacacactcatatgaaacctttcatatcaccttcatacagggttggtgtcttatttttccatgttccctcttagataagcctatggaatggtacatattatgttgttttgaatttggtgtttgcatgaaattaggagcataattttaatttaaaaataatctctaggatgcctgtcaaactcttctaaaacgcctcgaacccatcatcagcaagaatcctaaaggaacttggaaagactgggtgagaatcaatggttctctgtattttattttagaagaaaaaggagtgggaggagagcaagagcaatgtgcattaattgaaatctgtagaaagggcatttgcaaaggtaccaccattgtgtaatgataaataaaaggccctttggctcttagcatgtggaaatcctatcacagtgtggtggaggaactcttgtatctgggaaaattttctgttagagaaaaagatggttcttctgccagaactcctgttttaatccagaattaattaatgtttcatcctatgtagcctaggggttgtctagataataactgtacatctgttttttctctttctttgggttctgctgttcctaaaatagaaaaacaatagtagaaccactctgtaaaagtaaaaatcatataagcactcgtttagaaataggaaaccaagccagtgggtatatgttcatccagtaataggtactcaatggaatggaaatactcaactgcttcctttgatctgcttataatctagttggaaaagaagacacattctaaagtcagctaacaaacttttcaaagtaatagtttatcaactaccagatgttgtggaacaaatatccataaaagctgggagcatgtgtcacgctggctattctagaatgtcagtttttgcaaccttacaaatacaggtctgggggaaataacatttgaggatcccacttagaaatggtttctgctattccatggagtaaggactcattttataattcatatttatgggatctgtctatacttcctgggcatatttgtttctgtcctctgtcccatgctgcctgagcccagaaagcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccctcacctgaaacaaatgtgtccagaaaggattgacagttcccataaatatgaattataaaatgaacccttactctatagactagcagaaacctgatattaaaattaagcagccaaccaagcattgttttctaaaatgtcccatcttaattgaaaattttctgcagatgactgagtgaatttcttcctaagtggaacatatgttgatgactttagtccagcctgtatcataccacagcgggcatttagtacaatcataggtgctgaacaaacagctacaagccgtgaaccacagaggagaaagccaaaaggaatggattaatctgggtccttcctggttactattgctgatagttttatttaacacacagggtaaaattaaaattgaagtcttgagtgattctttctttgggcatccttgttgcatcatgctatgctcttccttcacaggcacagactgcttttgatgaaagcattaacctttcagctgttggatacttcaggtaaatactccctctgatcacatgctatggagaagaacagtggtatcttgaggaagagtttcagttcccttgcaattttggcaaacgttgactttctaccttctatttacccatggttataaagaacatttaactgctagttaatccatggttgtggttataaagaacatttaactgctagtatccagaaagacttctgttaggaaaaataggcacacaaaattcagcttaactgatgattctaatcatagtgggtggtattataaggctctctgtggttagtacttggaatactcggcagtggttgactttttgttgaaaacacgatctatctcttaagaaacaaaggtaggggaaagcaaattaaacccataagatgggtaccattttacaccttcaggattggcaaaaaagaaattggaccataaccatgttacattaagatgtgaaacaacaggaactcagtgaatctggaaaacagtttattaaattattttaatggaaagtgaaagctgtctgagagcagggtgatgtagagccttacctggtttgatcactttgccattggtgcgggacctgggcactgactgcctgtcaggaacaggcattggaagcatttttaatggccacctccaggttgcagggcagcagaggagagagggtagagagttctgcaagctgctgacccatgcttctgttttaccattatttatttgatgttcttaaagattagttaggaacagagcaggccatggagcttgatggtgagagaccagagtagagacaaagaatgggagccatgggacctgatccttcacacagaggggcaaattctggagccagaaagatagacaaagcaggcaagcatgcacctttgaaatagcgtttggtgtaaaatgaaggttgagttccccaaatctgatgatccaatattagccaaaagcagtaagatggacattcaggaagtaagaagctaacctccaggagtaaggaggcaccagtcaggagtagttagatgtttttatcagacaaagcaagttttaaaagaaaaaactaaatacttatttattcaacacatttatcgcacatacattaggtgctggcacatacattaggtacaggtatattcctgtggcttgcataaatcctcatgggtctgtttagtcatcatggtctgcaattaggggacgtgatcacttaacaacactcactgtttcttccagaggttatgagtcagacatgaactgggagaaaggcgaaggccagcccttcgaatactttgtttatggagctgcctgttccgaggttgaaatagactgcctgacgggggatcataaggtcagtaccggttggaaaggtcttcaagttgcacttaggatgcacctaaattccacagatgccatctatctgaggagagcttagtgagtggcagcatcgtgcatttggcctaagggtgatttccctggattaccagaagaaaatagaatccccacaattgccttggtgatctggttgctgccatggaaaacaactggtggcctgtctttatttccctggcccttttaaatggaatcaggaaagaaactacatgaagaaagaaacatgctctaaagggggctttcatgtagactattggcacaaccagcaattctgactttttatgagaaatgccaagatatgacattcttgaaggatttcatagacatctgtaatctgctaacaagcaccaagccagcccagggcaggtagtggccacttttttatatcttttactcagctaggtcttgccttttagaagtccagtgtgctatccattgtgccacagagctggcttggtcttgctttttagatagtttaagagcatccttatgctttcaagggatgctctgaagagatacacacacatacacacaaacacacacacacacacacacacacacactctctctctctctctctctctctccccctctttctgtctctgttgcttcaaagactcatagaatttctcctcttgtaccagagccttcgggagtaaaagaagccacttactggtcactgtcaatactaataaatgatcactgatacattaaatgggactgtgataccctaacaactgtcatgtgaccaagctaccagtttagtgataatctcttccaaaatgtacctagaagcaagctctagttcttgatatttacaaatatcctctatgcctgtgttcttggattgtgatcagatttaaattttcatttaataagtctccagcatgtattttttaaaactatagtcaacctaatctctgaaactatggtcacttttattgaacctgccttttcaagtatctaacctgtctggttctaattcagactggatctctatagggtaacctcgcactagggcaaaacagtgatcactttgagcatggtttttgtgttagactagcagccctacactactagggagcgggttcttgcatagaactgatttctgtttgtttgtttgtttgtttttgagacagaatttcactctgtcacccaggctggagtacagtggcttgatcttggcttactgcaatctctgcctcctgggtttaagtgattcttgtgcctcagcctcccaagtagctgggattacaggctgcgccaccacacccagctaatttttgtatttttagtacagacatggcttcaccatgttgcccaggctggtctcaaactcctggccttcaagtgatccacccaccttggccttccaaagtgctgggattataggcctgagccactgtgccctgcccatataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaaggcctgtttctcagccattctcctgttgatagacttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgacaggaggctcagcttctcactggctgttggccagaggcctccattctttgtcatgtggatacctctttgtaggctgcctgagtgtcctcaggacaagacaactggcttcctccagagagaccagcccaagagaaaaagagagagcatgtgcaagcgagagagtacccgagacagaagcccagctttataacctaatctcagagtgactactgtcacctctgccatagcctactggtcaaacaggctggcctggtagagtataggaggagactacatatggatgtgaataccaggaggtgaggattatccagagccatcttttaggcagcctaccacaacctagatccactctctccagtcctaacaaaagacacgacagacagcactaagcctacagctttgtgggttgtttttttctgttttgaggtggattcttgctctgttgcccaggctggagtgcagtggcatgatctcagttcactgcagcctctgcctcctgggttcaagtgattctcgtgcctcagcctcctgagtagctgggactacaggcacgtgccatcacccctggctaatttttgtatttttagtagagacggcatttcaccatgttggccaagctggtctcaaactcctggcctcaagtgatctgcccccctcggcctcccaaagtgctgggattacaggcataagccagccccaccagcctaagcacacagctttgaaagcacaaccttcactaacactgaagactttagagctcctcctctaaccttcagctgaggccacttatctcctggaaggccagtcttgctgactgatgtcaaagaggactttacattttactgtgtgtttaaataagaaatgtgagttcctgaagttttattattgtcaaacattccagatcattatctaattttcaaatgttacatgaaagtcccagatcaaataaggaaactcttggatttcttttgttcaattagtaattataagaacaatctgttagtcatggcagagaccattatatcacattaaaaaaaatgtacagacttgctggaaagcaaaggtgttactaacactctggctgggcctgctgtacttctcctcatttgtaggttatcagtagcaagttgtagtgtcaactttattctcttctctgctacaaaaatgaaaagtctagaacagcagatgacaatttgaagacttttttgttggtgcaccctgaactctgtggttcagtaaacattcctcagccagttgtacctggatgtttggttgtatgctagccattaagctttgcaactaggatcgtgagggccatagatgttttcttttgttgtgtcatatgttatatctgttgtagtgaattaaactcaatctgttgcatcatacagcttgaatcaaaatgaagtaaatatttttttctcctattatttccaagaaaaaaagacagtgcttcagctggctaagagtatttgtataattttgaaagttttacataataaactttgtcatataataaaatctttgttgcttctttcgaaatgacatggctgaaagaaaggctttataccaaagtcagcctggcaggaagtgttcctcagcttcttctccctaagttattctcattaaaataaacattttaacttttttttaatactagaacatcagaacagacattgtcatggatgttggctgcagtataaatccagccattgacataggccaggtacgtgtaactgatgtgtctcactttctatttgtaaaagccaaaagtgcggtggggtctgcaggagagcattccatcagtcttattcatcatcttatttttctaaccctttagtcaactctattcagaccaactgcagagctcaaatgttttactgtttaaaagggggaaggaaataaaggtgttttaggtagtttttgaagaaacataaaatctgtgactagggagcttgaatgaggcaagaccaagcctacaggtgactgatgagctccaaacttctgggacataagtagagttagtgcccagtgctgagccttagccacacgatgggcttcagcttcgaggagtttgaagtcgtgttgggataataagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgacacaggacccacctggaatcttcatatactgggtttacgtgtctcgaacctggaggcaattcagctcattacctctgatttagggcaccatcttgtgtcccctcccccccaccccccgcccccaccatcatgacattgcattattggcgaatgggaagaatctgtggtgtggagaagtcaaaggaggcttagggaggaagtgggtgtgaaccaggttgtcaaggaaagaatgagaaacgacattaggggtgaaagaagagtggaggaagtcaccctacagaaacacatggaatttagcatgcctgttcatggctgctaatcaggccagggcagatgactatggggaaggcctgtgtgggaggggtgggccatgaggagggagtcagagagcagaagagggctggggactgccaggggtgggtggagggcttttagagacaagacttcacttagtggggatggactgaagtgtttggaagactgatctaaaatcagagtccagagatgtgaggctagccactttgtgggcaaggaggtgggatgagacaatgggattgtagcattcactagcaccctggggtctctggacacatcagtcaggggggtttgtctgcctcatgggcaaaaaacaaaagaagagggtgcttgggctccagactctgtgaagactcttcctgagcactcatttcaatggccaaaccaaaattagaaccctagtcctttgtctttgaccttctttttttcatgatttttatttattattattattattttttttttttgagactaagttttgctcttgttgcccgggctggagtgcaatggtgcaatctcagctcaccgcaacctccgcctcccaggttcaagcgattctcctgcctcagcctcccgagtagctggaattataggcatgcaccatcacacccagctaattttttttgtatttttagtagagacgggatttctctatgttagtcaggctggtctcaaactcccaacctcaggtgatccgcctgcctcggcctcccaaagtgctgggattacaggtgtgagccaccacgcccggctgactttgaacttcttttaacttaatgctgaacaaacatgtttaaaatggcttttagataaactttcagcaacatgctccaagacaccctgaaaatgctcttaaactgtaattttaaaattcaagcaaacagcatgaagttgaaatgctacttagtgttgactgtgttttctcatacgtggaaattctttttttgttcttgcctcagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaaggtaagtaatgttctatgggtaaatatgcatgtttatatgatacctgttgggtgacaggaaggctacattcctctcttggctgtttgggatttttaccaggattgcagaagaaaaattcttattaaacattttaattctaatctaacattatgataaaaatttttagtattccaaatcttagaacttaacatcaactactattgccatcaggttctatctaatttttcaccttgcaataatcatcttcatgcctaataatcatcttctgtatgtaggtcatttcctgaggctagaattctaagaatgggaatattggatcaaaagattaaattactttttgaaacaaaaaatttatataggccgggcgcagtggctcatgcctataatccaagcactttgggaggccaaggcgggcagatcacctgagtccaagagttcgagaccagcctggccaacctagtgaaaccccatctctgctaaaaatacaaaaaaatagccaggtgtggcggtgcatgtctataatcccagctacttggaggctgaggcaggagaatggctcaaacctgggaggcggaggttgcagtgagctgagattgtgtcactacactccagtgtcatgcttgggcaacagagccagactctgtctcaaaaaaaaaaaaatgtacatatgtagtacgtaatatttttatatatgcacatatgctataaatatgcacatatatacagagtgagagagagaggtataatctagttggcatgcttcctttcaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatggtacgtttgcatggtagaaaaaaaatagtgatcataaaattctgaatttttggcctctgttcttgtggtaagttttcgtgaacgcactgctgtggcttttcttgccagaaaaggtgacgggaaacctgggggcatttgagcagatgtgcagaggggtccttgaacttgtacccctcgggttgcattttttcatcagcctgcccctgcttggctccattctatactatttgacaaaagaaagttcattcccattagttttatgttcctctcctgttttgctcccttcctaggacaccttggtcaggaatagaagttcaggaactatgccctgaacctaggacacccagtccaggaatataggcccctctgacagtctgcctccaccccaaccccaaacgggcacccggaaagtatgctagcaggaacccctcccctctggcaacagcgcccatgccgagcagacatctctaccctccttggatattttcagggacagggtttttaattgtggaagaaagtcatactgttcacagttaccaccctgactttgactgaagggaaagcccctcccatcctccactcacactggctctttgtggtatccttcatggttttccctaagcccctgacacgttgctttttctactctggagaaacagagacccactccacttttcactgggtggtcttcaagcgtgagatgataaccccaggacctctccagtcctcccctggcttcctctatacttcacaggctgttgttccctgacctgtcatggccctggttgccctctgctggtgtttaacctactttatgttcttctatttttcacctaagtcacaaacatttcccaggtttgaacatccagatttgtttttattttagattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatattgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaggatttgagtagatgtatctccaaagaagatatataaatggctagtaagcattaaaaatatgctcaaactcattagtcattaaggaaatgcaaatcaaaaccacaatgagccaccattttatatgcagtaggatgattgtaatcaaaatgatggacagcagtaagtattggctaggatagggaaaaatgggaacacttatccattgcagggggcagtgtagaatggtgtagatactgtggaaaatagtttagcatttcctcaaggagttaaacatagttaacatagaagttaaacatagaattaccataatcttaggtatatacccaagagaatttaaaacatatattcacccaaaaatgtatacataactgttcatagcattattcatagtatcccagaagtggaaacaactcaaatttccatcaactaataaaatgtggtatatccacacaagagagttttatttggccatataaaaaaaaagcactattacatgtgacaacatggatgaaccttgaaaacattgtctaaatgaaagaagccaggcacaaaaggctgcatattatatgattccatctatacaaaatgtccagaacaggcaaattcacagacacaaagtagattaatggctaccagaggctgctgggaccacagactgctaatggatatgggattccttttcggggtgagaaaaatgttctagaatgagtggtgataattttacaacgtgtgaatatactaaaaaccactgaattgtaattttataaaggtgagttttatggtatgtgaattatacctcaatttttaaaaaagtatctgtggagagaaacagaaaatgtgggaaagattgagaagttgtgagaatcaagaagcctgtcccaatcaatggctttccaaaaacatggaagcctcaaagggaggctaaatagcaaggcatagtcaaggaaaaacgccatttccgttaagagcagagagaagtcacatggatctctgcctttaagagcagattttctcatttataccacaagtatttatagagcattttactctgtgccaggcactgtactaggcacttgagatttatcagcaaacaaaatagacagagatccctgtccttgggaagatcctattttggtaagggcaggcagaaaaattttaaaaataataagtaaattacaggagtatggttgatgcttgagtgctaagggaagaagtagaagtggagcaggttaaggccaatggagagtgatggagcaggtggcaggttgtggttagaataggtcagagaaagccctcctgaggaaatgagaatggaggctgtgagctaagcaggtatctggaggaagagcattactggggagacaaggcattagagcagagtctcttgcaagcaagtgtgcctggcccgtttgtggagcagcagtggggcccatgtggctagcacagagccagggacgggggcagccatgtagaacctggaggccgctataaggacttgagcttttaatctaagtggctgcagagcagaaaagtgacatggacttgcttctgttgcaaaggattatcctggatgctgtgctgatgcaggtcgtgggagggcaaaagtcgagggtagatgcctcctttctgtccctttgccaactcctccccctccagcccacctctgtaaatgttggaattctcgagacagccatgggccctctttcccagtctctctgcctggtgggtggctgcctttactcccatggctggaggtaactctcttgcttaagctctggctctgtaaacccaactcttgcttttcattgccacttggatgtctcaaaggcacttcaaacgtcccaagcagatctccttttctgtacagccatccacaggttgctaggccggaaacgggaaatgatctgaggtgctctgttctctttgcgcacacatctattcaggcacgaaatcctgtcaatcccacatcaaagacagttcctgaatctgcctctc

SEQ ID NO: 11901 - DNA, 94133 bp, Human
agtaaagtataattccatatgtagtagcataaaaaatgtctagatgtccagggtctcttctaaaattctatcactctggaagattaacaacagtcttactaaataactttacacatgaatgaaaaatggagaaaaattctattaagatgccaatcttattaaaatgaaatgggctattccctcctcccgccagaaaaaaaaaggctgggaaaataaaattcacaagttggtttttttcttttttctttttttacgagttggttttaaggttatttctaatattcatttttcctaatgacaccaatatatcgccatttacctgattttaaaactgcaactggttagttttaagtgaacacaagtgctatgtttttgtagctttaccatattcaatctgtaacttacttaataaaagaccttaaattcataatgcatgcacggtgatcaaaatatgagcactcctccaagctctgctactataacgtttgctcctttgggagcataatgatatggttttcttttttttttttttttgagacggagtctcgctcggtcgcccaggctggagtgcagtgatgcgatcttggctcatagcaacctccgcctcccgggttcaagcgattctcctgcctcagcctccggaggaactgggactacaggcgcccgccaccacgcccggctgattattcgtatttttggtagagatggggtttcaccatgttggccaggctagtctcgaactcctgacctcaagtgatccacctgcctcggtctccaaacataatgatctgttttaaggttgcaagtatttccattaggtatttatggggtgagtagggtggggcagatgtgtcccggaatggggcacagcggacaggaagtaacggtttataacaacgtgaacgcttctgacgtgtagcgggagcttcagaaagcgtggccgaatctgcagctcttaacaaatggctcgttcccaaaccttagcctcaactccttctgagcgataggggcatgctaccagcacggggggaaatgagatacaagaaacgcccgaaagggaaaaacaaggctgggctgtttccttcctttggggtcaagacagaggcacagaaggcccaggtctgggaggttggatcacctccggctggatgttgagccgggtgggagcccaaacagcagggggcccacaggaggccggcccaggcagcctcgcgtccacttaccaggccaggcccaggcacgtccccagcgacagcaggctcaggcacgttcgggggtctgcccagcccccgcctccgctgctccgggccacgggggtcttcccgccctcgctccgcttcccgggctccgcagcaggggctcccttgggccccgacttcttccggctcttcacctcagacatgtctggagaccctaggacgacaagcccagggcagcttcttcaccagggggagcaggacgtggccgccttggcgttcgtgggaaccctgggcggtgaccgcgccccctcacagacttggcaccgcccagagcccagccccttccctctccccggcatcctcgttgcttcactgagtctttcagctgccagctccatagttcccctaggagaggtgggcggcgacctcaacccacagcgccttccactgcgatattgctccaaatccgaggaaattcaaactcccgggcgcgcgcaggccgacgggacccgaggaggaggggcaggacgaaggggtcgcgcgcgccacgtcgggcgcgccgccgctgcccgagtccggcattggtgggaacgcggcgcgtccctgaggcttagccacgccccgtccgcggggtaggcgggcacttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttgggtaagttgacctcctcgcttttctccccgagccaggttctttggaggcttggtagctgatttcagggactgagaatttgaggacatggaatatttgataaccatcctgctcctgtaccaggaagagaaattctgtaatgaggaagtagtaaacttggggttttcgtggataaacgtgcgctgttttctgttttacgtccatgaagagttttggctttccattttgttgtgggttacaaaaggttttgagacttagttcagataagttgtgcagttttaaaacgtatttaagatttgcatattttagtttaacaggactaggtgaaattggaaattagtttcagaaaaccagagtgtcttatttgcttagctattggacatcacctaaaaaattcattcattcttgttttttcacatcgaatttcattactataaattaaggaacattttatgtttaagaggacaaaaacgttattaacattttaaaaaatgagagttttgattcgaatcaataactttttatcagttttgtgcccctgctgggcattttgtaagccttgacaagcataggcaaatgccctacgtccgtccctgtttttccaagtgctacatttggtgacttcaaaaacagtcattgaagcttgataattattgcccccttctgtgagctccaagttacttgtgctctgtttttgcacttcgggcattcacattcccactctctctctctttttcttctttgagtagactgtgaattatttcaggcaaatgactcaatcttttctgtagtcttggtgtctgacatatagggaggggcacaaatgtgtattgaatgaatgaattgataaacccgtttagactctttcactctatacattgtgtaaagttctgttaatgttttgaaaacttgcagatattgtgaactgggttttatgcccatggaaaaatttgcattatatttgaaataaagttgctagaaacgtcaagtattttactataaaggctgttattctttcctcatgtcctcctggtctgagaaatcacatcagaaagtgtttcctgttgctttgtgggaaatgtgtttagcaaggaggacctagagctgacatcctccttgaacgagaactaatactcaatagtaacaatgctctattcactcttatgtttgataaggaaaacaagaagtctcttaatattaggacttcaatgtaatcactattttatacaatcttaattaaaaaaggaagtattttattgtaagaaatgataatgtgtgctaaaaaaaattgacagtagaggccgggcatggtggggctcacaagtgtaatcccagcactttcggaggctgtggcgggtggatcacctgaggtcaggaattcaagaccagcctggtcaacatggtgaaaccccgtctgtactaaaaaaaaaaaaaaaataagacaaggtgggggagaaatcccaaattttgctactcagaagtaactcaaacatttcgatgaataaacttctaaacgtctatatatattcatatgataccaacacttgtttttttttttgagacagagtctcagtctgtcgcccaggctggagtacagtagagtggtctcggctcactgcaacctctgccgccctggttcaagcagttctcttgcttcagcctcccgagcagctgggattacaggcacctgccactgcatctggctaattttgtatttttagtagagacagggtttcaccatcttggccaggctggtcttgaattcctgacctcgtgatccacccgcctcggcctcccaaagtgctgggattacaggcatgagccactgcgcccggcccccacgttatgtgttgtatgtgggatcatgtttctgttttttttttttttttttttcagcaacagtattatgaacatctttccatgtcaatacatggagatatgtgtcataattttgaatggctgcataatattccattttatatacataccctaatttttaaaatctatattcagaatgatggacatttaggttgcgttcatcactgaaacatcctccattaattcttttttctttttattttttactctagcctcccaatgtgctgggattataggcttgagctaccacacctgattggaaactcattaattctccttgtggatatttttacatatgtatttgaatgtctccttgaagtaaatccttagaaatgggatttctgggttagagagaaagcttattttaaacaattccatatcttactgctttccagaaaaattgcattcattttctagtttccccaattagtgcataagaatggccattttctcatacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgaggtaaagctctctgaagcagtccacacttccttaaaaatttttagaatttcagaacttgtactggtctccactactttatgttgcatacatattcattgttgtatactaaactacttaattttttttagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatggtttgtatccattataccttctatcactttgctatcaaaattgctttgggtttgtcttattgtagatgtaatcttttgaagagagtgtgaccagttcactgaaaactgcatgttaaaaaaattgtagtgatgttttcaatttaaatattttttatttgcatccacattaactctcaacttttcttcttgcccagtgaactgtactgctgagataataatatgtctaccctaatttttagagacaataagacaatttataggcccttgtttattttccagttctatgtgtttatagagtttataggaaaaaataagaatctttagaaatatatgttcttgaaaggtattccataaatgttcttccttttacacttgccttcccagtcttcaatatgagagggaatgaaaagtcaggaaataattgggtgagtaaagcagatatagatagaaacttccattttctttagtcatcttgaaggatatatgtttgtctttgctctctgttgtctgagaaatcagaaaattgaagttaatatgctagccacattttcttaacttctcttggaaattttcaggctaagcctcagctttgctctttgttttttatggtattacttcagtaattattccaaagttctattcattcatgcttgttttgttttggattttagtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggtaagtgtcttagtccatttcatagtctagtaaggtagatagacatgtaaaaatattatgatatatcaatacgtgataaattgaatggtagaaacaagtataaggtacagagttagaacaaaggaaggatatgttaactctctgaagggaggggatggataggacaagcttcctgaatgagatgacatcttagcaggagtttggagaaagaataaaagttagctaggcagtgaaggtagggatgggagactagggaaggtgggaaaggtagtgggtggttactggggtggggaagggcatactgggtagaagagggtttaagaaatgttggcaggtataccactgaccttagcgatcctggtaggttctcagggtattcatcaggaatagttgtatagctccatcagttctaggctgcccccattcatcagtgtgttctcattcatcagtgtgttctctctgtatgacacttctaggggaattcaaagacagttcccaacttctagtagttaataattttttttttagtaggccaggcacggtggctcatgcttgtaatcccagctgaggcgtggatcacctgaggtcaggagttcaagaccagcctgggcaacatggtgaaatcccgtctctaccaaaaatacaaaaaaaatcagctgggtgtggtggtgagcacctgtaatcccagctactcgggaggctgaggcaggagaatcacttgaacctaggaggcggaggttgcagtgagctgagatcgcaccactgcactccagcctggtcaacaagagcaagactccatctcaaaaaaaagttttttgtttttttttttttgatatgtatgtataacatgatctacggttaagacagtttagacagaatgattggaataagtagtaagcctctaagagacttagaaatatggaggctagggtatatctatgtgtacacatggcctcagtttaatttcatagcctttgtaagtggtatagactatactcttgtcagaagtatgcctgattcctaacccttggtttttcccctctatcattacagagaagtttcctgagacttagctcctttcaagtctcagagccaaggatttttttaagcccctactgcaaagttgatcactaaggatatttcaggataaatttagcttaagttcctttagtgtgaaggaatgagttttcctttcaatattatgaactttctttgtgtatttataatattccaatttataggtttaaaagaacactccctctccccatttaaattgctctacattattgtgatgaattttcaattctagggattaaaattgactaacaatctatggaattaaatattcaggagtcatattgtataaattgttatcttggaacaggttttaactactttgttttgagaaaatcctagagatactggcaactgtacatgtgagcttaattcatattcctcgtacttttgtgggatctcaagttcagaggactgagttattcatattccttagttcacggcttattatagtagatctgtactaggctgagcttttcactgtatttatttatttccatttcaaaatttcctattcttatttcctttcccctctccatggacaatcctaatgtatttaatgtatgttctttgtaaatgtctgtgtaaagtgtgtactcttgtaaaatatgtatgttgttggtatgcaggtattttaaatttgcatagatgttatggtattattctgttttttatctcccatgacacaatgtttttaagatttatccttgttgctatgtatacatgttatttgttacacctgattgccaccaacccattttactgctcattaccctaagtaaatggatatgtagattgtatccaactctctgctgctgcagcaaagctgggttgaacttctatgtgagtaagaatttcttgggtatttgtagctaggagcaaaattagtaattatttatttatttttgtttttttttaaagagacagagtgtcaccctgttgcccaggctgagtgcagtggccatatcatagctcactgcagcctcaaacttttaggctcaagtgatcctcccaccttagcctcctgaggagctgggtgcacacgccaccatgcctggctaattatttatttatgaaacagggtcttgctttgtcacccaggctggagtgcagtggcacaatcttggctccctgcaacctctgccttctgggctcaagtgatcttcccacctcagcctccggagtagctgggaccacaggtgcatgctgacacacccagctaatttttgtattttttgtagagttggggttttgtcatgttaccgaggttggtctcgaactcctgagctcaagcaattcacccaccttggcctcccaaagtgctggaattgcaggtgtaagccaccatgcttggtgtgtttttaaacatttttttgtagagacaggtttttgctatcttgtccaggctggtctcaaactcctgggctcaagtgatgctcccgccttggcctcccaaagtgctggggttacagatgaaagtcaccatgtccagccaaaattactaaatgataggatatacaaataccaaatttgattcccctccagtctgtacatttcccccagatgagtatggggactccgataattctacttgtgcagtgacggttggtatgatccagctttgtaatttttgccaggcaaacttctataaagttgtatcttttactttgcatttctctggtaactcaagtttgaacatttcttcataagcttgttgttagccttttgggtttctttttttatggattttgtttatattatttgtctattttccattggggtttccaatttttttttctttttgctttttaggagtttcttatatattctagacattaaactttgttggttttagacttttattttattttattttattttttttgagacggagtttcgctcttgttgcccaggctggagtgccatggcgcgatcttggctcaccacaatctctgcttcccaggttcaagcgattgtcctgcctcagccttctgagtagctgggattacaggcacccaccaccacgcctggctaattttgtatttttagtagagacggggtttctccatgttggtcaggctggtctcgaactcccgacctcaggtgatccccctgcctcgcctcccaaagtgctggtattacaggcgtgagccactgtgctcagctggttttagacttttaaataccttattttaatttgccatctgattaatttttttcctgggtgttctcagtagacgagaactctgatgtagtcaaactaatcagtttttttttttgtcttctaacttgtgtttcctgagttttgttcaagtagtcctattacagtcttattattcatatttagttctttattctctggagtctgcctttgtatgtccactaattcaagaataggtgctttcccaaagataaattttaatctctggagttcacttccattctcaaatacaggaacattggatttttgacatttaattgtattgcaaaaccttttcttttaaaagtacagataatataagagatctaaatttgattaaaattgtggttcctatggaaatgttttctttgggtggtgattggcataaattaaagaatattaagttgttaacttttagctgggtgtggtggctcgtgcctgtaatcccagcactctgggaggccgaggtggacagatcatttgaggtcaggagtttgagaccagcctggccaacatggtgaaaccccgtctctactaaaaatacaaaaatttgctgggcgtggtggcgcatgcctgtaatcccagctacccaggtggctgaggcataagaatcgcttgaacatgggaggcagaggttgcagcgagccaagattgcaccactgctctccatcctgggtgacagagtgagatgccgtctcaaaaaaaaaaaaaaaaaaaaaaaaaaaaaaaaaaaatatatatatatatatatatatatatatatatagtttttaactatttatgtctatacagttttaagtaacccagttgtcttttgaaatttcaatgctttaattttttcttatttgtagggaaatagtaaagaattgacgtatctttaaatacagtagtgacattttacattactgtattcgtatgttggtttttaatcatggatgctttcttcataggctgtgttcctatttgtttctgtcctttccaagatttctttgtgttattagattattaattgctaccaggataagcctcctgtgaaagtagtgtggagttttccctgaataaaggcaacttttctctgaattagtttctctgagtgaattgtaaatacagcctcctcatgcaaagctaaattgctccctcttgtgcccatagtcaagatgtttagattctttctgaaatgtggaattaatggttcagtttttaactaaatgttatattgtgatggttagagatttacatatcagatggtcatttggtctgtttgcctttttaaagctggtagtgttttctcttttcttgcatgtatttaaatgccctaaatttttagttatacatttagggaaaaaggcctttgaccctaggtaataggtacataaattaaaatatgaaagaatttactaggtagccatatcaggatgctttctttacctttaatcttgggatgatttttacaaattttattttattttattttattttgagacagagccccattctgatgcccaggctggggtgcaatgatctcagctcactgcaacctctgcctcttgacagtccccctgcctcagcctcccaagtagctgggactacaggtgtgtgccaccacacccggctaatttttgtatttttagtagagatggggtttcaccatgttggccaggttggtttcgaacacctgacccaagtgatcccctcgcctcggcctcccaaagttctgggattacaggtgtgagctgctgtgcctggccgatttttacaaattttaggtagtacaaatttaaaaaaatggaaacttaaggcaacagatagtttatttgtctgtttttgtttgtttaaatatttttaaagtagtattttctttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccataaagccgccattgtcatcctggcccgttctcaatgagctgttgggcacacctcccagacggggtggtggccgggcagaggggctcctcacttcccagtaggggcggccgggcagaggcgcccctcacctcccggacggggcggccggccgggcagggggctgacccccccacctccctcccggacggggcggctggccgggcagaggggctcctcacttcccagtaggggcggccgtagtattttcatttaaaaagaaaaagaaataaaagttctccttacttgttcctttttgctttctcctaaattcttaatctttttatttttatttttgagacagagtctcactttgtcacctaggctggagtgcagtggcatgatcctggctcactgcagcctcaactttccaggctcaggtcatcctcccacctcagcctcctgagtagctgggccacaggcgcacagcacgttgcctggccaaaatttttcttttttttttttttgagacagagtctcactctgtcgcccaggttggagtgcagtggcgcggtctcggctcactgcaagctcggcctcccgggttcacaccattctcctgccccagcctcccgagtagctgggattacaggcacctgccaccacacccagctaattttttgtatttttagtagaaacggggtttcaccgtgttagccaggatggtttcgatctcctgaccttgtgatccgcccacctcggcctcccaaagtgctgggattacaggcatgagccaccgcgcccggccttgcctggctaattttttgtatttttttagggacgtggtttcaccatgttgctcaggctggtctcgaaattctgggctcaagcagtctgtctaccttggcctcccaaagtgctgggagccaccgtgccaggctctaaattctaaatcttatcctagagataatcttggttaacaattcggagtaaatttttccaaactttattctctgcaattataaatatatacacatacagaacacagctttaagtttaagtgaagtctcaaggacttgctgtttcataactgcaaacttacactgaaggaggcctgaggggacctcaggaaactttaggagtaagcagtagggcttgtctaccttcttctaagacattggcactgataatcaaaccaggcttcacagccctgtctctacctcagttactgtagagttctctgtctccagttgtttgttatattttagactttcatgcagtcactattcagtacattgccaaattctgatctaggtcttcttctgtcattcctatgtgtttctgccataccctgtagaactcctctgtgagcaggaaactctcttgtatcatcaacttcttagaatattcgccgtcttgccttatctgaaactgggcagtttcctgagtttactaccttctccataaccttcttaagtgacatggcaacttttttcctttatatcctacatactttagcaccaggaaatgggtgggcgttgttcttgctctctgttgtctcatccagaccattaatactcccttctccagctgaatgctttgaggttcatgtctctaacctttcctattgatgtaatcaccgtctcattcattgacgattggagttcgtagattataaccttcctcttatgctctttgtctgttagcactcttagtgattttgatacctgtgtggatgagtcatccaaaaccttaacctcttacctccttaacctctttgtctcctgtgaacatttcttaactcttccctgattacaggctagaccctgatctttgtcattactagaactacagcacttttgaaatcttgatgttgagcattctcttctactctttacccacctccacccattttattcaagtttaatgctatagacttaccaagacttctcatccattgattccagaatatcctctctattcatactatcagtcctctcctagacttcagccatcattgtccatcattttattgtccatcattcagttgcttcttagcacatactcttgactctttagtcctctccttatctggagtgaaaaccgatttttttctctatgctgggaagtggaataggtatttgctcctcaaggcttcatccagaccattgcttacgtcctcttttctgggactgatcctttccttgaccttgtgcaggttcaaagactccatgtcacttcaagttataaaaagtctaattttcataattaatatgtcaagtcctattcagtactccaaacttcatttacatataaggttcagttgggcctgcctgaaactttggaagcctgcaatgggatagtaggttaaggtgggttgtttccagctttttcctgttgcaaacaatgctgcagtgaatattcttgtggatgcagaatagtgtagaagttgaacattgatactttaagtttgaatctcaactctgcttcattagctgtgtaactttgggcaaattactcaacttttctattcttcagtttcctcattttcaaaatgaagataatagtgtctgcttgatagtgtgctataggattaaatgaatgaacatacagagaactcttagaatagtgcccaataaatatctgatgtaaatagatctttgtgcatatatacaagtatctcttttgggtgattaggtttttaaagtagtgatttatatttgtatttaattatttgtgaataccagtaaataaattgccctttggtgtaatttaattcatttatctttgagtctgttttttgctttttttggtatgtttaagatcacataaatctttatgattgatgctactggaatgatctaatgctactgtttaccatattttacacatagggacccctcttttttatatatgtatatttatgtggaggtgattaagtatagtctatgaagacttaagattttggctactgacaatatgtaaataaaaatacatatttcaagatgttttatggctcaattaacaatgatgatgataacagtaataataatcatggccattcctagtgtttactagtttgaagcttaatattggtaagttgctctcagatccataacactaataacctgttttaatcctttatacttaacatagcaatttcacatattttatatcattaatttttcacagcaactctgaaataggtgggctagacagccttatttcagtataatcaatgagactgaggttaaatgatttgataaagattgcttagctagtaagcagtagagccagacttgagtctaacttcctattttaagtctgtataagaaaaccataatgggtgagttatatgttccaggacatcagtagttctcaacgaggggtgatttcacacccccccaggtgacatttgacaatgtttggagacatttttgtttgtcagtactggtgaaggggaatcctattggcatctagtggatagagaccaaaaaggctgttaaacatcctataatgcataggacagtcccttacaacaaagaattgccatcccaaaaagtcagaagtacaaggtttagaaactgtgctgtgcagtgatcactgacaacacaggacaaagatcataaaactttacttggtaagattttcccgataagccacagatttacttcaaacttcagtttcttcacatcttcaacttgtcttagattcaggatataaagcctaccagtatcttgcacgtaaaatttctactctaaatcaagagaagttgaagatgtgatgggattgtaaattggagtaaatctgatgcttaacagtaaaaccatttaaaggagtactcctgttgaaaggccttaagttcattattctttccctcactaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtaccgatggtcaaatttagttggtgtgtcaggtcccatgtcccaataagatgtaactactgacctcttgagaacatcatgcctttttcctgctgttctatagggaggataagagagaaccattgcggccaggtgcagtggctcacgcctgtaatcccagcactttgggaggccgaggctgttggattacctgaggtcaggagttcaagaccagcctgactaacatggtgaaaccccatctctactaaacatacaaaattagccaggtgttggtggctcatgcctgtaatcccagctgctcaggaggctgaggcaggagaatcgcttgaacccgggaggcagaggttgcagtgagccgagatcgtgccattgcactctagcctgggcaataagagtgaaactccatcagaaaaaaaaaaaaaaaaaaaaagagagagaaagaaagaaagaaccattgctttcctgcttttctctcttgtatttaaaacgaaaaaaaaaagtggctgccactcggcctaaaattgctttttctctttgcatgctacctaccacatcatctcatatgtaccattgtaggctttcaggaaatgtcttaagtaggtgagttggtgagtggtctttgctagaaagtgcaaacttcttactttgaatccgttatttctaatgggttaacatagaacaacagagaataaatgcaggcaactgataaatgtcaggaaggggccagggacagtggctcatgcctgtagtcccagcactttgggaggccatggtggatagtttgcttgagtccaggagttcgagaccagcatgggcaacatgatgaaaccctgtctttctaaaaaatacaaaaattaatctggtgtggtggtacacacctgtggtcccagctactcaggaggctaaggtgggaggatcacttgagcctatgagattgaggctgcagtgaacccagattgtgccactgtattccagcttgggtggcagaggaagaccctgtttcaattaaaaaaaaaaagtcaggaaggatttttaatggggctcttctgtttgattgtcttagtttctagaaatatacgtgtaactcttctacttccatgtacttcaggagtgagtttgttttgtttgttcaacagttaattaattcagcaaatacttaccattataattatgtgccaggcactgttatcaagtgtttcacagttttcattagccaaaagggagacagcagtttagttgctgcttgtcttaagagtataaccttggattcagtcaacaatttgatttctgtcatcttaacagcctctctttcatttgttcatttaaccaacattgagtgttgtgccaggttctgggccaagtgctgcaagtacaaagataaataaagcattccttgggaatgttatagtatactgagtgagagttaggtagtggctctgcactttttaaaaatgccctaatgcacccaaggatgcagtatactttcatatgtagcagttgctgagtatggcagtgattctcaaattggtaagggtattaatatcagaatatagggtgagaagagtatttttgggaaaagcctactaggtgattctgatgcatattcgttatatttttatggtgcaatctctgctcactgaagctccgcttcctgggttcaagtgattctcctgcctcagcctcctagtagctgggactacaggctccccaccacacgccgggctaattttttgtatttttagtagagatgaggtttcaccgtgttaaccaggatggtcttgatctcctgacctcgtgatctgcccaccttggcctcccaaagtgctgggattacaggcgtgagccactgcgctcggcccctccttctcttgatattgatctgtgtagaggaaataggattgagatcactaacccttccctctttaattgctcagtaacttttccctagttctacttttccttttttgcaaaattaaaattgacttctgttgagtaaaataatgtagccactttcagatgtgtcagactagcttacaaagccaggcatatttttttaatctctcagtctcatttggtttgtgcttttgtaatttttcaacctatgtatgtgcctagagtatttctttatttttatttttatttttatttttttagatggagtttcgctcttgttgcccaggttggagtgcaatggtgcgatatcggttcactgcaacctctgcctcccgggttcaagcgattctctgcctcagcctcttgagtagctgggattacaggcttgtgccacctcgcctggctaatattatattagagacggggtttctccatgttggtcaggctggtctcaaactcccgacctcaggtgatccgcctgccctggcctcccaaagtgctgggattacaggcctagagtatttttttttttgtaatgcacagccatagtgtgtcattcagacaaaaatgttattgtataattatgctatcaggttttagttatattttttcccctcatctgttctagtgagtttagaaaagtttttggagagaacaactgggaactggcatagaggttcttggttactatgaataaacaaattgattaaaaaaaaccacttgtataccaaatgaaaggtaatattcttttagattacaacatatgaaattgctagtttttaggtaaaaaatggtcacatatcatcattattgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagaggaagaatcattttcctagatctagccatctatttgttttaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatatttaatttaattacatttaaatatgtgacataccaaattacttactttgtcttgtgatttttgtttgcaggtcctaaatatgtagtccctgtggagagttccttaggaaaggaaaaaggacttgaaattttatccctttttgttaatatgaagaaggcagatttgccagaacaagctcatagtattataaaagaatgtaaaggtatggttatttatttgtttatgaggagattatagggagttatataatttcccttttgttaattgagctaatgaatatggtaatttagcacatgaacatccaaaaacttttctgggagatttagtattttaggttctctgatatcttaaatggatacatgatattatggtatttatttattcattaaaataatatttaccatctacccacagtgtgttagagaccacattagtgagagaagtgagacacagatgtgacctctgctgttagagttaaaaatagagtgagaatcagattttaaaacttgtttttgcttgggattttataaaaatagtgttctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaaacaattttttaacttaaaatttatatatagaatctcgctgtgttgcccaggctggtcttgaactacttgcctcaaatgatcctcctgccttagcctcctaaagcactgggactacaggcatgagtcaccatgtccagcctgttacccagttttttgtgtaccttttatttgttgtattcttttgacatatagaagcttaaaattttaaacagtcaaatctatcaactcttaaaattatttctttcattattgttatgcttggaaataccttatttttcttctttttctttttttttctcttttgagacaagtctcactctgtcgtccaggctggagtgcagtggcgtgatctcggctcactgcaacttctgcctcccaggttcaagcagttcttctgcctcagcctctcgagtatctgggactacaggcatgttccaccatgcctagctaatttttgtattttcagtagagacggggtttcgccatgttggtcaggctggtctcgaactcctgacctcaggtgattgcccgcctcagcctcccaaagtgctgggattataggcatgagctaccatacctggccaccttatttttcattctgccatcaaatagacacacagttttgtttgtttatttatttatttatttattttatttattttttgagacgagtctcactctgtcgcccaggctggagtgcagtggtgcgacctctgctcactgcaacctctgctgcccaggttcaagtgatcctcctgcctcagccccctagtagctgggattacaggtgcgtgctacctcacccagctaatttttgtagttttagtagagatggggtttcatcatcttggccagggtagtcttgaactcctgacctcgtgatccacctgcctcagccacccaaagtgctgggattacaggcgtgagccaccacacgtggccagttttgttaatttttaaagaaatcttacacttagaaaaaatgcttaatttgtagttattacaaagggtgatgcatgtccattttgaaaatgtgtgaaactaaaaaaaaaatagaaattatccataacctgataattattagcatcatgagagtattgcctccagtcttttagaacaaagatttaaaaagttgagattatgtatatgtggttttggattttgcccttttttttttaaagagccagggtcttgctctgtcacccaggctggagtgcagtaagatcacagctcactgcaggcttgaatgtcttggcttaagcaatcctcctgccccagcctcctgaatagctgggactgcagatacccaccaccacacctgggtaatttttaaatttttttgtagggacagggtctcactatgttgcccaggcaggtctcaaacttctgccctcaagcaatcctcccacctcagcctcctgaagtgctaggactacagacacatgtcgccacacccagctggatcttaccctttttctatatcttgagcattttcccatgttgttaaatatttttttgaaaaaaatttaccagtggcataatattgatatatcttaatttattcaaccacttctgtattattggacattgtttacgttgtttaagattttttcactattctaagtgtgctgtgatgaatatccttaaacttaatcattcttttctttttctttaagacagagtctcacactgttcctcaggctaggatgcagtggtgctgtcatggctcaccgtagcctcaacctcctgggctgaagcaatcctcccacctcagcctcctaagtagccggcactataggcacacaccaccacacctggctgatttttctaatttttatttttagtagagacaaggtctcattatattgcttagactggcgcatatatatatatatatatatatatttttttttttttttgtaatgacatcttagccagatttgatctatgttattttgacttaataaagataatcaggaacttactgaatgaaatctttcttatttctaattttttttgggataaatatctagaagtgaagtcaagagtgataaatacttaaggcttttgataacatgcagcagaaattgtttcttagtaatgtaagtaagtaagtcgattcttattagtgacaaaataggatggtattagcatagtgacttcattttttttttaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtaatgggatcaatgatcctcatcattgggtatttattgcatgtaagctttgatatagtactgagcatgttgttacagagaaccttggaaggataagacccaggggactgaggtggtggggtgttgggtgtagaaatccctctgctgttagcttccattaagggctttgtgttgaactcaggagttaacctatttctgtggttctagtgcagctgaagaagcatctgacttctctttctcttttctatcttgaggagtagctgagtttcttcttaagaaatggagacattcttactcagggctttaagataccgtttttttgtgtgtgtgataatacctgtctacagtcctggtcattgtacttttgtggcatattaaatacttacaacaattcctaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggtacttgcatcttggtttacttttttttttcctttttcctttgaaataattttagatttattgaaaatttacaaaatagtagatagtttctgtgcataagtccttcacctagcttcccctaatattaacattttatataaccatagtacagttgttaaagccagaaaattaacattgatacaatactgttcactaacctacgtgttctttttgtagtccaggccaatttaggatcccgtattgcatatgattgtcttgtttccctacttgtcatttttttccgtctcctcaaatctgtgaaaatttatcagtctttatctttcatggccttgtcacctttgaagagtactggctagtaattttgtacagtatacccaaatttggttttgtgtgatgtttttcctgactagattgaagttatagatatttggcaagaataccaatgatgttgtatctttctcagtggcgtcataggctgagagtacttggtggtttttaaaaaattttttgtagagatagtgttttgccatgttgcccaggctgttcttgaactcctgggctcaagtgatccacctgtcttggcctcccaaagtgctgagattgtaggtatgagccactattcccagactcctggtgttgatatgttttattatgggtgatgttaatgttgataatttgtttaaagtggtatctgccaggtttctgcactgtaaagtcattattttgtggggagattctctgtatatatatatgtatttttttttttttgagacagggtcttactgtgttgcccaggctggcatgcagtggctcactgcaatcttaaactcctgggctcggttggtcctgagtagctaattcccgagtagttgggtctgcaggcatatgccaccacacctgactgattttttttattttttattttttgtaaaaaaattaaatatacggatatctctctatgttgcccaggctagtctcgaagtcctggcctcaagtgatcctcctaccttggcctcccaaagtgctgggattacaggcgtgagccaccgagcccggcctctctgtacattcttaatagctttggaagctgaagttactgtgatgcttaggttataaaattgtttctggcttctgaaacgtttcattgggttgcaggatctacataagaagataatcactcagtttcagagatatcaccagccgcatactctttcaccagatcaggaagactgtatgtattggtacaactttctggcctatcacatggccagtgccaagatgcacaaggtaagatgacccatttaaaaattcttttatctgacttccctttttccatatgtattacaaataagtgctttttttctgttattttttgtcttgaattttgttcatattgctttccatttgattttttttttttttttttttttttgagacagggtctcactttgtttctcaggctggagtgcagtggcacaatctcagctcattacaccctcacctcctgggctcaagtgatcctcccacttcagccccccatgtagctgggactataggcacatgccaccatgcctggctaatatttttgtatttttggtggagatggggtttcactatgttgctcaggctggtctcaaactcctgagcttgacgtgagctcaagtgatccactcgcttcagcctcccaaagtgttaggagtacaggcatgagccaccgcggctggctgaagatttgaatttttatgtagttaaatttaccactgttgttgtcgtcgttgtttggtattttgctttgctgtcctgttcataaacatgtattgttttattagtataattttttattagtaaaaatgggattatagcttgcataattatttttgtttttacctgtagtgattagaaaaggtaccttagtaactagtaaatgaaccacctcagaattaatcctcttcttactagtagctttcctttttgggcagtatggatttgttttgtaagctttgagaggaaatggatagtggaaaagtatattcattgattcaataaatatttattgagtgcttgttatgtatattgctcttcattaagaggataaagcacaggcacaaagtcattgctctcacgagtttatgttctgggaggaggcagacattaaacaaatttattatatttcagtgggtagttaagtgctcagaagaaggacagagcatggaaggggaaagaaagtgatgatagaggggtagaatcatcatgatttgcttatgggtttggtatgcattatacgagaaagagaagaatcaaagatgactccaagaatcaaagatgactcaaaccccagtggaaagaacggagtccatgaactgaaacaggggtctttgggagaacaagctttttcctgcagagaatggggatggttaagaactcattttggatatattaagtctgatatacctattaaggcatctggctggaaatattgaataggcagttagatatatgagtctagaattctggggagaattatagatgaaagatgaaaatagggaattattagcacatagatggtatttgattgaagtcatgactaccaagtagctactaaaaatgtttacatttggaaaaccatatgtactttcagtaaattttctatgctcaggtatgttatttcttggttatgatacatagtaaattgttgtagtttgtttttttatctagcaaaatatatttacatttaatagtgtatattggaatgatggtattccaataaatacttgtgccctaatttacttaaccaaactctagttatcgaacatttaggttttcagtttttttggtccttatgatgtaatgagcattcttgtttatctttgtacctatgttgtttccttggcaaattccgagaagtagaattactgagccaatgcatctttttaaagcttttgacatgtatgatagtgtggcaggattcagtttctctttagccttttttctgactttaaaggtaatggttgattttcattggaaaaacagaaaaaaacgatgaaaaggaaaacagagatcacaaccattactaatgctcttgtgtatagttttctagatcattttgctgcttctataaacatacttgtctcttaaaaccaaatgggatcataatagaaatagtctcatatattgctttttaccatttaattacattgaatggtcatcttttcatgtcatttatatagagtgacatgatttttaaagctgcatattatttcattgtatagctacattatgaatggccagttggttgatggacaattagattgtttaagcatattcatctggttattttcttaggatacttttttataagtggaatttctgggtcaaatagtatgtgcagtttaaattttaatacagattgccagactgctctccagaagggtaccctgttttacatgcctaccaacagtggttgaaagtgttcatttcctctgattctagctaatcacctcctctcctctcctccctcccttcccctcccctcccctcttcctgccctcccctcttcctgccctcccctcttcctgcccttgccctttctttgacaggatctcaccaggatgtcactctgttgcccaggctggagtatagtggcatgatttcagctgaaatcactgcaaccgccacttcctgggctcaggtgatccttccacctcagcctcctgagtagctgggagcacgggtgtgcaccaccacacccggctaatttttgtatgttttgtagagttgaggtttcactgtgttgcccaggctgatcttgacccctgggctcgagtaatccaccctcttcagcctctcaaagtgctgggattacaggtgtgagccactgtgctcagccccagctaatattcttgttactcctttagtcttcagaaatctgatactttaaaaatggtaaatttttcttgttctcctttgattaccggtgagattttggccatctgtgctttttgttttgtgaattgtggctcccatcctttgtttgcttttacctcctttacctattttttctcttgacgtgtttttctttttcttactgttttattagaattttctataaaaaataattttctataaaaataaggattgaagccctgatctatcatatgtgttacaaataagtatttttttaaaacttctttggtcttgagtttaatttatattgctttctactgtattgaagatttgaatttttatgtagttaaatacacttttatatagttaagtgcagtttttctttttgtttgatattttgctttggggtcatgtttacaaagatttccttcactacaagcttacaaaaatatttatttttattttctagtatttttaaatgttttctattttctatttaaatttttaaccaactggagtttatttggagctgaagtatgaggcccattttatgtttctttggaactatggatgtgttctttctcactagcttttgcatcctttaaattctagatatttactgtttctcttagcagtgtgaggttaatgatgttatacctaaaattttttgatctctaacagtgctgctgatactactttttgttttttaaaggaactttgtgctttaatgttttccctggattggattaaagcaaaaacagaacttgtaggccctgctcatctgattcatgaatttgtggaatacagacatatactagatgaaaaggtatatatattaacatgaaaaattagtgctaaaaaggaatctcatttttttttacatttaattctagatttaatgatgggaatgagcagaatagaaggggtgaagataatttccctcctttgatttttggttattctaattaatttgcttcctaccctactgggaaagtaggtaggattgaagtttaaaagctaggaaaataagatgttcagtggtttttttaaaaaaagaatgtattaagaaatgtgtttgataatgagatttttaccctatgtttaaaagtcagaagaggattactatatatttgttacttaatggttggctgttcaattttagttcatataaagaatatttcatttaagcttttaaagtggcaagatcacagaaatggaaaaatgtcagatcgtggctctgattgtgtttctaagagatttcagtttatttgtaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggatgtaagtaggttaggagagaaaccaaagggagtggtgcgctaactatatcattatttttcaggtggtgaatacgatcactccaggaggatttaactactttcgaaagggctggaacttttaataagcattcttacttattgaaaagttctagagaagtaagcataggagaaaatgattgtattttcaaagaatccatataaatagatgcctgtaaggcatttggacaaattatcctaagtattcagtactaagtgcttgacttactgtaatttagtatagtggtgaggagcatggactttggagccacagaactgggtttgagcctcagttctaaaacctaataattctgtgactttgaacaagttacaggtttttctctcatatgtaaaatggagataacaatcctttgaaataagtgctgtttccatgaagattttatttatttatttatttatttatttttgagacagagtctcactatgttgccaaggctggagtgcagtggtgtgatcttggctcactgcaacctctgcctcccggattcaaacgattctcctgcctcagcctccaaagtagctgggattataggcgcccaccaccatgcctgtctagtttttatatttttaatggagatggggtttcgtcatgttggccaggctggtctcaaactcctgatttcaagtgagctgcatgcctcggcctcccaaagtgctgggactacaggcatgagccaccacgcctggccttctgtgaagatgtaaatgagataatggctgtaaagtaatttgcactttcctttgcacatatagtccttattaaatgaccactgaaccctgattattctgtctcttaaaggagtctcttttgctcttaccttaatcttgtaaggaaaggtataatcttacctttccttataaaaaggaaaggatagctattaataccatctttttaatgcctgttataatgctacataatcaagttattctatttaatcttcaaaacaagtttataaggtaaattttatttttattttattttattttattttttttgagacggcgtttcactcttgtcgcccaggctggagtgcaatggcacgatctccgctcacggcaacctcctcctcctgggttcaagccattctcctgcctcagcctcccgagtagctggaattacaggcatatgccaccacgcctggccgattttgtatttttttttagtagagacagggtttctccatgttggtcaggctggtctcgaactccagacctcaggtgatccacccgcctcagcctcccaaagtgttgggattacaggcgtgagccactgcacccggcctaaattttatttaccttataaaaatgtaagtacctaaaattgacctctgattatacaaatgagaaaattgaggcacagaaagatttggacttggctaagttcatgtgacttgctgaatgggatttaaaccttggatcttgtggctgggcatggtggctcatgcctggaatcccagcaatttgggaggccgaggcgggcggatcacctgaggtcaggagtttgagaccagcctggtcaacatggtgaaacccatctttactaaaaatacaaaaattagctggatgtggtgaattgtttgaacctgggaggcagagactgcagtgagccgagattgtgccactgcactccagcctgggcaacaaagtgaagctctgtctcaaaaaacaaaaaaaaaaaaaacaaaaaaaaaaccttgggtctgcctggctttattttgcatgctctttccatatgtcatgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactagatgtgaggtctttcccctaaggagttcaaaatctcgtagtgaagaaaggagtttaggcaaataattacaatataatgcaatgagtataacaacagaactatgtataagtagagatagaactgataagtatttggcttggaaaaatgaggaattcaagggagggttccatgaaggagagaatggtatctgagagaattaaaattttttttttaagttaaaatgtttaatttttgttggttttatttatttatttattttgagacaggacctcactttgtcatttaggttgagtgcagtggtatgatcactgctcactgtagccttgacctcttgggctcaagcaaccctcctgcttcaacctcctgagtagctgagactacaggcacatattaccatgcctaattttttatttttttgtagagataaggtctcactatgttgcccaagctgatctcaaattcctggacacaattgatcctccttccttgacttcccaaagttcttggattacaggcatgagccaccacacccagcaggttttattttaaataatacattcctgattaagacaaaaaacaatagtaataggatgtaagatgaaaagtcaaagactagccatttccctcctaccttcccactttccagagttgaccattccttaatactttcttgtgaagtggaggtctctctctctctctctctctctgagaagcagccccctaacttactgaagctagattagatctgtctgtattcgagagaactgtttgccccatatcataggatttgtcacactttatagtgattatctgtttacttggttttctctcatactagtccatgtgttctgaagtatagaatagtttggaggttaaaataacataccctggctctagactgcctgggtttgaatcccagctctgctattgattagttgtgtatcataaggggaaagttatttaacttcctttgcctaatggtagtattttatagcattgttgtgaggattaaattagtgtatatatgtatataaacgtatagacatacatatagtacttagaacagcacccagttcatagaaagtgctcaataaatattagttgttattaagaatagcatttagcatttttctggtctgtattcagtataaatttatggaagattgaatgaactcatgtttcagttagtggctgaaatagaatcttaatacttggtctgatcaaagggcataggtttagttcttgttctcttatgaattgttgagtttcttcctgttttctcccattgcatcaactgcatttctccttgtgatgttctctcatagaatggttagctatttatagcttatttttaaattgtgtttgaccagtccatattcaaagaatgctttatttaagtactagaaacttttttggtgtttactatagaaaggtttaggttggtataagcttaaatttaattgagtttctgttttcaatgaaattatttattcactcattcatttgttatttgtctagtacttttgggccatctactatatatcctttattatgaaagtcactttctgagctttgaggaattgagtagatagatcaagcagacataaagaacattttaaaatctaatcctcttaactttgctagaacttatctgttcttctagttgtcatcactctagttcttatattatacagtcgaccctccatatccgtggttctatatccatagattcaaccaacctggattgaaaatattagaaaagaagtagatggttatgtttgtattgaacatgtacagactcttttcttgttattatttcctaaacacgatggtattacaactgtttacatagcatttacattgtactaggtattttgagtaatctatagatgatttagggtatacaggaggatgtggtgggttacatgcaaatcctataccattttatgtaagagacttgagcatccatggattttggtatctgtagtgggtcctagaaccaatccctcatcaatactgaggaacaactgtacttgtttgttttatcacttctactaaagtgtaatactttgtaggcaggatctaaatatgatttacctttgtgttcacttttatcacttgatctgtcttgtgtgtggttaagttttttgaagaatgatagtagtggcacctttatgtgtcgggtgctgtttagaatagataccattacttccatttgacatatgaagaaataaaaacttgttaggttaagtaatttgctcatttacacacctaataagtattagaaatgaggttaggtttgtctgactgccaacccttgatttctaaaataagcacaatactatttgacatatttacttgtactcaaagtgacagggatgtaacgtatatgaaattctgtcactgcactaatagttttttctggtttaagtatacattacattcctttacaccttattatttatttatttatttagaaacagaccctcagtcacccaggctggagtgcagtggtatgatcttggctcactgcaacctccacctccagggttcaagcgattctcatgcctcagcctcccgagtagctaggattacaggtgtgtgccaccatgcctgctaatttttgtatttttagtagagatggggtttcaccatgttggccaagctcatctcgaactcctgacctcaagtgatctgcccgcctcgtcctcccaaagtcctgggattacaggtgtgaaccaccatgcctggcccctttatactttagatactatgagcagtaatataatatctatactggtggaatagttgatattcattagattgagatacaaagaatatgatgttgctttatctttttggtatgtctgaataattgtagtttgagagaagcagtttttttttttttttgaaatggagtcttgctctgtcgcccaggctggagtgcagtggcgcgatcttggctcactgcaacctccatctcccaggttcaagcgattctcctgcctcagcctcccaagtagctgggattacaggcacgtgccaccacacccagctaatttttatctttagtagagacggtgtttcgccatgttggccaggctggtcttgaactcctgacctcaggtgatccacccaccttggcctcccaaagtgctaggattacaggcatgagccactgcgcctggctgagaagagcagctttaaagtacatcataataatggtgggtgtttccttcagttaggaaatgagcattttgctatgatttttattttaaaaaagagatggagaatttttgaaggtatccttatataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctacttttgttattttttttcttttggtgatctgtgctgtcatttgcatgttagtaatctgattttaagaattttgtattttggggaacataaccatgttaaaagacagtttattttagtactgaaagaaaatagttacttttactctcatttatttaatttctgttcattttttccctgtatttagaaacaaaaaaaacatcacgaatctttcccgcttagttgtccgcccccacacagatgctgtttaccatgcctgcttttctgaggatggtcagagaatagcttcttgtggagctgataaaaccttacaggtaaaacacatctcttgagaaaaatgcaaagaggcatgtatccagttttgtgcagatcagaatatgtttaaatcctaaaattcaagaaaattgcaacttagaaataacagaggaatccagctctcttgaacattttattaaaggtttctctagagatttaaaagatacagttacatgttttcctaattctaaacttacaggtggtaaggaagtgccctttaccctgccagtcagttcccagccatccatttgtcagctaagggtagtgaggaaataattgttagaagacgtagggcttcatagcacagggaatagggctgtgattaaaaaacagtgattaggaaaatacctattttatcaaagtcttaggcataggtttttttcttgtaaataggaactggactagactatttcctaagttgttttaaagaatttcctttaagattccctttgttttcagaaaatattaatgagtacttttctttatgtttgtgttctgccttttgattttgcagagaacatgatgaaattagttaaaacttgtatttaggatacttttagtctttgcaagattatgactccatagcttatgtctatatgtgtactttattactaattttattaatcttggcttttgagttccagagagaatgcatattaaatgaaatgttttatttgattgttaagaatttgccaaaatagtctcaagagctgaagctgtgctctgacacttctttttgatggcagcggcgggctgcctggagtggctgctgccatcatgctggctgcagcagggaggcgcagctggggctgcatgctctgtggagctggcggtagctggggacaagcaggaaccctaccccttctgaattggggcaggagctcctggttcctgctgtagccgcccaagccacagctgtggacctgggaacccgctccatggagcaggccagagccctgccctcctgggtgtagctgtagccgcccaaaccacagctgcaggctcgggcctccggctccacagagcaggcaggaccccttccccctggtgcagctgtagctgcccaagcggtggctgcagactcaggcatccctgtactcttgggggacctggaaggaccccctgcccttgtaggcttggaagtgcctgctcccgctgcctgacttctccctactgttggcacccactctgatcttagagcaaagctggggctgagcctgggtgctgttgcagcccggccagatgtgcacatgcttggggcagtgctgacatgccagccccctgccgcctcggccccctccggactttgggtgctgatgagcataggagggaagccaagggggtgctgagggcagtttgatactggcctgcaggctccccttggcacctacagcctgggtgccattcatggcagcaggaggcagacaggttcctgggtggaagggggcgggtcaccaatgaggccccaccttcaggccacaaagggcctgaagactgggggctgggctgctggtgtggactgaatggactggagtgggaacttatagtgccttttccaggcttgcccatgtctgcccatggaccagttggcatgtacttcctcccttctgaagcccataaaagcctcgggcttagccagtgctgagcagacactgggacaaccagctgcagagaggagcaacccactctagtgccccctctttgctgagagctgtgcagatgacaggaggaccagctgcagagaggagctaccctctctgctgatagctgaacacttgtcaggaggacttgcctagcagagaggagctaccctctcctgagctgtggaaaggagctgccccccgcaggtttattgagctattttatcgctcaataaagctcctgtttgtcttgctcaccttccacctgtcagcgtaccacattcttcctggttgtaggacaagaacttgggatcccactgaatggtgaggctaaaagagctgtaacacaaacagggctgagacatgccccttgcttgccgcattgcaagtgaagataagtaaagaaaagctgcggcccttcggggagcccagacttgggagctccccaagctagggctgtgactccctctttggggccccgcggttcctggcatctccaagcttctgggcaccaccgtgttccccggtgccagcgtgtaagctgcttgtggtgtgcctggtccagccacagcctcacagagagccagagcccatgctggcacctggagctgcctgccccgctgcagcagtcagcacgtctgtgcgcagtggctggaccccacgctcactcacacacgcctcgctgttccacgcctgactcgcccttggcaggcttgggacccaggctggtagtgtgagctgaatgcagcctgtcaggccaagtgggtgaaacaagaccagtgggcccaagcaaaacttgggcaaaggcgccaccggccacagaagtttctggccagaaaatcaacaccccaaagatcctgtaacattttcattgatatttacaaacatgtaacagtgaatagttctctagttatgtgaaggcatacacattctgacagaaattctgattttgggagtagctttgccaaggttcctttctgttttgcaaaatgacaatgattaaactcacttaaagatttttattgaatgatgaccagtagttaagcagtttattataaaaaatattttattgttacttgtgcaggtgttcaaagctgaaacaggagagaaacttctagaaatcaaggctcatgaggatgaagtgctttgttgtgcattctctacagatgacagatttatagcaacctgctcagtggataaaaaagtgaaggtaggaaaatcttttcctcttgagttgtaatcacaacagaattcattttatttttccatgatcatgagaccagagtaagtagagttaaaggactctcacctgttgatctactaacctgattcattgtaaattaacactatctgaaaattctttacttttttttaaagagacaggattttgctctgtgacccaggctggagggcagtggcatgatcatagctcactgtaaactccaattcctgggctcaagtgatcctcctgccacagccttccaaagtgttaggattataggtatgagccactgtgcgtggcctgaaaattctttatttttaaacaccagcaaaaatgcctaggttgatcacctcaggattaaacaagcagtggggaaaagcaatgacaaattagtgagtttgtcttccattaatagacaagtccatgggttaaatatcagttgaaatctttgagtgcattgtgattaggagtgttgctgcacaaacttggggattcctgttgtaagatacaattttaaaatgcaaccccaatttttttaatttgcttatgaactggcttatatattcagtggaaaaccaggtggatgaacaaactaataattacgttactggtctaaaaacataaatagagaaaagtaaacagagtaatttttacttatttattttgaggcagagtcttgctctgacacccagactggagtgcagtggtacaatctcggctcactgcaatctctgcctccaggattcaattgattcttatgcctcagcctcttgagtagctgagatcacaggtgtgcaccaccatgcccagctaatttttgtagttttggtagagacagagttttgccatgttggtcaggctggtattgaacttctggcctcaagtgatccgcctgcctttgactcccaaagtgctgagattataggcatgagccactgtgccccgccagagagtaatttttatttttgttaagtattctcttgttcctaaatttggcttctaccaggagcatttatactaatatagaattcaagagaaactgaaggcttgtgggggttatcactgatatatggaagacagaccttactttaaccctttttcaaaggggttaaatctggagtactggatgtagctaggtggagtgggcaagaaatttgccttgggtgttttcctgaagttttcacctactggaagagggctatggaatgtccagactaaatttgagaccttggaaaaatctacctcttgatagattggactcgtggcttaaccaacagttaattcactctgtagtgtctactctgactctgagtcagacttggaggtggccactgagggcagttctaaagtcagagctacatggagtaaaaggaaataataatgagtttctgttttctaagccagaggtagaaatacctattaaagaactttaaaataagataaactctctggacctctggggattctaatcagtgctttgataacatacaaaggaaatgccaaaggacattagtacctctaaaaagtcaaaatcccagtgaaggttcattaggtaatttatttcttttgtttgttgttatatggcatagactgcttagttgtcttacatagtaactagaatgatgattaatttttttgtttttttttttttttttttgagacggagtctcgctctttcgcccaggttgaactgcagtggcgctatctcggctcactgcaagctccgactcccgggttcatgccattctcctgcctcagcctcccgagtagctgggactacaggcggccgccaccgcgcctggctaattttttgtatttttagtagagacggggtttcaccatgttagccaggatggtgttgatctcctgacctcgtgatctgcccgcctcggcctcccaaagtgctgggattacaggcgtgagccaccgcgcccggcctgatgattactttttactgaaaactgaacactataagaggctataaatactacacactttgtcatattacattatcaatttcctgctacagcttgcagggttaagtgtcgatcccgtttacagaagaggacgcagattcagagatgaagtctcttgctcaagcttacattaaactgggaacagtaatagggttgaaagctgggtttctctcagactataaaacctttattttttttaactaagcaatctgcctttacttatttatatggtaccttgaagtccatagaacacttgtcatgttcattatctcatttgatatcttaaattgtgtgggagaggtatagatatccccattttacagaagagggaactgagatgcaggtaagttagggatttgtgacacacaagtcataagtggtagagccagctcttgggctcaacccttctgaccagaaatctattatgctaacctctttaaagcacttctctgcctgctttcattcatataaacatgtgaaatcttgcccttaagaaatgtcatgtgttcatgacactctagttatgctataggtacatatatgtatatttgcaaataattttttttaaacattaaggcaaaatattgccatattttagaaaggggagaggtttcattagcatcttgtccaactaggaaaatctgctatgacaggataagatagcatttgcaaagcaatggacattgctttgcccctctgttctccctttgaaaataatggatatttgtaaattttttctcttttctctttagatttggaattctatgactggggaactagtacacacctatgatgagcactcagagcaagtcaattgctgccatttcaccaacagtagtcatcatcttctcttagccactgggtcaagtgactgcttcctcaaagtaagtgtggatattgagaattaggtagataaatttgattcgtacatcagagtatctcctttgattttcttatgtatactactattaggactttctggtcacaatgatagaaactacaataatatattagctgaagcaaaaaaaaaatagcttaaaaatattttattggctcatgtaactgaaaagtctagagggagcatggcttcaggcatagctgactccaaatgcttaaactgtgttctcaggctctacctccctttccatctccagagtcttgacttcctctgtgttggttcaggcatgctctttctgtggcagaaaatgtggctaccttacagctcacaatcacagagtaagagaaatgtgctctctcctagaacccatagatctaattttagagaagcctttatttgactcattttggcttacatgctcatagctagggtaaccccagtggacagtaggatggaatccttggattgtccaagggtcacaagtttagttatatggaagtgggacaaatgagtgaggtcaactctacttgaatcgtaagtagagcttaattcaaaagagagttctgttatcacagagaggagggagaaaaggtgctggtaggaaagataaccaaaaacagaaattcattccacatatgctttgtaatgtttgattgtatctttttttcctcttaagtggataaagatagctagattaccttttctggaatcccagaaagatctgctaactttttttgaattgttttttggtttgatttcaaacctttcttccttgataccataccatctttgcaattgaacatgatatttttgagaggggtagtaaaagacatttcagtttggaaaacttcatagactctatgttttgacatttaaataaattattagaaaaattatctttagaaagtactgaaacagttattgaaaattgccgtctccatccccctgttcaggaagctaaatttttatttatttatttattttttcagaagaaaaaattatacagaagctcagtgtgtataagagttaaagcttgctgctctggctgaatgggacctacatttcttcttgactctctcttcctccccctttccctctcctctctctctctccctctatccctttcccttcctgtcaccttcccttcctcttgaccttcctttctctcctcctccctctcttcttctgtctcctcctcctcctccctcctcctccccccaccccccctctcattctctctcattccctttcatctctaacctctccgcaccacatagtgctctttaggcatatttatgtttatagaatcccaaggaccctgcagagcacaatttgaaaacactggattggaccaaaattacagagtaatgtagtaacataaaattatatcacagttatggttcacttttactcaaaaaaacttggccctatttgaataaatgtaccactaaaaaaaaataagactgttatactatttacgactaatttttgatgttgcttttggcattttgtaggttgaggaaataaatacaggaaaaaacctctgccatgtgggagggggttattggttagtaagccattttaattaaggacaaggtttactttaagatgtgctatactacctatattaccataaggactattaggatgcatttcttgtgattcttgagcagagagaagccagtgaaaatatgtaattgtgaagctgccttcatgtaacttgctttatctgaagaattgagtttatctaggactgggataaaggagtcaaagatagaagtggacatgaggaacagtatatatctcacttactaatcatttctaaataatttttgccaaaactaacatttagcaataattgatttcttcttctgggtttaatcttattagcataaatcaccagagatgactataatcccttttatttgcattttttatactttccaaacctacccaaagagaggagatataatataaacccctgtggtatccatcatttagtttcaacaattatcagtattttgtcaatcttattttataaatacccctcccttttttttttttttgagatggcatcttgctctgtcgccaggctggagtgcagtggcacgatcttggctcactgcaacctctgcctcccgggttcaagcgatttccctgcctcagcctcctgagtagctgggactacaggtgccgtgccaccatgcctggctaattttttgtattttagtagagatgggttttcattatgttggccaggatggtctcaatctcctgatcttgtgatcgcctgcctcagcctcccaaagtgctaggattacaggtgtgagccaccacgcccagcttataaactcctccacttttttgaatagagtcttcctctatcacccaggctggagtgcagtggagcgatcttggctcattgcaacctctgcctcctgggttcaagcaattcttatgcctcagcctcccaagtagctgggattacaggcatgggccaccactcccagctaattttttgtgtttttagtagagatggggttttgctatggtggtcaggctggtcttgaactcctgacctcaggtgatacgcccacctcagcctcccaaagtgctgggattacaggggtgagccgccatgtccagcctgaatagaggattttacagcaagtcctaaatatgtcatttcacccaaaatatttaagcatgcatctcagagatcttaaatataaatactatgtttattatcataccatactattatcacacctaacataataaaatatagttttgtaatatacttggtccatgttcacttattccatattctcaaaacatgcatttctatcatgtttgttggaatcagaatccaaacaaactttatgtagcatttgttctgcctcttaagtctcttttattctattaaagttccctttttcctctgactgctttcttataccattgatttattagagcaatttagtcatttgtcccatggaatgtgccatattttggatttggttaattgcttcctagaggtggtacttgacttgctccaccatttttagggttggataacctgacatttaaaaaatatgggggtaatttatattacatattacttattgtggctttttgtaactgagtaaaataataatgattctaaaccactccgttgaaataagtagtaattgtttagttagttatttagtactcagcctaaaaacctcggtgagcctttgagtcccttagtcgatttacatgctgatctaaaggctgccccattgcttgttaatcacaagttcatttttgtgtttgatacgtttgtgttactgtgaattaaacatcattctgtaatcaaaaagcttaaatgagagaaaaggaagaacttcacatgatttctgatgtttccccactcaatactagttgtttatttatctttttttctttcacaaatagctttgggatttgaatcaaaaagaatgtcgaaataccatgtttggtcatacaaattcagtcaatcactgcagattttcaccagatgataagcttttggctagttgttcagctgatggaaccttaaaggtatgcttttgtacactattaaaataggttgtattttatggaaagtcttatgatttgattatagaaataggtttctgttttttcacatttctacagaaagagcctgcttctttcaatttccaggagcatatttaatgtaactgtaattgcttatcgtaatgattgtttatgaatggtgtacaacctaatgcttaaagttctataatgtaggctgggtgcggtggctcacgcctgtaatcccagcactttgggaggccgaggtgggtggatcacaaggtcaggagttcaagaccagtctggctaagatggtgaaaccccgtctctactaaaaatacaaaaattagctgggtgtggtggtgagtgcctgtaatcccagctacttgggaggctgaggcagagaattgcttgaacccgggaggtggaggttgcagtgagctgagatcacgccactccactccagcctgggcgacagagtgagactccgtctcaaaaaaaaaaaaaaaagttctgtaatgtagaatttttattcttttaatttgaattcttaaattttaagtgtacattttgtttcaagcatatgttcataaaatattttgagatctgttttagtttattttgtgcttctataatttatgttgtgcttctataaattgtgagtaatttataaagaatggagatttatttcttacagttctgggggagagggtaccagcagagaagggagagagtgaggaggcggctgaacttatccatttatcaggaacctaggtaatagcattaatccattcatgagggtagcgccctcatgacctaatcacttttgaaggtcccatctctcaatacttgcatcagggattaagtatttaatacatgaactttgggggacacgtttaaaccacagcaagatctatgggtcaggtttgtaaaggatctggcttttgtttttgtttttgtttttgagacagtctcactctgtcgcccaggctggagtacaatggtgtgatcttggctcactgcagcctctgcctcctgggttcaagcgattctcgtgccccagtctcccaagtagataggagtacaggcgcctgccaccaagcctggctaatttttgtatttttagtagagacggagtttcaccacgttggccagtctggggacctgtttttacttataatttattcattctgccttttatattattgctttcttgtttttgagaagccacaaggtaggaaaaatgcaagagttagggaaaaaagcttattcagccttctgaaatttataggcctaaaaaaatgaaataattcttcctcaaatccccaccttctccaataagattcccaattccactttattattcctgtctctattgtctctcctgtttattgactgtcctttctttctttggtcttaagatcaacccatctttgacattgttgtctcttggtctacatttttccctcttgttctgtagtagttgctctagttcaggctgttgtctgctcatgcctgatagcaaccatctaagatgcattctgcatctcttcttatctaagttcagagatactagaataaccttctaccactgttttctttctttttttttttttttttggagacagagtctcactctttcactcaggctggagtgcagtggtaccatcatggctcactgcagccttcacttctggtctcaagcagtcctcgtacttcagcctctcaagtaactggaatcacaagcatgtgccatcacacctggcgaaattttttttttttttttttttttagagataggatcttactatgttgcccatgcttgtctccagctcctgggctcaagcaatcccagtgctgggattataggcgtgagccaccaagcctagcctaccactcttttcttttttcttttcttttctttttctttactcttctcttttctttctttctttcttttttttgaaacagggtcttattctgttgtctaggctggagtgcagtggcctgatcctggcccaccacagtctatctcctgggcttagatgatcctcccacctcagcctcttgagtagctgggactgcaagtgcctgctaccatgcccagctaattttttgtacttttattagagatggggttttgcctatgtttcccaggctggtctgaaactcctgggctcgagtagtctgcctgccttggcctcctgaagtgctgagattataggagtgagccactgcatccggccctaccactattttcaacataaattatgccatagtataaactgtaggaaacgcagactcattgggatgacttctaaggttcttcaccttccgtcattctgccacatcctttcctgtcaagtttgtttcttctaacccctataccttaattgtctgttctgggcaaggtgttttatttcagctactgtccctgtatgtgtttcttgggatgtttcctatgtgtgcccctgtagcttttcttaggatgttttttgccttcgatttcacttgccatattttttaatgcccgtcaaaactttaggcaaagccttttgtgtgagggtgagagagagagagagagagagagagagagtgtgtgtgtctgtgtgtgtgtgtgtgtgtgtgagagagagacacagggtcttactttgtcacccaggccggagtgcagtggtctgggctaactaaagtgatcctcctgcctcaaccgcctgagtagctgggacttcaggcgtgtgtgacaatgcctagctaattttgtttaatttttgtagagatggggcctccctgtgttacccaggctggtcttgaactaagctcaagcgatcctcccactttggtctcccaaagtactgggatcacagacatgagccaccacacctggactgcaaagcattcttcagaaagtgttctcttacagcatccatctgtttggttctgagtacatatatctatctatatctataggtagaaactgcttggtttgtcttctgatttccacttataaatgtgttgtactgttcagtcattttaatgtgtcttctgtttctttgattaggttgaatataggtttatgatctgcagggaacttgacatctttttgttgtattatacctttctttgtaactcatagtacagaattgtactcaagtattcagtaaattttcttgactacaccttttctaggaaaatacttaaatactcctgggcactattttgtttgttagaatctctagggaaggagattcagcaatgctactaactcctgagaaaggtaaactgttttgattctgatactctggttgaatctttgatcttgctttgctgacggaagataactgtttttgtataaattactccagagtatctagaaactctttctgggtagaattctactttgtagagtttagctagctgttagtgggtgctgggagcattcttaggtagaatattcaggtaagtggattttggcctctatgctatatctatctgcttcttcctttagaatgatccatgtcatgggaggtttttcagaatacccgtggatggatttaggcagccctcctttcattttgtcagcctattatttcctggtttttactcagtgaaagacttcagaagaaggcattttatattttaagttttcctttcatcttatctcctttgctaattccaaattctgggaagactgcattatccttagcatgtttgccattattattaggttgccaaatgttcaagaaagctgtaaaactaggccatttatgtgttgtacaaatataagttgtacagctcagctgggccttatttgccgctgaattatggtctgttcatccctaatttatttgcttttccactagtgcctattctaatccttttctgctgttcttaagcccctaacccttttattttatggcaataatgttacctcatacccattcaaaggattaaaaccatccaccaagagtcccctatcataagccccctcagaaattgctgtaaaaagcctctgctccattttttctcataacagtgtccaaaaagtcctgtacttgggccagacatggtggctcatgcctgtaatcccagcactttgggaggccgaggtgggcggatcatgaggtcaggagttcgagaccagcctggccaacatggtgaaaccccgtctctactaaaaatacaaaaattagctgggcgtggtggcgcatgcctgtaatcccaactactcaggaggctgaggcaggagaattgcttgaacccgggaggcggaagttgcagtaagctgagattgcgccactgcactcaagcctgggggaagagcgagactccgtcttgaaaaaaaaagaaaaaatcctgtacttgtacctactgttcctccctttccttcttttcctggcaccttgtttcattagttgtttcctctctatgttgcttcttcagatttttcttcttttttgaattattttccacagcttacaaatgttcttgggccttcctgagccttataaagccaaaaagtgaaaaacctttgattcttccttgattgtattgttctttaaaattgtcattctgtttttctctttcccttcatgactgggcttcttaagtcatctatacttgcctctgtttcctgactacctactccctgcttaaccattttttagcctggtttcatcttccctgtattcccttgaagaatgtaaaaatccagttttattttcagtttcaattttttttgtagtctaaggccctctggattagtgtgaaatctgatatttttctttatctgattctcattatttttgttgtattactattggtcaaacccccaatgaccacctagtttttttgtttttttgtgttttttttgaaactctcctcattttacatcaatgttttattctttctcctcttagctctctgatcccttcattaactattttccctgaccattaaaatgtagctattcctgcagcatctaaccttggctaccacctctatcaccgctcttccatcccagttcattcagtctcatggcttcaactcatcttttttcaggtatgtcatctgcaaccttcattttatgagctgtgttcttcattcctaacttcctgctagttgttgtcacttaagtaacataccatgcctcaaagttattgcactccaaactgagttaattattctcttctcaaacatgacctactttttatgtttcattattattttttttagacagagtctcgctctgttgctgaggctggagtgcagtggcgcgatctcggctcactgcaagctccgcctcctgggttcatgccattctcctgcctcagcctccctagtagctgggagtacaggcgcccgctgccatgcccggctaattttttgtatttttgagtagagacggggtttcaccacattagccagaatggtcttgatctcctgacctcgtgatccgcctgcctcggcctcccaaagtgctgggattacaggcgtgagccactgcacccagcctatgtttcatgatttaaaaaaaaaaatttcaacttttatttagattcaggggtacatgtgcaggtttgttatgtgagtatattgcatgatgctgatgccgaggtttgggtacaactggtcctgtcatccagatagcatagtacccaataggtgcctcattcccccctccccaactctagtagtccccagcatttattgttcttatctttatgtctttgtgtacccaatgtttagctctggcttataagtgagaacttgtggtatttggttttctgttcctgcattaatttgcttaggataatggcctccagctgcattcatgttgctggaaaggacatgattttattcttttttatggctgtgttgtatcccatggtgtatatgtaccatatttcctttaaccttccgttgatgggcacctaggttggtttgtgtctttgctgttacgaatagtgctgcagtgaatatacaagtgcatgtgtctttttggtagaatgatttgttttcctttgggtgtatacccagtaatgggattgctgggttgaatggtagttctgttttaagttatttgagaaatctccaaactgctttacaaagtcaccgaacaaatttacattcccaccagcagtgtataagcgttcccttttctctgcagcctccctggcatcttttattttttgactaaaaaaaaaaaacaacacatatataaaaattatatagcagtgttttgtagttctccttgtagagatctttgacttctttggttagatgtattcctgggtattttatttttttgtgtgtggctactgtaaatgggattgtgttcttgatttggctctcagctttaatgttattgatgtacagaaatgctgctgatttttttttttcttaaatagaaaaaaggtcttactacgttggccaggctggtctcaaactcctggcctcaagtgatcctttggcctcagcctcccaaagtgctgggcttacaagcatgaaccactgtgcctggctaactgatttttgtacattgattttgattagaacagtgttcagggtttacatcattgtaactaatcacaattgagccgtatcgtgtgaatttttttcctctctcattagctttctgttttccctggggttgataagtttgttttttcatttgtttagtttttatatgtgcttatcttcaaactctctcttgttaatttgctccttaaatgattcaaacttaccaggcattttataagtcttttcttggaaacaacatttttggaaggttctatcttgctccattctggtcggtaatggtaatactattcccagagtccagctgccatcctgaggtcttccttaccatcatcctagggattccttttgcttttcttttaaattggaacacttgtttttcagttttttttttttttttcgtcttctttcttggcttactttttcagcttggtggagaatctcctctagcttcctaagaaagaatctatgggaagtaaatttttaaggtgtctttattataatgtctaaagatgtctctgtttttcacttgctgatttgcttgagttccttatgaattctggatattagacctttgttggatgcatagtttaacaaggccaacaaaagcaatgcgggagaggactctctattcaataaatggtgctgggataactggctagccatatgcagaagaatgaaactagacctttaccttttaccacatgtaaaaattaaagatggattaaaaatttaaatatatgacctcaagctattaaaatcctagaagaaaacctaggaaatacccttcttgacatcagtcttggcaaataatttttggccaagtcctcaaaagcaattgctacaaaaacaaactttgacaagtggaacctaattaaatgaaagcttctgcacagcaaaagaaactatcaacagagtaaactgcctacagaatggtggcttctttcaatctggaaacttatccttcagttctggcatttccttgaattatttgatttcttcctattttctctttctggaatgcttgtgtttctggattaaaattttttttcctctccttccttctttttgtccatttgccctactttttgaaagatttctttagctttacttttctttccttctattgagttttaaatttctgctaccatatttttaagtattcattcttgtgtgattagttccttttaaatattattctgttcttgtttcatggatgcagtatcttttatctttttatgggcattagtaatagggttttttttgaagttttcatattccagtgtaatagatatttttctatttgttggttttggtttctgtttggattttagacatagatatatcttagctatctgatcctttgctatctgctcatatttaagaatacatcaccaacaagttgaatgggaattgtgaacttttaaattgtggttttcctatgggttatctgtttttatcatgaacaattttttttttttttttttagacagtcttggtgtgttgcccaggctggagtgctgtggcaccatctcggctcactgcaagatggtgaacttttgatgtcaaagtctttatatcttttgtcttgaactggttgggtgtccagagtaaaaattttcttttctcttttttctttttcttgcattttttttccctcccgagatggagtcttgctctgttgcccaggctggagtgcagtggcgtgatctcagctcaccacaacctctgccttttgggttcaagcagttctcctgcctcagcctcccaagtagctgggattacaggcacgcaccaccacacctggctcatttttgtgtttttagtagagacgggatttcaccatgttggccaggctggtcttgaacttctgaccttgtgatccacccttcttggcctcccaaagttctgggattacaggtgtgagccactgcgcccaatgccgcccccccccttttttttttttgagacagggtctcactctgtcacacaggctggagtgctggagtgcagtggtgtgattgcagctcactgcagcctcaacctcctaggctcaagtgatcctcccaccttagcctcctgaggagctgggactacaggtgtgcaccaccatgcctggctagaagaaattttaatctcctatttgtaggatatgactctggccagttctgagatgatatctgggcagagatctcaacatttagaaaaaagactttctcttaattttcctgttttcaggtgacccttctctcaactgtgttgggtatagaatagccttgtattctgccagagtagggacacaggccccctgggttgcagagtgaagggaggagatttcaatggacttttaaagattcctcttgacttagcttcacctttatcagaaggtactgggtgccagcacttcctgagtctttttgaaggacttaacttcacctttatcagaaggtactgggtgccagcacttcctgagtctttttggagttctgtggggtgattgggctgcttggatttctccactgcaggctcagaatttaatttctaggagtctgcctattacttgcctttctgctttctagacttgatgattttgttgctgctgtctctttctccattttccttcgccttgtggattatgccgagagaaaaattcctattactattgtttacctgagttttgggagagtttggaaatggtctgtgtctgttctctgttttctgaaacataatacctgagactgggtaatttataaagaaaaggggtttacttggctcatgattctgatggccggaaattccaggattgggaagctacacctgatgagggccttcggctgcttccactcatggtggaaaggggaggggaagtgggcgtgtgcaaagagatcatatgaaaagagaggattgaagatagcgaaacccaggaagccagactgttttcaacaacccgcactcttgagaactaatccattcccagggaactcaccccagtgggaaggcattagaaggcattcatctgtttatgagggatccacccccatgacccagacacctcctatcaagccctacttcccaacactgccacagtggggatccaatttcaacacgagtttgggtcaggataaataaaccatctccaaaccatagcagagctgtatgtgttctctgcatctttaacacctgaaccctatttctttcagcaacactattgtctgtactcgcctgtgcttgaaacttgggagtgatctttttgtttgtttgtttgtttttagagacggggtttcaccatgttgcccaggctggtcttgaactcctgggctcaagtggtccgcttgcctaagcctcccaaggtgctaggattacagacatgagccactgcaccctgccgggagtaatcagtcttttcacttaaaatgtatttattgaatacttagtgtgtgccagatactgtactaggtatttggattttaaaccctgaaaaagaaaaaagtatacttcctggctgttctgaactgttcagaataaagttggagagaacataagtgaacagatgaaccatgaaaatcataaacgtatgaagacagtgctctgagagcagataaggactctgttggggaagggttcacatacctgatactacaaccagattgaacttgttcttctttttcattgtctttgttttctcattttgtactttagcttatgctgatcccttggaataggctctaggccctggagtgttcccctgtctttttgatgttgaaattctctgtcttaagctggtataagataggctaatctcagggagtagagtgaggtgactacctcctgtacaaagtgttccctcaagccctcagcttgaatatagcctccccactgtgctataccttttcctttcaaatgacacctgacatattttgtgtttaagttatttatgtgcttgtcttacttcccttactggcctgtcaactcattgagggtagtatctgtatctgattcatttatatagtctcaaagtgactagcatagtgtttaataaatgtgttaaagatgataaacccttgctgtgtcacttcaagtcaaactaagacttcttcaaactcggacactttttaaaaagtcatcatttgacagggacaggattttgatttccgtattcatgtatgagtatcaaaatgtgattgtggctcacagagcactcgcagcaggggacagacactactgcactcttggtgagaactgcccatgtttgtggtggctttcccaccgtgctgttaagtcagtatcattggttggttcacactgatataatgacaggtagtaagcagaggtcctgcaaaatgatgttagataacagcatttcaaggtcaaattctcctgtaagtttttaccttttgagaggatgaaaactgtaaaattatgtcctgccccaaatggctctataactttttaagcattttgtagggtatcatgttgataagcatgtgcttttcaggctctgagatgaactgttttaaaatgtgagttctatttaaaaatttgccatttaaagcacgcagaggcctggggtgcacagggaccctggatacagtgtagcgacttgctcagaatgaaatgctggtattagtttatgtggtccctcaatatgtgggatttcaccactgcttggacagaagctgaagtcaggtccagaaacagatgcaatttagacatgtataatcaagttggattgtgctacttttatttttctttgtaaaattcaggcaatagttgctttttctttttgttttttaaaatttttttaaattgaaaacaaaacaaaacaaaacagatgaggtctcactgtgttgcccaggctggtcttgaactcctgggctcaagtgatcctcccaccttggcttcccaaagtgctgggattacaggtgtgaaccactgtacccagcctgattttcatattaatagggaaactgatttctcatatattctggataatgtaactgaaggttcaggcttttatgtttatttatttatttttctctttagtatcagggaaggctgttttagcacctgctgtctcttttgcattacccagattacctgcagttgttgcaagtagaaaagttttggttttggccatgtttcttagtatatataatacttctttttactcgagagatttgaaaatgtacctggccagaaaaattaggttttacctgggagttgtgctttggaagctgacttaaagcctgagcagcagctttctcccccaacccccatccttctccgtggccaacctttggtttgggcatgggcagtcattatcactctgtgaggctgagacactgctcatggcccagaggagtgaaggtggatcttcttgaaggcctttgtcttttgtgctattcaagtggtcctactagtgagcaaagtttacagtattttgtatctcattcctcaggatccagttagttttgtagccctatctggccctgccaagcacacaaagagtcttgcttgtccctgttttcagagacttccttatgtctctggatgctctgctaggtcacgacctaacttggactgggtcctgtgtagtcttcctgctgtgcatgtggtaggttcgtgaaacacacttcattcctggcacagcagagggcagcagtggcaagtcgtgagtctcttcatcttaccacctttcttccacttgtgtccttactgtcaacatgtaatttttagcttccacaccatgcaagactcttaactttttatttaattttatgttctgcattttgggcagtgcttctaattttttctttttaagaacgtaataatgaaactggagatcttaatttaaaagccttacaaaaagtcatgcataggtaaaaataattcatcaagtgaagtgaataagtttatgtggcatttaatttaggaaaaattctagaagtgtgattatagagtaaaacaaactttttcttttttattactttaattcaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttgtaagtactttaaaaagccaacttcagtctgatttaaagaaagttaaaacttctgttcatttttgcattttacaatgtttattcataaaaataaagtctagctgtgtgattttgggcagtcttcctaacctgtcatggttctttggaactgtgctccgtgagataaggatggccttgtaaggaaaggtctccatggttacaccgtttgggaaatatgttttgtattgctttcccctattaggcacactgtatgaactaacatattcagggccccaggaagtcctcttacacaatttatgccatcgaatccagtgttcctcaaatgtatttaaaacatagaatgctttcttcatcactccttttttttcttcaattttgattacattggtttaggtgatttttcaaagtgttttcttacacctacaattttatgatttgatgactctgacagaaatgctcatcaatgactgaacaagatagtgaaatttttataaagtaaatgaggaaaatatgaaaaaagtaaataagaaaattctttgcttttcttccccacatctaatagtagctggtatttgtggtattcagagtgccctcacatataatttcttttgatataagtattcaagaagcagcgggttacagtagccctatgataataatgaggcaactgaggttcagagcagccaaatgatttgtctaaagttacattgtgattaggagaaccagatcttctgatttatggctcacttacattctcatctaatagtgatttcaaaagacttgaatgagggatattactgttttaaagagcataattgaaatataaaatatggttatataagaactcactgagggatcatgtatatgattgttattgatttagtgctacaatccttggatgttggttgcttatgagtttgtacccctttagcaggaaactaagaggaaaaatacctccctttaagtttgttaaaatctataagaacagaaaagaaaccactgcataagcaagacttgaagattaaaacttttttattgtgataaaatgcatataatgtaaaagttgccattttaaccatctaaaaatgtgcatttcaatggcattacattcacaatgctgtgtagccattactactatatatttccaaaactttttcatcaccctaaacagaaactttgtaaccatgaagtaataactcctctttcccctctcttgctagacctttgtaatctctaatgtaatctgcgaatttgcctaggtatttcatataaatggaatcatataatatcggtccttttgtgtctgactcatttcattgagcatgttttcaaggttcattcatgttgtagcatgtatcagaactgtatttcttcttatggctgaataatattccattgtatgtatatatcacattttttctttgtttttttttttcttacaaaccagtgtttattttcacatacagccttgttgtaaccaatgtacagatcaaaactcaaaatattcctcttcagaaaactttgaaccttatcccctagccgacctataatggttgaatttctgtcaagtatatatttatgtatataatgggcttaattatttaagagaataactgagtgatttgtgtgatctgtgaaaaggaattggactatcatacttgggttgtatatcacatttttttcatccattcatctgttgatggacacttggtttgtttccaccttttggctactgtgaataatgctgcagcattggtgtacaagtatctatttgagccttgtgtgtttacctaggagtggaattactgggtcatatggtaattctttatttatttagttttctgaggaaccactagatttttccacagcagctgcaccgttttacattccactagcaatgtacaagggttccaatttctccacatccttgataaaacttgttattgttcatttttaaaattatagccatcctagtaggtgtgaagtggtttctccttgtggtttgatttgtgttttcccaattaccaatgatgttgaacaaaagataatttttgaaaagattttaagagacctgttctagtgagaggaagataattttatattgcatgaaatgccttgttttaaaaatctgtacagcagttccctgttttaccatgctaaaagaaagctacccaaaggtgttccttaactgcatgtagatcccgatttcttaccctttggtctctccttcctcctcctgttctttctttccaattcctatgtgagtctactcctattgttaggtcttttttcttttactattccataattgggacaactgcctattgtggaataggcaagtttgccaagtttcctcgatcactgtcagccactaattttttaaaaaatgacctatcttgggaagcattttaaatctgatttcctgccctgtgtttttggcctccggcgctacgctgcctaccatatgtgcatgcttgcagggactatgcattcactaaacatttttttttttttgagatggagtctcgctctttcgcccaggccggagtgcagtggcgctatctcggttcactgcaagctccgcctcctgggttcacgccattctcctgcctcagcctcccgagtagctgggactacaggcacctgccaccgcgcccggctaattttttgtatttttagtggagacggggtttcaccatgttagccaggatggtctcgatctcctgacctcgtgatccacctgccttggcctcgcaaagtgctgggattacaggcgtgagccaccgtgcctgggctactaaacattttaatagctcccactggaagcttttttgtttctttctaaggtctatgtcttgatcttaaatcagtatattgtatcaatacatgtagtaaataaaaatcatcttatttggcaaaaactttggaagagtatattcagcatttataaatcttaaaaattgaagaaactgcggctgggcgtggtggctcacaccggtaatcccagcactttgggaggccaaggtgggcggatcacctgaggtcaggagttcgagaccagcctgaccaacatggagaaaccccgtctctactaaaaataaaaaaattagctgggcgtggtggtgcatgcctataatcccagctacttgggaggctgaggcaggagaattgcttgaacccaggaggtggaggttgcagtgagctgagatcgccccaagctgagattacgctattgcactccagcctgggcaacaagagcagaagtctgtctcaaaaaaaaaaaaaaaaaattgaagaaacttggattacccaaagtagttttttggggttcaaaaacaggaaaatgattgactataatggagcaatttggtagttctagagagaaataaaaatgactgagctaattttattttagcaaacctctgctctatattattttgatcatcttcatttatgagtattcattttctcttttgaataaacaagcattagggagaactactctgtatgttaattgggccagtctattcatttattcacaaagcttttatttctctttaggctagcttgagagctcatctgtgatgaattttcctttatagaaaatatgttttaagatgagcagtatttttaaagtatatgtatattgatccatattttgtttatgactgtcaataattatgccagttatcagtaattgtcatatttttttcaggacttatatttgaaatgggaggatattagaatagcttatctcttaaagtattttaccttcataggtatctctatttatgttgacagctttttgacattcatactagtggcctattgggagaaatccacacgggccatcacagcaccatccagtactgtgacttctccccacaaaaccatttggcagtggttgctttgtcccagtactgtgtagaggtgagtagttgaatttattctgtgaagcctgggtttccagagatcaaaggatgacagagaatgggcagcttaaaccattaactgctgaggagccttgcttgagaaattatagagtattttctttatagcctaatgacctctaactttgggatattaaaccacatagccagctttattattttaacagtgattacagacttgatttgacagtatgacagggaattcagcaagcatttgctgaatgcctaacatgtgccaggaactgggaaaacaatggaatgactgctggtcatgaaacatgacatctcttatccagtatagatatgtggcatttcttaaacagtgtaggcacagactcttttcttcttaaaaaaggtggtgagaaatgagtccagttcagatttcttagatcattgagtaggataagataggatgttcattgccaggcactaatgaataaaataactcatataaattacttttttatgattttgtacttacctgttaaattttatgttcagaatgtatacctagctggccctggaagaattccacccagtgaagtgctatattagttttttcataaagtagtgaattatttttttccttcaaagatggattagtgctttttttttttgttttttaatagaaatgggggtctcactgtgttgcccaggctggtcttgaactcttggcctcaagcaatactcccccagccttggcctcccaaaatgctgggattacaggtgtatcaccttgcctggccaaagatagattagtttttccaggctttcttagtcttcattccttaggttggttttaccaccaggtagtttgaaaccccttcagatcacagttccaagaagatgggtatgggccttttggaaaatagagaaattcactgggttcacaggctcctcatcaagggagccatgactactgcaagcacttcttcagtgttctctgcttatttagcaaattttagtgagtttgccagccttgcccattactgtgaaggtgttgggggagagttgctaagctatagcccttcaacatagaggcacaggtgagagtgagggcatgagatccataggcttctcctaattctaggtgcagcagtgcatgtgacactgaagaacttccctactgagactcttcccattgcacacagaggcagggagtgtgaaaaagctctagtcctgtatgaaacagcgggaagaagtagggtgctgtgggcagtgttttgttgggcagagactttgaattggaagtgttttgttttgtgttactttgtttttgagacagagtctctctctgtcacccaggctgcagtgtagtgttgtaatctcagctcactgcaacctccacctcccgggttcaagctattctcttgccttagctttctgagtagctgggattacaggtgcccaccagcatgcccggctaatttttttttgtatttttcatggagatagggtttcaccatgttggccagggtggtctcgaattcctgacctcaagtgatccacctgcctcagcctcccaaagtgctggggtttattgggttttagatctcctaggagatcttgaaccttatgtgtagatcctcaaagtaaatgtggagcgtttgttaggatttttagaaacagtactaagtagcaacccctctttcagcctttcttgtcacttctaaagtccttaccctctgccatccttagcaatctccaggaaacaatgaaagagtatcttccttcttgaaatgtagggactcagctctggaggctctgagtgacaaagaaatgatgggagagagatggggagaagaaagtgggaagagaggggaggattctcaagggagattttcagtttcttaggagagattttcagttgtggaaccactttcatttttggcccttagctctgtatgtcccagcttggactcttagagataaggcggagaaaatttcatataattagttcataaccacagaactcactgaatgaaaaccagtcactgggcctatgatgaggtacttgttttgtccatgctagttctgaaatgataaagtagttctgtaatttaaagtgtaatgagaggaactcagtcacatatggtacttcattagacttgaatatattagagtaatttacagcagaacccaggataaaataccaggctgctggtagacatggtaataagcatgaataacaagagaaatgtgtacatgttacaattattgtgttaatttattgtaggttttacagtcagttgaaatgaaggttagatgacagtattagtggaaaataatctgaatatggaagctgcttttgttcatcctattattttttggattgacttttttaaagtgataaaatatttgcatgattccaaagtcaaagttttataatgcgttatattcagagaagtcttgctttcatccctatcccttcgcctcgctctccctccttccctgcatatgtaaactattttctgtttttggcttaactgtccaatatttcttgcatatataagcagatatctatatgcatatatatccatacctgtatccttctatatgttcttgtacatatttttccatctcatataaaagatagtagtgtatagtatatagactcttctacactttgctttttttctgttaacaatatatcctagagatttgtcgtcatcaaggtgtttttctcattgtttttaatggctgcatgatattccattatgtgattaatgtagtttattcagttggttccctattgatgagtatttagtttcctagtattttgctataaaaaataatgatgcactaaataatcttctgcataagacattttgtagttttgatagtgtgtttctgagcaatattcattgaagtggtattgctggctcattcttgctattttcaatatttttgctctcttcaaaatgcttatgtatgtgatttcctatatgctgtgtttattctgtagttgtggaatacagactcacgttcaaaggtggctgattgcagaggacatttaagttgggttcatggtgtgatgttttctcctgatggatcatcatttttgacatcttctgatgaccagacaatcagggtgagaaatattgagattttcattttgaacatttcctgatggtgagctaaacctcctacaaactaagaaattgatgggtagcactgaggtaagcagaataggaaactagtactatattcctattcaccctggaaaagtgctgttatatggactgtaacagtctcattcattcgttacatgttcattgaggattaccatgggccaagtgctgtgggaacttcagtgattaaactgtattttggttaatttaaaatactgcatttgattcctcagaaaaatttttgacccttttctttaccttgaattcctacatccaattacttgccaattctgagagagtctaccttttcattttctattattatctctacctttccatttctgctgcccaagttcaggactttgttaactgttacttctcttgttgtattagtctctgccacaagtcttctttcttgcttttctgcatgcagcttctaagatatttttttttcatgtacaatgcagtcatgtcatttttgctcaaaaataagatagtggctcccttgtctaccaaagtaaatatatacttctgtttctgccattaagcttctccacagcatggccttattctgctccactctgtctcccagtttattcctacagggaaccaacactggactgctcacattttcccaaacactccgtagttccctgcttctgtgcttttccttaagtggtttcttatatttggaatgctctacttacctgtatctctgtttgttgaaatcctaaccattctataagtcccctcaagtcttctctatttggggagaatgcctgtctctcttaatgccatctaattctatgtcattttctagtggtgcttatcaaattttgacttgaatttaaatacagatatgatttactccttatttccaacactccactgcttctctggctcattgacgtatcttacattataagctctttgaggccaggaaccctggctggtccccacagcatcctaatacagcattatgtatgaattatagctaaaattcattcagtgcttactatattcaagacattatgcaaagtactatatatatatatatatatacatataaatttactaattctcacaatagtcccttttgcagatgaggaaacaggcagagaaagactgagaaaggtcattggttcttaacatgccagtctcaatgagcttgagccagaatataaatcaacacattgctttcttcatcaagaaagtcttcttgaaatgaaataagctgcatcactagacacagttacagtgtgtttagtgatgtagttgatttacgttctggtacaaacttctttttgtttttttgagacggagtctcgctctgtcgcccaggctggagtgcaatggcactatcttggctcactgcaacctccacctcccaggttcaagcaattctcctgtctcagcctcctgagtagctgggaccacaggtgcacaccaccatgcccagccaagttttgtatttttagtagaaatagggtttcaccatgttggtcagacgtcttgaactcctgacctcaggtgatctacccgccttggcctcccaaagtgctgggattacaggtgtgagcccctgcgcctggcccaaacttcttaccttgtggattggtatcaaacagtttgataaccagcaggaggtctttatctttgagtaacactgggttaagcaacctgcctgaagttacaactttaggtagaactagaattcatactgaggaattttggctctggagcccataactcttaatactaactgcatcttactatagattgtgttagtaaatatttatttttggattataatctaatattgaaacctttctagcatcataggtattttatgtgaaacatagtttgtctctcgctttaagatgaagacatgttattttagagatggaatgataatttctttatctcttaatcagctctgggagacaaagaaagtatgtaagaactctgctgtaatgttaaagcaagaagtagatgttgtgtttcaagaaaatgaagtgatggtccttgcagttgaccatataagacgtctgcaagtgagtattttttagaaaacaattggaaaattgttttggttgaattttctattcacggtttttcttgtttttggacttgagattaagcataattattttgtatctaacaggtgtccagcagacattagttaaataaatatatataagtcttgagctgaggctcagatatgcttatatttagaattaaattagataattcctcatctcactgctcttctgttgctatctatgatcacattctttgatttgcatggagtctaagaataccatgaggacaaactcatgttgtctacaagagtgattcagacatgtctgatggagtgtgcaagggggatgagcatatggaagcatttttaaaagggaaggattccagggtctttgaaagaacagaagtcactttaggtgaggaaggagtctgattgattggaactgaggtgaaaggagctgggctttacatactgaagtacacctgttcatttacacacacctttgttcagtaaatatttattgaatgcttattttggtccttgaggaggaaagggttgtatagtacaattgaaagaactgtattgcttagggatccaaacagcactactctagtctgttctccttctgccacccaacaaagagtgggacacgtgagaggaaggcatttctcaactagctgaagagagaaggagtcccaaagatccattggcagaggaatggtattcaggagctcggagtggtggtaacagatgccctaagagcagatgccctaaggagcactggaattcaagagcaggttggcatcactgtgctggtggctaaataaggtgtcgttgcattgacagagatgtcctggaagtggtgatagcgttgtagatagtggcagcaagagaaagcagatgcctcatggaagattaaaacacaagaggctatctatatgttggtcagcccaagcagaacagcagagtatggaccattgaaggaagtgtcagcatgtggagctgacagcatgtcactgtgacttgtggctgagagaggtggtaagagcaagcagccagataagaagggcaggaggtggcatggcttttatgtgaactggtgggacattctcccttgccctgaggattccctgagacataggattgagaaggacagaaaccctttcatagtgagggctaattttctttcttttgtttttcttttgagacagtttctctctgttgcctaggctggagtgcagtggcacgatcttggctcgctgcaacctccacctcctgggttcaagagattctcatgcctgagcctcctgagtagctgggactacatgtgtgctaccacgcatggctaatttttgtaattttagtagagacaggcttgtgccatgttggcctggctggtcttgaacacctgacctcaagtgatccacccacctcggcctcccaaagagctgggattataggtgtgagccaccgtgcccggcctaagggtttttttttttttttttttgtatttttagtagagatgaaactattttctcatagtatatttagggcctttcattagctcttgaagagcacgaatacagcttgagttaactttttccatatgggttttagaagtgctttattaacttctagggaaaggttttggcagtgataacatagtcttatgccatcttttcgtttgatttttcttgatttgcttattgaaagatagggagcatgaatgtgtgtgagagagtgaaatgagatagtgatgtcaagctagagaggagagagaggagcagaatagagaagacgagagtaatagagcacatgtgtggaaggtctgagaggaagcagacaattgagacagatggacagagggtaggacagagtttaatgagttgtcattcaaaaaatttttttttgtagagatgggggcatctcactatgttgaccacgctggtcttgaactcctggcctcaagtgctcctcctgcctcagcctcccagaatgctgggattacaggcaagagctgccatgccccactcaaaccttaacaagttgtaaagctgtagagctcagcttggtgtagtggagagaatagtgacttttcactaaggagacctaggtgtaagttcagacttctttatcaactagttctatgatgttgaataaattgtatcacgtctttgagcctcagtttgtaaaggtccttttcatctttacagtctctgagctagttacagggtcaaagtagaatccaaattcaggagtagatactgggagtaaatcgcctggtatgtggtaacttcttgtttactgtgggtgtcaaaatcaagctgtaagtcacctctgaatatggcttgctttgattttacaagttttactattgtcctcaatatgctgattaggagctcctaatgcacagtacttctggggtgaattgggatatggaattcaatgtgaatttctcattaactgttttttagaaagctgattcttccacttgggatatttctacttcagttttcttgacaaatttagtgtcctcatgcttgtatttcctttattaaatttgtgcaacctttctttaatgactgttgtaactgtgagacttaaaaagtcatctgtctataaaggtatcattctatgtcagtggttgtgggagagtttagaggataaacttaatagtttcatttaagtgaataaaacattttttagttactacttaaagaattcttgaaattgatttttgagagaagatgttcagctcttcgtagttcaattttcattttgaatatctaatagatcaaaatgtgctatgtaaaataatgttaaggaaaaactacctgtgattggttgactctgtaatctttgtactagaaacaaagatgcctgcctatttcatgttgaaaaataattcaagaattttagtttatgacactaagagagaggtatctgacaactgatttaagcttgagaaatattttcccaggtcacatgttttagatgagtgataaggcatcataattcatgggatttaagcattggtacagattatgaaattaggtaatctttgttcaagcattgtaaatccagctacacaaattatgcttatgagttcttctccattgtcctcactgccccagctccaagaaaaagaatcttaatttacactgttttgtgagtgatttggaggatataagccccattttaatttgtctttttatgtctgtctcagtcttgtttgaccaacagctttgaaatgtagcagaaaagtatattttaacaaatgatagccctattaaaagtgggctttgtgaagaaatggtgtggagctagctgtgggattacaaatcagatagatgtgtctcaggtggcgggcgcagcagctgctttttaaaccttgtaatgcttgttttattttatgaaaatgtatttgaaccaccaaagtggattgaaatgaaagtgtgaagtgctaaatgcagctgctaagactaggatatggcttgttgttcccctgagagctcttgttggttattttctgtgttttattttatttttttcaattgaagcctctgttctgacgaacaaaaactgctcttacagcctaataactgattttgcctcatttttcattagctcattaatggaagaacaggtcagattgattatctgactgaagctcaagttagctgctgttgcttaagtccacatcttcagtacattgcatttggagatgaaaatggagccattgaggtattcagtgctagtcttcagaatctttctgtacagaattaaataaaactaattatatgtctggcattgtgcacttctatttttatttatttttatttttgaaatggggtcttgctgtgtcacccacgctgagtacagtgacacgatcacagccgactgcagccttgaccttctgagctcaagtgattttcccacttaagcctcctgagtagctgggactaaaggtgtacgtcaccatgcccgactaattttttttttttgtagagatggggtcccctgtgttgcccaggctggtctcaaactcctgggtttaagcgattgtccggcctcagcctcccaaagtgtggggattataggcatgggagcttttgtgcctggctattgtataccttttttttttgaatcaggatctcaccttgttgcacaggctggagtgcagtggtacaatcttggctcactgcagcctttgcctcccaggctcaagcaatcctcccaccacagcctgctgagtaactgggacttcaggtatgcaccaccacacctagctaatttttctgtttttgtagagatggaggtttcaccagtgttgcccaggctggccttaaactcttgggctcaagtgatctacccatcttggcctcccagagtgttgggattacaggcatgagccaccacatccagcctattgtacacttttatactaaataaatctttctgtgatctattagtcattgttcgttaaactaacaatcatcttatccagttggctgtatatttttcagatttcctttattactgtttctcatgctttttgtctttttatgtcccttattctctacttagttgtttggctgttctccacatatatcaaatactatctatcaagatttcgctaactatgcaaagagcatttttttctcctcttcttagaagcccagccatgtggggtataagttgtttccatttcggtactgataaggctcatggggaatatgggtgcagggctgcctgtgcttgcctgttccaccaatccttgctgttctacttttggtggcagaagaacctcagttcaccacctgaaatccttaatttatctaacaagaccaaataggtaaaaatagaaacactttgcaaggcaaaaatgtagtataataaaaggcattttgggtaaaaatattgttgtctttatcacaagtgaaattcatcccaaaagcacattttctctagctttatagtggtttttcaaaaaccttggttccttctctcactttttctcaccaggtgtctgggaattattttttaaccaattacttatggcactggccacagttattttactttggattcattttcataaggaattacacaaatattctctagtccatatggccccacagagaagagactatatgcttagacacaaagtgaagaaggaagcatttacacagtgatctcaatactcttatatatttgtcatggcccttatgtcatggattgagagttcaggctttgttttctctttattattgtgaaaaatttatttatcatttgttaagatgtgtactattctgggataaagtacatcatggatatgtatttcttaagcaagggataattgtatgtttacaggtgaaccttaggcttccatctcaggctcatctctcaaactgttgtgtattattatttattcttaaagagtccttggtttcccttttctctttaccttgatgccaagtcagtaccacattcttttcatttttaccatctatcttaaaataagtcttttagatagtttaaaaataaactcacaacacacatatgtgcttcatccacatcgttagttccctcaaagtcatcaaataatataaataatacataatgaaccatgtgaaattaccagcatttacctataaagtggcagtttcatatggtgtagcctcatatcatcaaataatagcaactaccatttattaactgtttactgtgccagatgctctcattgaattcttataacatcctggatgttcgatgttgttattcttgttttaaagatgtctaaactcttatttccacaattttcataaaatcagtaagtggcagagctaggattcaaacccagatctctgaggctgtgtgctcaactgttatgctatcctgcccttgcctcagggtttgtgagatcgttcatcccgctcatttaggaaggtttccattcacacaattcccctttgttttcaaggggcttttcttccagacgtgggttaggtttgagtttctggtgtctcctgctttagcatcatctgtattttccttaggctttcttgagtacattttaatttggtcaatgaaacatatttcctctctttttgtttttttggtatgagttcatttgaaagcctttttttttctttttttttttttgacatagtcattatcttttgaatttgttactacttttatttagagtattattagtctttggccctcttaagtattctcattgcactgcccaccagccttctgatatcctgtctccctcatcatcttttatctttccttgtttgtgttgttttatgaataatttgccttctcatccaggacttacttactttcttctctcttatccatcttaaatgtctttttttttttttttggagggcaagcccagacagccacttgtttgatgaagtgggtagttgagtactcagaaggaccactggttcctactgctgtctgatgattgcagtgagtgttttattttagggtccaatatgtttgcatgtaggcatacatggtgtgcatatatatatatatatatatatatatatatatatatatatatatatgacattcatttgtttttaattaggctggaagcaccagatggaaattctgtaccctccagtctaattttagtttaatatctttggggtgtaatgcctatgtattgcttagtttcttcttaattttctgtgtttttctgctttgaagattttagaacttgtaaacaatagaatcttccagtccaggtttcagcacaagaaaactgtatggcacatccagttcacagccgatgagaagactcttatttcaagttctgatgatgctgaaattcaggtgagagggaggatgaactcttaacatatttaatgctgattctagcaaaggaacactatgattatgcctaaaatctggtgtatattttaaacacattacgttgggcatacattcagattatgtacatgggcttagatgaaacctatgggtgtttcatatttttctgtgggtgaggcagacagtttatcttagaatcctctgttggaaggttgtttattttgaaaatgaagggtttgtttgcattttcttgcctgtcttggtatttggatttgtatcagtaagtatactttttgccacatttatgtaatttctctttatttttctttacagtagtaaaatccaatggaaatcatttcattctttccttttaagaacaaaatgtttattacaggaatgaaattctgtgaaaagagaatggtttgacataataaagaattgtggatatggaggcctaaacttactatatattcttttaaaatttacttgattattaaagtcccaatgcacattcttttaaaattcaaatagtattacaagacttattatgaaaaacagaccctttcccccatttctcgttctccagaggcaccacttttagcttttagatgattcttttgatattaccttcatgcctctatatggcatgcttatagtgctcttcttgattttcccatttgagaagttatctaccgaattccctacaggaagatgttgcttttttccgccttccacctgtcctgccttcagcttatgtgcatgcacacgttcacagacactcatttatcaatccatttatcccaattataacgaaattttgtttagatccttcctgttactatgatcactgtgtactaagggtactgtgaatgcattttttgccttaacgcaatttaggaaaatttgacctttgggtgtagttggaaattattttacactaaaactttgaagacattgctccattttcttccaagttccaaagttcacgttgaaaagtctgaagccattttgctgcctaatctttctctctggaagattttaggatcttcattttatccccagaatcttgaaatttcctgatgatacactgtgttgttagtttttattcattgttttggatattcagtcttccttttcaatttggaaacctatgatttttaattcatggaagttgaattatttctttgattctttcctttttgttccagtttgctttctctttttgtaacacccattattcagatgttagatctcccggactgataatctagttttctttttccacatttcatctttctatagtgtgctttatgtttttttctttatttttttttgagatggagtctcactctgtcacccaggctggagtgcagtggcgcgatcttggctcactgtaacctctgcctcctgggttcaggcaattctcctggctcagcctcctgagtagctgggattacagccgtatgccaccatgccaagctaattttttgtattttttttagtagagatgagattccaccatgctggccaggctggtcttgaactcctgaccttgtgatccgcccgcctcggcctcccaaagtgctgggattacaggcatgagcccccgcacctggcctactgtgctctatttttggggagttttcctcagttttgccttccagccattttattgagtttttcatttctactagtatatttctaatgtgttaaattcttattttgtagatagaatattttatctctctgaggagatatacacacagacaggtaaatatatataatatatatatagaaattatatacacacacacacacatataatttttttttgtttttttttgagacggagtttcactcttgttgcctaggctggagtgcaatggtgcgaccttggcttgctgcaacctccgcctcctgggttcaagcgattctcctgcctcagcctcctgagtatctgggattgcaggcatgcacaaccacaccctgctaatttttgtatatttagtagagatggggtttcttcatgttggtcaggctggtcttgaactctggacctcaggtgatccacccaccttggcctcccaatgtgctgggattacaggcatgagccactgtgcctggcttatatatataattttttccccataaatttttgttttgctgcatagttgctgttccctccaagttgcttttttctgtttggttgttttgacctcctattttgaaggcctccttagctctcagtggtcattggctatcagagatctgtactgaacaactggctgaaagctctgtgtgttgactgagatcttctctaaaaggtgaatctgaaaggggaaactttgttgtgagtatcttcaggtcttttgtcttggtctcctcagattcctagagaggaattttctggtcttttgcctggaggataaacctggctggcaggttctcagagctaagttggggaagataacaggaagtattaatagatgttggatctcaacatttagtatgtacaccttcccttgatccctcattctcagaattgtaattctaccctcagttgtgctggtgcccttaaattcagagattcttctttctagtttgctgtcactgtctgtctactttcttcctttttttcccatagtaactttgggattcaacagcaattcttttcttttctttttctttcttttttttctttttgagacagtcttgctctattgcctaggccggagtgcagtggtgcaatctcggctcactgaaacctccacctccgaggttcaagtgattcttctgcttcagcctcctgagtagctgggattacaggcacctgccatcacatgcagctaatttttttgtatttttagtagagacaaggtttcacgatgttggccaggctggtcttgaactcctgatctcaagtgatctcaccttggcctcccaaagtgctgggattacaggtgtgagccaccgtgcccggccttcttttttatgtaaaatcaagtttcctaaactccttggaggagtggggaagtccagcatttctagcttcacagctctgcagctcgttctcttattttcacgaggcattaaaaatatggccttactgggcgcagcggctcacacctttaatcccagcactttgggagtctgaggtgggaggattgcttgaggcaggagttagagaccagcctgggcaacatagcgagaccccatctctgcaaaacaaaataatttagccaggtgtggtagtgcatgcctataatcccagctactcaggaggctgaggttggaggatcgcttgagcctaggaggtccaggctggagtgagctatgatcatgctaccgcactccagcctgggcaacagagcaagtccccatctcaaatatataatggccttgttcttaggagatctctttgccccatctccttccctctcagttatttcgaccttctctttcctttgatgcccttatcctcgttctactccattggattctattccctgtggtttctcctcactgtagggttgttctggttaattttgagagctcacaaggctcacactgctccagtccttccagactgtacctcacactcagtgtctcctgctcttctctagttgttccattgcacttttcggtgaacactgtgtggctatcttaggattctctgcctcctaattcttaatacttatattcttagccccaccctcatttcctcctttgggtatacttagtgccttccatttttgagcattttgggagttcataatgccgattttgttgctttagactttttcttttcttttcttttttttgagacagtcttgctctgttgccaggctggagtgcagtggcatgatcttggctcactgcagcctccgcctcctgggttcaagcaattcccctgcctcagcctcctgagtagctgggactacaggcccgtgccaccatttccggctaatttttttttttttttttagtagagttggggtttcaccatgttggccaggatggtctcgatctcttgaccttgtgatcctcccgcctcagcctcccaaagtgctgggattacaagcgtaagccaccacgcctggccacttttgactttttataatgcctttaggattctgttttcttgactttgctgagtcagttaccattctcttgctttccagcctcccacattttgttgctgttatctcctttctcattcttttgatcttgccattttagtagggctttagaagtgaaggatagaatgcatatgttcagtggaaattattatattcttttatttagtatatatattaattgtggtggcaatatttaattgtattgttaaaaacccttttgggaaaaagatcttttaatgttatgtctgtgtgagtcctaggaagcagtatgattgcaatgaaatttggctttagtacagaaacttacttgttataggctcccatgacactggtgttctagctgtaaaactcagtgtaatagtcacctttcttcctctccagatgtctttggaatgggtaaaactaaaaactacatctgatgaagttcttttgagacattgtatactatgtattctatcaaaagttaaattcataaggtttttatgaccagcttgacgatttcaggtattctcagctagggggaagaataatttctagagatatttttagaaaaggagttagattatatttagaaatatgagttaagtagttgtgtttcttcctctttttctgttctactcagaatactttttacatttacagtgttttaaatgtaacaaaactctatagatattttcgagaaatgactggttgggttttgttttcattttttaaggtttttgtaaatgattaagtggaggtttgttttaattatctttgtatccccaaagcctggaatccagtaagggttctgtaaatctttgctgagctgaagttattgccaaaatttgaagaatcagctcacctgattatagcccttaggattgtgaacattgaggtctactttggtagtttttgatcctttaccttgaagtaaataaaggccaagtattacccatgcttacatgagccagtatataggactatgttagttcttgctggtatgaaaagtttccagccgggtgcggtggctcacgcctgtaatcccggcactttgggaggccgaggcgggcggatcacgaggtcaggagatcgagaccatcctggctaacacggtgaaaccccatctctactaaaaaatacaaaaaaattagccaggcgtggtgacaggcacctgtagtcccagctactcaggaggctgaggcaggagaatggcatgaatctgggaggcgaagcttgcagtgagctgagatcccgccactacactccagcctgggcgacagagcaagactctgtctcaaaaaaaaagaaaaaaaaaatttccttaacatttctacaatttaaattttattcatatagctgaaaaaaattctacaagtatatatacattgcaaaaatagtcaatgatagagacatccccaaactcaacttttgcatttgactaatggtggtggaagtttagtgatattaaggttattcaattagcacagtgtgtttccgtgcaacaacaacaacaacaacaaatcactcatcatcattgcctagtcagaaaccttctgtaacaaaagctgcaaaggctattcttaatctgccctcagtggttgtcaaattctttgttatatctgctccagaaggctgtctgagttcttgatgcagagggcagaagtaagatactaagttagaaatgaacattgaatcaggcaaagctagaataggcagtgtctgtaaactaggaggagctgttcagcatagccattgatcctccagtccagtgaagcccagaaagcgggaggagagagccaggagtttcctagtagaaatggaataaggtcttttatgcttagtcatatggggtgcccttcctctctggtatgatttgggaagccagaaatgcctccatttcttccccttcccccagcatatctcattgggttcttaaaatatgaaaattactaattcattctctttagaattactctcacttccagttcgtcttctaaagttctcttgcttgcatacaagaccccatgctcctgatatcctgcttctgtgaatgagcattctgaggcagaagatgagagatctgaaagccagggcttgttggggaggacgactgctaaatgtggtggaaaaagaagtaaaaaaaaggggaataagagatgtcatttattttaagattttgcctaggtctgattaaagatatttctgctgtttaacattggccaataaaaagctagactcagaatgttactcatgtgcatacctgtagttgtggctgctttttctttatctttttattcttttggagctggcctgttttcccatacctcagaattttagcttcatcaggcccacggggctgtttctttggataccttcccaaccttttttctcttctgtttcttctgcgtctcctatgctctagtcagatggactcatgagcaggtcccttttcacgtttccctgctcctatactttaactccaacatttattccctttgaagaacccttctcagtttgtgaatcacactttaaacccattcctcaagcctactttgaatgtgctatctccaaattttctctaaggaattactttttttgagtttcacagaacttttatctctatcattgtatcttctattgtaggactttttgggtttgttgttgtatttctcattttctttgctaaactcttaagtttctttatgctagatccttgtttgattcctatttgccttgcatataggtactaaatagacatttattaaataagttaatttgaagtcaagtattaataaagctctaaatacagttgcttttagtaattaagaaatgtcctttacatagacatagcataaaaataaacttctgtgtacctctgtgtctcagatacgtttgtatgcatattttgtgctagttactcatgttatttcattccccccacccctttccttatgtctgaggagctcctcctgaagctccacatgaaaaacaatgccttctcacttccgtcattttgaggattgcgatgggggatagctgagatatttgaagcttgggaactcttgtgttttggtttgaagctgctttgatcaactggccttcccaggccagcttcagtggggccaggatctgtagacttccccagcttgtaggttcagaaatctgtgactatgtaattaggataattttctcaggaaaatttaatcagatggtgagctcactggcatattgtgtgtttttttttttctatcttctggtataattaactgttctccaagcaactgaagaaaacaaattttatttaggaggaaaagtattttattttgcccctagtcaatttacataaccgcagcttctgtctgtaaaatgtggacaccacagtcttctctcttattcctctctgttttactgaaatgccatgtgagtaaaagactttagacaagagaatgtacactctctccacccctccaatgagataggatcgggggaggattataacagacttatttctttgatattcaggtatggaattggcaattggacaaatgtatctttctacgaggccatcaggaaacagtgaaagactttagactcttgaaaaattcaagactgctttcttggtcatttgatggaacagtgaaggtaatttaaagtataaatttgttttttgaaaaagtattctcatattgcaatgattatattgagacagtcaaaagccactgtgaggctaattacttacttaaaaatttttaatttttctcatgcttgttttctgttaattgcagtcacctacatctgctgtgtttaatgagcatttatactgttagtcacatttaaagtaaaggggtcagaacagccagtgtattaaaactcttgttttatagacctgtcttgtagctgattatgctttttaatataaaatgttcttaaaagtgtcaacctccaagtgttttttttttttttttaaggtatggaatattattactggaaataaagaaaaagactttgtctgtcaccagggtacagtactttcttgtgacatttctcacgatgctaccaagttttcatctacctctgctgacaagactgcaaaggtaggtcaatcaattgaaaccatgcataaaactttggtagtggttatgtataatgagttcaaataatatatgcaaaaggacataacagttgctctctacatgtctgtttcatattttgtgatcttttggaggatgcccattggcatttagttggtatcaaatgaatgaaatgaaatacattgaggacttctgatttctcccttatggattactttttgtctataactaatcaaatgcaacctctactgcatattgtaggcaataaaaatcattgaaaagcatttacatttaattatacactgacaatacaattttaatataattaatgtaatataattgacgtgtgtctaaaatcacattctggtgaatgatgctgcttggtgggggacctcaagtactctcttctctccttttttctccttctaccagtctttccaaactataaaccttggaattgtcagggctgtatcctgtcttttgtgctctgttgatgactctttagtgcatcttagagttatcttctcctctttgtcaccaccctgaagagcatgctttcctcctcctccactggtgaactgtcccagcatcctgcctctggtctgcacctcttccactttatcttccataccactgcctgtgtcccttgttgaaacacctattacctaacggtttataggccaaccacttagctcctcaccatctttttctgctatattgtttcctctgtgccagcctactttccaacttcatctttttgtgcatgctgctaactttggtttgataaaccttctactcttttaccttgaagcattatgactcatctttctagacctagatttgatggcagctcttctgaagcgtttcctgaccctcaagcaaggttagctgctctacctccagtgtttctattacattttattcatttgttagaacatttacttcatacaactgttcactaactgttcgtgagcctgtctttgtgattaaactataaacttttcaaggatagtgactgtagctagtttatcttcttgtaccactagttcttagctcacagcgcttggaacttggtagttttcagtatgtggttgctaaatgatgttgacaaaaccatgagacaatattgaaagaaaaaaaaaatagcatttggctgccaagaagtaggctagtatagtgactaacatttaaagattacttgtcacatgctagtaatttcactctctataatctcatttaatcttcacatcataggtacaattgtcctcattttacagatgccgtgtctgaagctatagaagcttatatgagttgtcctagtcacaagaatctagtgaacagtggagctagcactcacattcaggtctgcttcactccacagactgctcttagctgattcagtgttcttctgtctaggtctaaattaaggaaggagtgacattgatccttgagctgaatttaacttgagtaaataaagggaaactcagaaaaattaacaaggttgcatgctggaacttgggcatctcatgacagtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcagaatttgaggaaaataattttgtaaattatggtctggattataaatgaattgcaaattctgctttttctgtgctgaaagaaaagatctctttagcactatacccatttgatagccatttccagtgtggtttgttgcagtcctctgtggactgcctgcctgttaaacagtgcagaggttcacatttccgtcattgtggggcagcgaagggctcctaattgagtcacagtctgcatgctaggccagtttttattaccctgcagtgcttaagatatacatacaaaccatgccaattttatttagaaaacaatctattttttttagatatataattttgacttttagaaaacaatctttttaggaggcttagaatgttgttctctgtgtctgtggaaatatagtaccatatggaaagaattgcatgctgaaagattagaaattatggaaaaggagtcagttgacctagttgtgtcagaagaattggggagccgattggaaaagtttgggtattgggatgactactttggtaaccagtgtagatgaggaagatggggttttccccctttcattacaaaggaggatctaaaactccaggaacaggtatatagtgcagaagactaggagagtatacagtttgcaggaacagaggtgttatcagatgggctttccagggaaattaagattcttcttcttgaggactaagtaaccaaccttctctctaccagtcacataaatgtgtgtcagctgaagtggcagggctgctttggaaatgttcattttgctctgagttcgcgtctttggatgaaagtgctcctttcccagttatgaggcggtgtttcatttttcaaccactgcaggaaaaagttgtctccattaaaattgtgttattttaaaaatttttgttggtacattaaaaaaatttttttctccctgattattcagaatataggaaagttactgatttttgtttgtatatgtactaccttactgaactgtttctaatgagtttttccattcggttctcttggattttctagggagagatttacaaatgattgtttaattttcttttaccatttatgcctctgtttctttttcttattctggtgtacctttatttgaaaaattagagcactgcttatatattaaatgccactggaaataaatggcaatattagtatctgtgttagggttgtttataataaagtctagtaaaataattttagaatacatatatatggacatatatatgttttaaaaccagagaagcttctggataactctgttaatgaattgtgtatcatgtttatgtagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaaggtaagagttccccaagaactgtgaaagaaaataatagcctatatcatactttccaagctattttcacttcctgtttctcagttgggccttttacaacccagcagagtaaaaaggctgctactccggaggctaaggtgggaggatcgctggagtctgtgaggtcaaggctgctttgagccatgcttgcgccacttcactccaccctgggtgacagagcgacatcctgtctcaaaaaaaaaaaaaaaaatctggcagtaaaatgagtttagtaactaaagaaaagaacagaaaaaaatattgaaaacaaaaaagaaccagaaaaaactttaaaaaataattaaaagccaggcacggtggctcacgcctgtaatcctagcactttgggaggccaaggtgggcggatcacctgaggtcaggagtttgagaccagcctggccaacatggcgaaaccctatctctactaaaaatacaaaaaatagccgggcgtggtggcatatgcctgtaatcccagctacttgggaggctgaggcaggagaatcgcttgaacccgggaggtgaaggttgcagtgagccgagatcacaccattgcactgcagcctaggcaacaagagcaaaactctgtctcaaaaaagaaaataaataaataaataaataaattaattaattaattaaaaaaataaataaaaaggaaaagaaaaaaaaaggcagttactattatccccattttgtagtgatgaaactgagatccacaagactgctttcctcagatcttggggaagctttggtgacagtggcagggatgccctcaatccagagctgtcatactgcctcatactaaacttggggcattagaatgactagcaagttgggtgtttaacttagttctgttttccatgtcattcacaattaactatgttggttgaaaatctttaaaaaaacatatttttgaaatttcttcagtaataataatagcagcagtatatggctttatagtttacaaaacgcttcactcccctcatcttactagccagctttttgaggcttaaatttcattcttggtttacagatgaggaaaatgattttctatggaggttataactttcctaaagttacataattagtgccgggtgtggtgactcacacctgtaatcccagcactttgggaggccaaggcgggcagatcacttgaggtcagaagttgaagaccagcctggccaacatggcaaaaccccatctctgctaaaaaatacaaaaattagctgggttttgtggcgggcacctgtagtcccagctacttgggaggctgagaggtgagactcacttgaaccccgggggagcagaagttgcagtcagctaaggtcacaccactgtactccagcctgggcaacagagcgagactatctcaaaaacaaacaaacaaaaaaaccaaaaataaagttacataattagtaaatagaaaagccaggactcaaacccaggtctctgcctctgctttctctagctaattggctttttaaaacttactagtgattgaggccgcaatttgaatgtgttgtggtgcttcagggtcatatttttggtgtttttttgatgtatcttttatctatccactcaaaaagactgtgttgaatgtccagtgtgtgctaagctactgctctgtggcacaatgtttatggcttggttcctgcctttcagcagcttacagtctatgggggaagcaggtggtaaaccaataaagtccctaaagtttagaaggggtctgggacatgctttcatgagggaggtggaagcacaaaggagaggagtgaccagaccaacctcagagagttagcagaggcttcacctggaggggaatgcttgaagtgagtcttttgaatagcagtttacttgtaaaagtggtagaagatgatactctatatcagcggtccccagcctttttggcactagggactggtttccttggaagacaatttttccacagatggggtggtggtaggaagtggggagcggggaatggtttcaggattaaactgttccacctcagatcatcagcattagattctcgtaaggagtgcacaagctagatccctcgcatgtgcagttcacagcagggctcttgctcctgtgagaaactaatgccaccactgatctctcaggagacaaagctcaggtggtaatgttcactcaccagccgctcaccttctgctctgcggatgggttcctaaaaggccacagaccagtaccggtccatggcccagggactggggactcctctatattgggctgatcacttggacattctgaaagctttttcattcaaaattgattcctaataagatcttatgatactgttatttcttactgaaaacattcaagtgtaggagatgattctcattaattgtctaaggcaggataagtgtttggaaatatttgaatgactggtgttttggttacatgagacccacacagctgcaattttaccaccataagaatctagcttataaaaaagataaattagaggacagtttttagctttatgaaaggatgtactaaggggtacaaaaatacagataaacaaaaggagtaatttctagtatttgataatacagtagggaaattatagttaacaatttattgtatatttcaaaatagctagaagaattataatgttcccaacacaaagaaaagataaatatttgaggtggatatcccaattatcctaatttgatcattacacattgtatcacatgtacccccaaaatatgtacaacttaattatcaataaaaatttttttaaaaaagaaaggatgtatgttatccctttacaaggtttcattgaaaacacaattctgtttacaaaatgttgcattaacctacatctttattcagttattaggagatcctgagaaatgaccaccaattgttctcctttagtgtaaagataaactagaactcagtctgctctggggatgatgcttagaggagagtcattgctgtctgtgttggaagctggggagtcttcggctatattagctgctgacaaatttaactgctcagctttgacaccaagtttctagagaccacatcatttgattctctggcctccacagaattccatcacataattgagagtctggtttataagatgttacaaagatcagtgaccatatttgcagagttcttggggaaccttgaaataaagcagcagaataggtttacatagtatagatgttatgtctgaagggtgaaagaacttctagcctatgtatttagtttgtatatttaaatgacaatcaggctgcctttgccttctggtttgattactagcttattcaactgattatgatatagcccagcctgcatctacccagcatgttaatgagactatccaaaagcacagagcaaattaaaagtaaaaaggaacagctgctgtagtgtccaagaaaataggccttttgagcctgtttactttagaatccaagctgtataaattgagtgccagtaagataaagtaggtatccagaagcttaaaaagttcttaacttccaaattattcctatttataagtgaaaaaataatttagctgtttacctgcattatgccacagagtacatactgaatgacaagaaattcacattaattcatgtgcatgaagggaaagctgatctgaagtatggaatacatggtgataaatggtggtgtgccatgacttggtggcagcagagtgtaatggtcaggagagtgggcttttggccttgagataggctgcctgagttcaaagcctgcctctgccactcattagctttgtgaccttgcacaagattgtttaacttctgtgccttgattttcttatctgtaaattgatgtaatgataatacctaactcatttcacagatttcccatatacccctttcccccacaaacacatagcctcttccattatgaacatccccccaccagagatgtgcatttgttacaattgatggatccacattgacacatcattatcacccacagtccgtaattagggtttgttcttggtgctgtacatttttcgggtagttgaactaagtgatctctaagagccttagtgactgaaaacaaatgaatctcaggttggtggaatgtgcttgattacactgttattttacaaagcaaacttgtgagttctggaaaatcccaagttagtgcatgctggttcagtgaggtttaccaaagtccattgggtatacttttagcagttactattactaatagtgaacatgcttacttgacccactcacatgggaaagacaaaatgctaggtactgccataggcacaaaggtgggtgacactattactgtgttcataatactcaggatcatggtgagcttgaggccttttcagaataagtttacatgtattgtctcttgcccccattttagctgtgagattcatgggtaaactttatgattcccatttgttaaatgaatataaatattataagcaaattcagtgattgggaaggaaaggaaggacttggctacagcccttgctacgtttgagatgttcagtatttgtttagtaaataaataatatagattattttataaagaaacttggtcaagggctcttgcatcacacctggggaaagggaagattcagtagagagaacattgtttcctgtagcccatattatgaatagtttgggtctctgtcagaataccagtctgtgtctgcaaaggggcatttgagtgaagagagggggaatcttctgcccattctcccgagaaggacatgcagacaagagagttgagtctggccactgctgtaatggactctatagcttcctgtctgcagctctcaagcaggctgcatgtttctccagcacaactcaacggttggagttgggtgtaggcggagcagtgaggccatcaccagtgttcatcaggaagaggctgaccaggttgaatagtatattcagcattaaatccgagacattttcctcctgtttgcttgagttcggttggggggaggagatagggtaaaggatctgctggcactataaattgtcacacagtgtaattaccaatctaatgagaattttatttttctctgaacagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaattcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctc

SEQ ID NO: 11902 - DNA, 17930 bp, Human
tccatgagtcgtttgagttttaaaactgtctttttgtttgtttttgaacaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaagaaactgaatctgctaattaaaaaaaatatatttcattttatacattttagtgggcaaattatgtgtattcataagttttggtctaaaattaattttaggtaacagtgatgatgtcaaatgcttttgctgtgatggtggactcaggtgttgggaatctggagatgatccatgggttcaacatgccaagtggtttccaaggtaattgttttgaaattctctttgcaaattcttgtgattatcatgagattgcttatatgtgttcacctgaaatcagttgttactttactctgttccaaatatatatttgtgaataagtttaggatggattacttagtaaaatacttacttaaaaagtttcgatggacttaagacaacgaagaaatagatttggggatttttgtttaatttttaaagaaatatatatatatttaaataatacatgctcattataaaaacaaagtcacacattgtagaaaagcacagagaaggaaaattaaaatgtccagaaatcttaccgcctaaggatgagcatggttaccactttagtgaacatccctccagacatatagaaataaatgtatatgatacatatacatatagaaataaatacatatacatatagaaataaatgtacaccattttacataagttaaatattatatctagttttgaagttttttcagtcaacatttgtcttggatatatttccattcattcggtattcaataataattgatcacctattggcaggcattgttctgggtgcataaaatcagttgaacaaaacaaagacccctggtctcctaagtttttattatagcacgagagaacagacaactaataaaaacttgaataagttctatagcatgttggaaaataagtacaatcaataaaaagaacaaagaggagtttagaaatgccaggcaggttacaatattaaattgggtggtcagggtaagtatagactcatctcatctgttttagtcgccacgcagcattttaatgtgatgtgttacccttttgattgtttaactggccacctagtgttctagttaatcctgattagcttgcaagtgtgggtttttatcacgtgggtaagaaacttaatgtactaactaaaatatcagcttcaaaaagttttttacactctcctttttcatctaaatcatgtggcctacaattacattttttcatggtcaaaacttttgctattattcaacccgtttcccatttgccctgagaatactgcactggcaacaagctgcactgttttttttctaaatgggaaatgggttaatatcgattaataaatgtggcatcttaacttattttgattactttttttcctcttttcttttgagatggagcctggctctgttgcccagattggagtgcgatggtgtgatgtcagctcactgcaacctccgcctcttgggttcaggcaattctcatgcctcgagcctcgctagtagctgggattacaggtgcacgctagcatgcccagctaatttttgtatttttgtagagacagggtttcaccatgttgtccaggctggtctcaaactcctgacctcaggactttgaggtgcttgcccggccaacatcagtgtgttttaagaatcttagaagagttgaagagagtagctaagagctctgaggagagatggtcttacttgacctcagtagactgaggggctcctgacccttgtccacttgagccttggtagataactagtaatcaccttcctcttgcttatatcaacctgcctttcactgcaatatctctgaccattccctatatgctaaatgaatagtaaattgattatatgtacatttatactcatttgaaatatttatacttcacaatatattaagagtaaattgattatatgtatgtttatactcacttgaaatagccagtctacaaatggctggattagtcctgcccaaattaagataaacctttagaacttttcaaaattagctgaagtggtcgggtgcagtggctcatgcctgtaatcgcagcactttgggaggctgaggcaggaggatcacttgaggtcaggagttcgagaccagtatggcaacatggtaaagccccatctccactaaaaatgcaaaaattagccggccatggtggcaggcacctgcaagctcagctactcgggaggctgaggcaccagaatcacttgaacctgggaggcagaggttacagtgaactgagatcatcccactgccctccagcctgggtgacagagcgagactctgtctaaaaaaaaaaaaattagcagaagcataatgtatcttggcaaatataaaaatattaattttgtaaaacattcaacctgtatgaaaaatgttgactgtcatgagaagcatcttacaaaacaattaaaaattcacacaaaaaatttgaatcctgtcataggataactatgggttagttttagaaaaaaagttttttttttaaaagcaatacaatagaatcagttcccagtgggctaggatgtatttattcttctaacattaagtttagaataaatgatcttaaatgattctgtgatttgaggcaaacaaccagatttgaaatggaataaacacctagagatgagaaatttatgttattacattttcatttcacttgtataaataatccctcaaattttattttctttacattttaggtgtgagtacttgataagaattaaaggacaggagttcatccgtcaagttcaagccagttaccctcatctacttgaacaggtagggcaagttctttttttaaatattggttgccatcagagaaattgctttctgataattacagagagtgctatttgagtgaaaagacaagagttgttttagaaatacattttctttttcttatcaaacctgacatgattttagaaagtattattctttggagaaaaatagatccataaatggtagtctcctgataatgacacttgtgatgtttttcaaacaagttgcaataaatcaaacttcgagaaaaaatgactgggatagtagtatttaacagtttcactatataaattttccttcaaaagatctgagaaagagaattttattgctttttctaaccttgagaaagcaaataacttacataatagtttgatggtcaaacccatcctagccatgagcaatgaaactgatacagggtccaacttatcccaaaggatgacccagggtaggtaagacctgtggatgaaaggaaaattgattgtcacatggattatggaaaagatatagtccgtttcctgccttaatgaaaatgggttttgttattatatacacacactgaaactctattagtttatggcctagggaataactatcaaatataaatgaaatattgcttttggttaaaaaattattttgccagtaagcaagtggtttgcaacaagttgaataaaatatgtctgttgggtcattttcattgcaatgggtaagataagatttctattttaatttatatatatatatatatatatattttttttttctgcagctgctatccacatcagacagcccaggagatgaaaatgcagagtcatcaagtaagtacaatggataataatgaatgcatttaaatagagtcatttggtactgttaatattgaaagttgataatagtaatgtacctgtatattgatttataatttacgatgaatgcattttcaaatatactgtgttggtatttcccaaacttcagtgcatatcagagttgcctggagaactttaaaaaatatgacagatttccagtttctacttcagacctactgaattaaatctgagtatctaaaggtggggctcaggcatgtatagttttaacaaactacatacatccagcctaacacttgttcttgggccagtgtgggagcagatgtactatgatattagattgctcacatattctttctgtgaaagggaaagaatagaacacgttagtcacctttttaaatagggacgctgaggctcagaaaggttaaatgacttgtacatcaccttacacctaaaatgcaacagagctaatatttgtacaagcccctctactccattatctcatgttcaattcaattcagtatatatttattgtatattgtatatcgcctgttctgaggaaagcatagagaacaggatagagccaacccaaatgtccatcagtgatagactggattaagaaaatgtggcacatacacaccatggaatactatgcagccataaaaaggatgagttcatgtcctttatagggacatggatgaagctggaaaccatcattctgagcaaactatcacaagaacagaaaaccaaacaccgcatgttctcactcatagttgggaattgaacaatgagaacacttggacataggaaggggaacatcacacacagggcctgttgtggggtagggggatgtgggagggatagcattaggagatacacctaatgttaaatgacgagttaacgggtgcagcacaccaacatggcacatgtatacatatgtaacaaacctgcacattatgcacatgtaccctagaacttaaagtaaaataatttaaaaaaaggaaaaaaagaatacagaacaggataaacataactcctggtctcatgtatctactggaaacagacaaatacacagacaggagaaagggatatggcagcaaaagtaaagtgtaatatgagagtgcatataggacaattaacccagacttggagggtcagaaaaggctttccaaaggaagtacttgtcttagcagaaaatccaagggaagagtaggagttaaccgagtgacaaatggaagaaaagagtattccaggcagagggaacagcatatgaaagaccgaagtgacaaaggagaataggcacctttgaagaactgaacaaaattccatatggccagaagtaggagttgctaatagataaatcagggaagcaggccagctgtatgagtggtcagcactacaggcagaattgacactagagccatcagtttgtgacttctgggctagagtgcagaatgtgaatgattcagtggcaagagatgaggctgaagaggtaaacaaggttcagattgtatgagactttgtaagacactttattttggattttatcctaagagcaatggaattgttgatggaatttaagaagtgtgacacatcatatttgtgtttttaaaaagtcactctgattgcactgttgagaatgaattccaaggaagcaatattttataaccatagcctctctgaaaaatatgtgaattattcttgattgaaaactcatttgttcattcaacatagggaaaaataatctcaattctagtgggaggtaatccctgccattctgtttccttctcctgctcacatatgtatatccagttatgacaggtaatgtgtattttgcatctaagtacaatattccaagttgttatttaatgactgaacgtgtatatcattttaaatttaacaatgttcatacaaaataatgcctatacattttgttggttttacatttttaatattataaaacctttcaatttttgatttcatttcaaatttcaatttttaagaaatataaggctatcctaatatgtgttaaattctttgttccatatagttatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaagtatgtagatttattaatacagtctattttcataaggatttgatatcagtctatatgttatgaaaaatatactcatctagcatatctgaaaatatactcaatccagtcaggtttttttcatgtttagtattctgaattcaaatgctgaaaaatttattcatattcaaatatatttgagttgctcataagtcaaaaatgtatgatgtacaaaagtatttttcatgtttttccttaattcatatttttttctctggatagctgacgttgtgtccaattatgcattcatggcacattttttttttcttaacgctttgaaaatggaatccttgttgcatcatggcacatttttaatcccaggctagttgctcactcccctttggagtaaatcagggtgggatcagggacaattattaatttttttttgagacagtcttactctgtcacccatgctggagtgcagtggcatgatctcaactcactgcaacttctgcctcctgggttcaagcaattctcgtgcctccttcccttagctgggattacaggcacctgccaccatgccaggctaatttttgtatttttagtagagaagggatttctccatgttggccacactggtctcaaactcctgacctcaagtgatccgcccgcctcggcctcccaaagtgctgggattacaggcatgagccaccgtgcctggctggatggttattaattttaatgttagcataaaagcatgtcttagcctgtgactatacattaatacacaaattactattaagtcccctacctgtccacacaagaactgagtcttccagagcatccgtcgattatttaggcaagtcctagtatactgtttcacaatctcttaggacaagttgttcatgtccttccatactaaacgtatccactatgttctctattgcccttcacaaaaactcttctgggcacatacattctcatctggctgttttgactgctatcatcattctgtcctagacaaaaagaaatgctgatctctcctttcccaagcatggaccagacctataagtcccttcaacacagctgaaaacagactgcaacttttaacaagctcttactggagacttaaggaaaacggaagggaattatatcacaaatgttgatttacagctgcaactagctgtgacctctcttagtgcccccgggctcatcctcataaatctcccctgcctagcttctggttcatctctgtgtagctttggcaagtttacacaagtcactaggaatgtcccaataatgttttcctttatcaaaattcaggcccccccaatattcataaagctcagaaggagaataaagatttctccttatccttgtgcaaggccatctgggatctatttcttcacaggatgattgacagtcagattgtccacttcatttagggataaatccaaccctgcccatgaagatggatttgttctctgacccaacccagacaaacctatcagaccatagtgatatagcatcatacattcaccaaagtgtgaattactcagtctataaaccactagtgtagcagcaatacagtcacggttaacctttgcccagcctcatcaaattctcttttctctgtgaagattaggcaagcatgtccttcctgtagccttcttagtggtagccatttgtcatcagccaacaattgctcaaagaagagaacacttatctccacaactgttgagagaccccataaaatctaaaactatccacttataaaatatttatatttctttcaaagacaatcagaaaagtctccagaaatgacttcaagtcaacaatatataataatttacattgtgaaaaagagcccttagcgtttctgcctcaccattatatatatatctctactacctagtatcgtgcctgcatatagtctgtgttgtgagtgagtgaatgaaaacacatttaggttaatgattacgttatagtttcccaagaatagtagggatataaataaagaggtaatttaagattttttttttcccagaataaaataataatatggctgagtgtggtggctcacacctgtaatcacagcactttgggaggctgaggcaggcagatcgcttaagcccaggagttcaagaccaggctgggcaacatagcaaaaccctgtctgtataaacaaatataaaaattagcagggtgtggtggcatgtgtctgtagtcccagctctactcaggaggctgaggtgggaggaccacttgagcccagggaggttgaggctgcaatgagctatgatcatatgccactgcattccagcctgggcaacagagtgagacactctctaaaagaaaaaaaaaaaagaaagaaagaaaagcaaaaacaaaattaataatatgcttcaaaggcaactactcaggaggctcaggtacaaaaatagcttgaacctgggaggcagaggttgcagtgagctgagatcgcaccgctgcactccagcctgggtgacagagcaagactctgttttaaaaatgaataaataaataataaaagaaattttatggaagaatgatactttaagaaaaaattgttttaattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaagtatttgtgatggtgtatgcctggtaatcccagctactcaagtcttctgaacttgcaaaccagaatatagtctacaactttgaaatgagactttttctcagttactagcaattaaattttagaaatcttaagaacttcagagaatgcattatattaggttacgtataattacaaaaataaatcttagattgaaaaactagtatacttcaacaccaagtttgtatttttattttctaatatatccctactttgctaatagaaataatttaacaaaatatattaagttctaagtcttctacccctctcaccattacttttcattcctactctttaaattatagaactaaggtttgattgttcatttgttcaacagatatttatggagcattaactttgtgccagacactattctagctcctgacccttttctcatttattctcagagcttccattattttcaaaatatgtctttagccttgtctttttgactaagcatcatctttattttctggttgttgtttttgatttttgctgttttcttttttccattttttattctttcttaaatggttctttttatgagtcctatcacttgacaaagtcagtgtatctaaaatctaacaatcctctctcccaaaacaattcttcagatagctcagcctctgtcattagttattttttagaaacagctttatggattatggtaagctatatgaaaattaataaacttagattcataagttatattccaaagagataataaaactgcagttttaaaatataaaatgttttaccaatggatacaaaatctaggtcttgaaggagaattagatgatatcttgtaggacgagaaggtagtcgttgacaaatagggtttattattcaaaatgctgttactgcctttccctgcttactataaaatatttaggtaatggcaatatgtctaatttctggaaataattaaaatttcaacttaaaatggaattttaaagaaattttatgggccggacataatggctcacacttgtaatcccagcacttttggaggccggagtgggcggatcactcgaggccaggagttcgagaccaggctggccaacatggtgaaacctcatctctactaaaactacaaaaaattagctggatgtagtggcacatgcctgtaatcccaactactcaggaggctcaggcacaaaaatagctttaacctgggaggcagaggttgcagtgagctgagatcgcaccactgcactccagcctgggcgacagagcaagactctgttttaaaaatgaataaataaataataaaagaaattttatggaagaatgacactttaagaaaaaattgttttaattctcttgattttgtctttccccaatttgactagattgaattgaaacgtcaattttaatgggttctaagttccatttggttaaaggcttagcagtattgccaaatgattgaaagcacagtacatgacaccagactacctcagtttgatttttgctagttgtggtgtccttcggcaacttaattgcctcactgcagcttcattttctcatttgttaaatgaggctattaggacctacctcaaagagctgttgtgaagatgaaatgaatcaatacatgtaaagttcttaacacagtgctcactaaatgttagtccttactataagtagcattattattattattattatatttttttaagacagggtattgctatgttgcccagtctggtctctgactccagggctcaagtgatcctcctacctcagcctcccaagtagctggtgctacaggcatgtgccactgcaccctggattataattataataacattattattaagcaaaggagatgagacacccctaaacctagcaatcaacatcaatgccttactgattacgaattaaagatagtttttatcctgctatatatataggactggaaggaagtttgtgagcagagtttgaacatgtttatgcttgttttcttttttataaagatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttggtgagtgatagaaaattatttttaaaaattttctaagtcaattgaaaatacgctcttattaataatttatgactactgaaaataattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaattatttgtgatggtgtatgcctggtaatcccagctactcaagaggatgaggtgggaggatggcttaagcctgagagatagaggctcccatgagctgtgattgtgccactgcactccagcttgggtgacagactctgtctcaaaaaaaaatcaatctaatttatagatattagttacataaaaagattaaagacttctgttgccttgaaatgagtatttggctatagtctaaagtgttcatttttaaaatagattccatagctaaatattaaccttatttgtcatagtaatgctttttctttttctcccttagtgcaacaggacataaaatatattcccacagaagatgtttcaggtaatagtactaatattttaaatcaatagagaacattgtctttattttcttagtttttcactgaagaagcaaactgccttttattaaaaattctttcctctttctagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataatggtagatctatttgctgaccaaatgtcagatgttttcaggtgcttgacatgcattaatccatttgattgcctccaaccccacctaccagccaacgtggtcttcagtcattgggtttaaacctcaatatattaagtgtgatcatacaggactttgcagcaggcttaatttcatacttcagccatgctcattatagcttccattccaacctttctcttaatttccttatatcgcttgataccattagccattaagttcctttgtggtcacaggcaatgtgattgaaccatattcagctcctattggagaagat

SEQ ID NO: 11903 - DNA, 8834 bp, Human
  misc_feature (1)...(8834): n = A,T,C or G
tgtttttgttttggtttgtttttttgagacggagtctttctctttcgccctggctggagttcagtggtgcgatctcagctcactgcaagnnnnnnnnnnnnnnnnnnnnnnnnnnnnnnnnnnnnnnnnnnnnnnnnnnnnnnnnnnnnnnnnnnnnnnnnnnnnnnnnnnnnnncgtgttagccaggatggtctcgatctcctgacctcgtgatccacctgcctcggcctcccaaagtgctgggattacaggcgtgagccaccgcacctggccctggtttttatgttaccatgatttttatttatcttttcctttcccattttcttttggataggtagaattttttatttcccccttttgtttctatcagttgcaaagttatatcaggtgttatattctgttctttcagaggttatgagttaatattaacatgcatgcttgcctttgaaaagttaaaagttaattactcacctcctaacaaaataaagactttaaaatgccttgactaaaattatatcctgatagtttccattttttaagtgtctaatattccaaatttagctttttaaaaatcctctatagatggaaatggctgtagtgaatattatggttatagtcactacttacttagatttatctatgtagttaccattcacaataattttctcctttccattgtgtgtgtgtgtgtgtgtgtgtgagagagacagagtcctttccactcttttctttttgtgttgctattttcatactgaagcatactcttaatagttttttcaagattagctaaaaacaaacaaaaacaccagcatcaagggaattttagaacattatgctaagtgaaataagccaaacacagaatgttctcatactgaatgttctcacttacatgtggaatgtaaaacaattggactcatggaaacatagcaaaaccccatctctactaaaaatacaaaaaattagccaggcatgttggcaggcacctgtaatcccagctactcgggaggctgaggtgggagaactgcttgaacccgggaggcagaggttgcagtgagctgagacggcgccattgcactccagcctgatgacagggcaacattctgtctccaaaaaaaaaaaaaaggtggttaccaggactgaggggtgaggggaatgggaagatgacagtttaagggtacaaggccctatcagtgagataggaagaatacatttgatttctttctctttttatgggatcaattacacaacatggtaaatatagctaataattgagtgctgtacatttaaatttcattaaaaagaataaattgtaaatgttcttatcacaatactgttacatatttcaggtgatagatatgttaattcacttgatttaaccattccacattgaattcaaaaatcataacaccactttgtaccccagatatatacacatctatgagctgtcaattgtaaaaacaactcagagagataaatgtaaaattacaagaactgtatgttacaaaagagaaatgcatggtactatgaggctgaaaaaaaagggagacacaatctggacaggttttcagagaagccttccctgaagaataatgactaagctcagatctgcaggataagcagaaaataactactgcaaggggaatgggagcagagacaaaaagcattcaaagcagaggaaaagcacacacaaatgccctgagttccaaacactaaacgatcagtgacactggagcccagaggcgcttgtgtgagatgagcagatagaggcaggcaggggtgagaccatgcagaatgggccacagtaatgacatgggattttgttgttgttgttgttgttgttatttatttttttattatactttaagttctagggtacatgtgcacaacgtgcaggtttgttacatatgtatacatgtgccatgttggtttgctgcacccattaacacatcatttacattaggtacttctcctaatgctatccctcccccatcccctcaccgcatgacaggccctggtgtgtgatgttccccaccctgtgtccaactgttcacattgttcaattcccccttataagtgagaacgtgtggtgtttgtttttctatccttgcgacagtttgctcagaatgatggttttcagcttcatccatgtccctacaaaggacatgaactcatccttttttatggctgcatagtattccatggtgtatatgcgccacgttttcttaatccagtctatcattgatggacatttgggttgcttccaagtctttgctattgtgaatagtgccacaataaacatacgtgtgcatgtgtctttatagtagcatgatttataatcctttgggtatatacccagtaacaggatcgctgtatttctagttctagatccttgaggaatcacccaccacactatcttccacaatggttgaactagtttacagtcccaccaacagtgtaaaagtgttcctatttctccacatcctctccagcacctgttgtttcctgactttttaatgatccccattctaactggcatgagatggtattgcattggattttatcctaagaaatatagacagtcattggagggctttcttctgaaccacagtgtagagaatgggtttgtggtgcaaaagcggatgagagaagtacttaggaggctgtagtaccaatccaagcaggagccaagggtgactttgtctagagagacgtggaggtggggataagtaaatccatcaatgacacctgcaggtggggtgatatgggaagagggaggaggtgggacaggcattggctttgtatttatccaaacctaactcaatactgtacaagaacagttagtggggacccaactgcattgacctttccctcagattcattgcctgtccctattaaaaatgaacttagaagcccataaaactaatttgaattagggccctttattcctctccaataaaacttaaaacttcattagatccagtaaaattcctaacaacatcttcttaattccctctttaaaaagccactttgcatggtctaaatataataattatttggtagtggcaaatgtattcctaaaataattattttattacatattatcagcttaaaatgcttagagcctgagatctgtcagggaaataaattattttatttacaagagttaggttgagaaacctgatgttcccagcagagataagtcagaacctactgctctgatgtgaggcaggatttattagaccctgtgcctggagttcccatttcctctggtgaatttctccacctgtacttgtatgtgcatatttgtgtgtgtgtgcatatgtgtctgtatgtgtgaatacatgaaagagaagtgtctatgagacaagaatcctctcctatccccatcactaaagtattcctctgaaatctgtatgtcagaaaagaatttgaaacccctaacgattaaaggcaaacatccctcagagagatgaaataggaaactctggtaagctataaatgactcattgaaccatatgtatcagatctttcaacttctccaacagctgaaggtaaagcattggagccatgggagctttgatggagggcatggatatcataaattggagacctgacacttccaggaaccatgacgtaaatatttagagcactgggcactcattagtgctcagttggttgaaggaatgataaccaaaggccaaaattccaatctcacaactttgccgaagccagccctgactcctaaacaagttattattaaagttggtcttggtttccattcatgaggacgggcttctccaagacttgccctggcccagcccacagccccagaagttggttatctttatattatgaaaataagtgggctcttataatgtgggacatgcacttggccttgtgagtttaatttctaacaacaggaaaggacttgtacagacccattcacctcttgggcatgggtcacttgggttctgaagtctgtatgaagaggccaggacaggaggtaaagtgtaggatgcatttggccatagaactgagaagtctgatctaaatcatgcattcttttttttcccccccaagatggagtttcactctgtcgccttggctggagtgcagtggcacaatctcagcataccgcaacctccatctcctgggttcaagcaattctcccacctcagcctcccaagtagctggtattgcaggtgagcaccaccacgtctggctaattttttatttttttagtagagatcgggtttcaccatgttggccaggctggtcttgaactcctgacctcaagcaatccacccatctcagcttccttccaaaatgctgtgattacaggtgtgggccaccacgcccagcctaaatcatgcatccttttattcaaccacttttttgtcggtttattcatttattcaactttacaacagctttttcctgaccacccacctgggccagggcctctgctggagactgggacatggggcaagcaagagatccctggtcctgctttcatgagaacaatacctagtggtgacaataatacttatattatgaatctgaaacaaactcatagaagtggagagtggaatggtggttgtcaagggctgggaagatgaggaaacaaggaggcattagtcaaaggatacaaaattttgcttacacaagataagtaagtcttagagatctcctatactgcatggtctctatagttaacaataccatattgtgtgttaaaactgtgccaagaaggtagatcttatgttgtgtttttatcacaaaagaataataataataataagcaaagacagcaggaaggaattttgggaggtgatgcataagtttacagcataaactgtagtgatggtttcatgagtgtatacttatctccaaacgtatcaagttgttttcattaaatatctacagcttttgtatgtcaagcatgcctcaataaagtggtttaagaaaataaaatagtagtggactgtgactgaacttcactggtaacacatcatcctagaaggcactggggagagccacctgaccctgtatctgcttcactctgtgacctccggaagctctcttgtcctttaagcctcaaatttctcatctgaacttgagaccagacaccctccaaggtctataattctatttctcagggactccaaccaaatatgacctagtgactgacagccatgtttctctggaacacagagtatctggattcttgagaagcgcacctgtgggatgtcagaggtgggcaagactgtgtcattgggcatggtttcactggggaccctggctttcttccattcttccttcactttctaaatctctgctgtgcactggctagagaaagtaaggcacctgtcactgccatgctaagtgtgttggtgtttctttggttgtatgtttgttttagcctcaaagtggtaagacaggggagggactttgagacttcttatctaaaatcttgagttttcagggagtgaagtgaagtttttcaggcagtgaagtgacttgattaagatctcacagcatgctgggcatggtggctcatgcctgtactcctagcactttgggaggctgaggtgggagcatcgcatgagcccaggagttcaagaccaacctgggcaacatagtgagacccccatctcttaataaatttttttaaatttatccaggcatggccatgcatgcctgcagtcccagctacccaggaggcagaggagggaggattgcttgagcctaggagtttggggctgtagagagctatgatgatgccactgcactccagcctgggcaacaaagcaagaccctacctctaaaaaaaaaaaagagagagagagaagaaagaaaagaaaaagatcccacagcaggaaggagtcagccttggccaagatgtgcatgtccagactttcagtggcatgctcctcctgacaccagcacagcatcatgttgttccactgttcttttcatttagtctccatggttcagtggagaaaagagtagtccttactcttccacagacccactgtacagccaacttacttaaacctactggcctcgatgccccatggctgcaaggacaggggatatccaacacataaagctgttatgcaaaccaaatgcaggccactggtcaggcaaaggtgcttctaaactgggcagtgctacacccacaaaaaccactgagaccgttattgggaatagtaacagtagtaacacccatagtcaatgatgaaaaagaaacttcacttcagcccatcaggacttttatcccttaagtatgtgaccttcaaattgaaagagttctgaaatgttctaggaataactgatattaaaatctgtgtacaaaacaaaaatgtgtgttatcaagagatcagcagcccacccatggagggcaccagccaccatctccatcactaatatgaccacactgtgggctccctcatggctgtaggtggagtgcctggatagagtagcactcacccaggacactgactctagtgcaaactcactttccacatttagatttgttgcaaactgactttccacatttagatttgttgctctaatgcattggatttattatttttatttttttattagcataggattatgctaatttttttattagcataggatttttattagcataggattaatattaccattttgggggagagggaggtttgtgcctttgagtaggatttctctggcatgctattgtgcattttgtgctgatacaacagaataccacagactgagtaatttataacgatcataagcgtactggatcacggttctggaggctgggaagtccagtatcaaggtgtcagcctctgttgagggccttcttgctacgtcatgacttggcagaagacatcacatagcaaaagggcaacaagaaagcaagagagagccaaagggggtgaacccactcccaacataacactattagtccattcatgacctaaacacatctgaaaggtcccacatcacaatgacaattaaatttcaacatgaattttggaggggacaaacattcaaaccagagcagctatggacatggttatcagttaaagaaaacaaaccattctcaggaaaattgtaaaagtaatcattggacctacccagtccccaccctgccagccttcaggaaaagacttagggtaaagattctaagagttagaagaactttgcctttgcctcaaagttagaagaccagtttctgctttctgtttagcatcctccaaatatctatctgggttcagttttccccttctatacatggagccaataccttttttcccctcctcataaagggttttgagatgaaaatgaaaagtaaaataaaagttataatgaacacagaatgtttaaaaacaatgaagtatcacataattgtgtaataaagagaaaaactatccagtatttaagttcttattttatgtcagacaccattaagcactttgtataatgtaaacactattgactagtagaaacaataaagtaaatttaatagaactttatccatacgaatattcacaattttcaaccaaaatatcagcacttttcacctcgtttcacacacctgtctctctcaattccaagacaggatggagaagtgttgttgctgaccctcttgtgatctgtaagaaaatcagtgcaaactgctttccccttaaagggcctcaagtgaatggctcttgatctttgtggtcctcagctcaatggatggaaaaatagtctttcccagagaagagaggagtaaaactttaccttctccttctgatctaatactctaggccagcattaagatattgactgcaactttaaaccccgtggatgcgaagataacttaaaatgcacacttcattcctcttgttggtatttcaaaggactttgaggttgatcacgggacaggaaagcagtaatatggtagttattaaagaactagaggtttgaatgggctttgttcaactgctgctagactcacgtgtccacaaaaaagtttaaaaatgtggctcccaagggcaggaattaaatggaccttggctttcttgttgctgttgtctttgtcttccttctacagaaagtgatatctgaaatgtaataactggaagtttctccaaaacaaacacttaccaaaaactctcaaggacatgaaacttgggtgggacttggagaatgtacagcccttttggtcattgatggaaataagaaacacaattttgcagctgattagagctgactggttgttgtcacaatcattcattttgttaactgagtactttttgtgtacctggtactatatcatgtacccagtgagattttaaggggaataatacactttctgctcttgataataccaaggtgtcacttctcgagtgctactgtgtgctgggcattgtttttagtaccctacatgggaacagtcaatgaatcctcatagcaatccgagaaagaggtgttattattaccattactattttacacatgaagaaacacagacacagagattaagcaacttcctcaaggtcactggctagtgagtggagctgctgggttttgaacctgacagtctgttccggatcccacgctacatagtggtaacccctgcactttaccactgctcctgtgggagaggggatatgacaggtccaggcaagattacactcttgggtcagtgctgccaaaatggtgcataaaacatgcttcagagaagggaaatggttggccaaagaagacttcattgaggaggagggttgtattagaaactctctttcctggccaggcgcggtggctcacgcctgtaatcccagcactt

SEQ ID NO: 11904 - DNA, 40624 bp, Human
tcattgctatataaaatttcacttacagtctaaccattctactgttgatggatatttggtttccagtttgggggttattatgaatagtgctactatcaacattctattaatgtattttggtgtatgtatgcgtgaatttctttggacatttttgtgttttttaaatccacagtcagtgaaccctaagtgttcctcagcattgcagtcagtatatttaccatgtatgcgttactcaaatgacagctgtagttgcaggcattaccaaatccttccctccttaatgttatcactggactttgtctatacttgggattcttaacatgttgtattttggttaagtatgcgtattcatgttttttattagattttgagtgctttttagtactttgttttacttgcttatgtatcccgactcctgacgaggtacctgaaatatagtaagctagttgagcgaatggtgatagctgtcaccattgccagtgattaacagagcaagtttccctagttatgtgaatcacttagcctagagtaaaatccatgctttagtttgatatctcagtgtcaaaggattaggaatgggaagtcatttctctctgagagaagcccagaactgtgggctcagaactgaatgtgctgtgtggctaaagggaattgctatggctttacaagcctcttggagatttaaagtgttaacagcagtgattccaaggcatagtgtgggggggccagatataaatagcagaacacaagtagcgtagtgtgccactgccaagctactgctgggggtgtttataaaaagaaaagcattcctgtctcagctctcactgtcaacaacatcccatcctgaagacttgcttaccacaactgagagtggggagtcagtttgaggcctagcatcacttaaacttcctccaaaggcacaaaagccaggtaaaccttttgacttatttacactcagactaaagaaatgaacaatttttaggaaaatcctgatcaaagcttgcttaaaacatattgccttgtgacagatatctatcatcttatattcaaatcttttttggaaagagaagtttaacacaaagtagcatgttggtactatattttagtatttttagtaaaaacaaaacaaaactgcttctgaagaaatatgggaaactgaggccaaaatgatctataaaagggaagacttctcccttcccctgtgctgttcattctcatttttagaatccagaatatggtgattggtagggtaaaatagaagcttcatttgagttacattatcataaatactgggatgaatattaggcattcggccaatagttgtataatcttagaattgctgcctacccagttccttcttattcttgttcccgccttcagaaagttatgtaagacacttattttaccctcgggcttctcttgattgtatttgggggaagggggccatctctgacaatccactgctttgtaccactactgacctcatcatctcctctgtcccactcaaaagggcatgacaatgtgcaaagaggatagaagaatggataatgtgcatggacatattcctggggaattcttagaaactgggagctaggggaccaatttgagactgctgttttttagtctgattgtgttatttcctgtgcacgctgaggggagatttagagatgggaagaaaatatgactcccagtgactgtggtgggagagatgacatgtctggaggagtatggaaatgcacagatttaatcttgagcaaatcactgaaattctaaggtgtttttgtttcctcgtctgtagaatgagagcattagaccactagataaagcctaatggctcttgtagcccgttaggaatttattgataatcacttcctgaccatcatgctatccactcacattctaaatgaaaaaatacacagtgtcatcctattctacttccctacacctcttttttgagtctactgaattgaaatttctttattttaatttagaagagaaaaatgaagacgggacattttgaaatagtcaccatgctgctggcaaccatgattctagtggacattttccaggtaatgttgggaatgggaagcatgtggtcattggaatggaaattcgtttttttttttttttgagacggagtctctctctgtcgcccagactgctggagtgcagtggctcgatttcggctcactgcaagctccgcctcccaggttcatgccattttcctgcctcagcctccccagtagctaggactacaggcgcctgccaccacgcctggctaattttttgtatttttggtagagacgggttttcaccatgttagccaggatggtctcgatctcctgacctcatgatccgcccacctcgacctcccaaagtgctgggattacaggcgtgagccaccgcgcttggcctggaatggaaattcttgatataacattacctgaggcatctgtgtggcttgatggtggaaatgaaagtaggtaggataggtaaattaattataagtagctcttttcattttaaatatgtgacagattaactgtaaaaagttgaaaaaattaaaattaagcaaaaagaggaaagtaaagattattcataattcctccactcagagggaatgattcccaacctgttggtgtatacaggcttcttggcttttttctatgtgtatactgtttttaatttacaaaaatgggttcacactgtacatagaattttttctttgcattttaagttaatactatgctgcatgtcacgcatgtcatcagatattctgaatatatgtttttctccaaataagataatgctgcattgtttgattacatgttttttaattaatgaccattttcccacattttttttctggcagaacttttatgattttatttgcaattgactctttaagcatcctgtaacatatttttatgtaaaatataatatttcacttgattttttttccccacgttgttagctgccacattacttgtgggtatttgtgcaccattttagatgcctttttaaaaatatcttaaattcttaaactgttatccttttttgaatttaatattctaatccattttctatagaatcattgtgtatcctgtttcctgtgtcgcagtatgttttttattgaaatataatttacataccataaaaattcaccatttttagctgtatacttcagtggtttcagtatattcattatgttctgcaaccatcaccactatctgattgcaaaacatttccgtcaacccaaaaagaaaccctgtacttattagcagtcagccccaattttctccatcccccattccctggcaaccactgtctactttctgtgtctatggttttgcctattctggatatttcgcctaaatggaatcatacaatatgtgaccttttgtgtctggcttctttcacttagcataatgttctcaggagtcctatcagtacttcattctttcttatagccgagtaatattctattttatggccgtaccgcatcttgtttatccatttatcagctgatggacatttgggctgtttccactttatggctattacgaatagtggtgttgtgaacatttatgtacaagtttttatgtgaacatgtgttttatttttctttttaaaaaattttctaatcatatagtcttgacatattgagatactacaaacactatttggttatttggtagcattacagagtaaagtttacttatatataggaaatatatatgtaagaatgaatttgggggttatgatttatgattcatagcaaaattacctattgttgtgaacatgtttcacttctcttgggtgtacacctagtagtggaattgctgggttgtacggtaattttatgttaacttttttaggaactgccaaactttttcacactagctgcatggtattacaatcccaccagcagtatattaggattctaatatctctgcatccttgtgttacatgttacttggtttttcatcatttatagccatcgtagaggatatgaagtggtatttcattgtggttttgatttggttttcaatatactcttgcaacataatttaagtgtatttgttctgtaattgtttcatgatttgcttagccagtttctctccttgacctttaggtcatttccatatttttgtaagaaatttttggtaattgaatttcattagtatgggctttttttctcggtggttatatcagagaaatataatcagcttgttcacctagccttttgtacctgttttttagtatctgttcagttgtccctgaatagtggtggcatttatgaactttgtcactgctcaaggcacgcaccatacaaaatacacaatcagctatggtgtctggccagaaagacttgatgtctaaaattagacatttggagactggttagaggcatagggaaaagacaggaacatagtagatcaactctgatataatgtaaggaatgtgggaggtgttttcagggtctggtgtcttatacggtgttgaagtcttgaagataaatcaggcattggcacccaagctgcactctggtacattctgtgctgtggaggaaagtgcatttcttggctatgagatggcagtgatttgatctcctgaagctcaaattcccatgtcaggaaactgacctacaaacccaggactacgggggtcttaatgacttccatggcagaattctctgtggctagtaatcaagatagtttctgaagctggcacaattccctcgtttgtaaaatggtgttaattattttttgtttaaccttttataaatgttgtaatgaggacagaattacactctttttcaagtgctacataaatgtccatggtcttcataattggaaacattctgattctttagaggcaacagaacagtttggttaagaggacaagacggccgggcacggtggctcacgcctgtaatcccagcactttgggaggccgagaaaggcagatcacgagttcgggagatcgagaccatcctggctaacatggtgaaaccccgtctctactaaaaatacagaaaaattagccgggcgtggtggcgggcgtctgtagtcccagctactggggaggctgaagcgggagaatggcgtgaacccggcaggcggagcttgcagtgagccgaaatagtgccactgcactccagcctgggcggcagagcgagactccgtctaaaaaacaaaaaaaggacaagactctggaattagactgcctgagatcaaattccaattccatgtaagtctcaatctcttagtttcctcatctttgttaaaaaaaaaaaaaaaaaaaaaggcggggggctaataatagtacctacctcacaaggttgccgaacacttagtgcctggcatatagaaagaactctggagatgtttgttaaacttggtgatagagtgtccacccagtgtgtctgagaaggaaatatgtaggaaaagttcacaaatgaaaaatggttttaaataagaaccaggtcgttgtggctgtacgattgtaagtttcgtcttagacatgttacgtatgaaggttctttgaacattcaagtggaggtgttaagtaggcagataaatttgatatataggactggcacttacaggatagatcagatatatttagatcataattgaaactgtaagcatgtatataactgcctggggagcgtagagttgagagttagaaaatacgtagccttgaggaactccaacatttaatggctaactggaatatgttgggtctgcaaaagagtctaagaagaaatgctcccttaagtgagagctgtttgggtggagaaatgggtgggaagccataatggggagggttgagctatacgtgggaaatgaagtggagatggcaaggacagacatctctttcaagatgtttgttcgtgagggagagaagagagatgggaaaggagatacctagagcaggatatggaagcaagttttgttttgcgtttacaagttagtatctctgtctctctctctctgtctctctctctttcactctctctctctctcacacacacacacacacacacagagagagagagagagagtttttaagtatcattcacatagaacctgtaactttttttttgaatctgtaactttaacagcttctagctaaatatgtctataaagtctccaactgaggtccctaagcagacttatgcaactatgcaccatacaagtatagactaatggaagaggcattatccttttatttgtagaaactcataaatggtattcctggggagatttgatcatcttattttttgatccataagccagagtacagggttctaatgtagttcacttgaatattttgccaggttctgtgctaggtgtgtaggattcaaagataaaaacgatacagatcgtacccttaaggatctaacagtataatacatatattcctagcatgaaataatacaaaaaaaccacatcacactggagaaagaccttatgaaaaaataataataaccacggcatgttaaagacttgatatgtgccaggcatggggcagagggctttgcatatgttcattacataatttaattctcacagccatcccacagttaaatactatttcctccactttgtcttccttttttaatttattttttattttttgagatggagttttgctcttttgcccaggctggagtgctgtggtgcagtctccgctccctgcaacctccgccttctggtttcaagcgattctcctgcctcagcttcctaagtagctgggattacaggcgcctgccactacgctcagctaatttttgtatttttagtagagatggggtttcatcatgttagccaggctggtcttgaactcctgacctcatgatctgcccgcctcggcctcccagagtgctgggattacagacatgagccactgcacctggccttttatcctaattttttttaaaattgaaaacttgaggattagaaatgtcaagtaactttcccatacctagttagtaacaaatgggatttgaactctgatctgcctggcttcaaagtggtgttaattacattacaccaccctgcttcttatgttatgtgaacatatgtatatgtataatttagttgtatgtggtattatgcctcttcagttgtatgtgactgaaatacagttcaaactagctgaagcaaacagggaatttattgattcttacaactggtgaagagtacagttaggcccagcgtctaaagtatgttttcgggtcctcatctctacctctcagctcagcaagccttatttgttgctttattttaagacagaattctccatgggactaaagaataactgttggaagccctaggccaatattatccttagagcttacagctttagaggaagaaagatccatttttttcctctgggagctctgattgctagactttagatcacctgcttatccaggaggtgcaaaatcatttctacccaggccatatggacaagggagggggcaaccccaaaggaaaagggtaatgtttgtcattatgtgttatagatcatgaataatattttgcatatgatacttcaaattcccaacagccttgaagggttgaagaaatctagctaagatgttcaaagccaggactgccacccatttctttagcttcacatccattgttctttgctctgtgccataatgtccagataaatgagctacaggcacaatctcacccatacctctcacccactgacatttactctttcacacaaatatggcacagctgagaaaagttatcaatagcaatggaatatacttcctgcataaaaacctacccaaaattggttataagtcaggcgagaattttggcaagggatgagaaggtgggggtaataatgtgagagaaaatgatattcactgaatttcttatttcaagagtattaatttctttttcctttgaaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggtaagtgtctgctctgtctgtgcttggctgggagggaaggagtgggattcttaggcttagggaaaggtcagtgaaaggagagtgagaggtgtttgaaaggtgaaatgacattccgtctagcttctttcatactatctctttacccatagttaattttatgaaaattgtacatttacagtattattaaaagttaaaaaaaattagcactataaggcagtggttcttaaccaaaggcagttttgccctgcagggtcatttggcaatggtcagaaacatttttggttgtcacagttggggaaaagggggattgctactgacatctaatgggtagaggccagaaacactgatagacaatgcataggacagccccacacaacaaagaattatatggcccaaaatgttggtagtgctgatgttgagagaccctactataaggcttacaataaataaatagtgcagcctgggaaacatagggagaccaccatttctactaaaataaaaataaattaaaaattagccaggcatggtggcacatgcctgtggtcccagctgcatgggaggctgaagtgggaggattgcttgagcccaagaagtccaggctgtagtgagctgtaatcacaccactgcactgcagtcttgcagcagagcaagaccctgtctcaaaaaagaagaaaaagaaaaatagcagtcgccagccccacctttcctcaatttccactcctcagtggcatccagttttcattcttttagctatttcttcaggtgcttactgtcatgtttccaagtaaataacatgcttcaacatgttatttcttggtttttaaatctttagacatcatgtattgacttcctactacagagaatgagtatgtaaccctcatctaccgtgtattagttaagaattttttatgtgttcagctgtaaataacagaaaacctgactgagctttcatttaataagtcttagaggcaggctgttcagagtcagcgcagtggctcatccatgtcatgtcactcatgctctttctttctgttccaccatccttaccatgttttgtttgttgattcatgtttgcacttgtgactgttgcagctctaggcatcaatccatgtccaagacaaaaagaaagtaaaggggatgacagccaaatctacttgttcagtaaggaaagtaaaagttttcccagaaacccttactaaactcctgattacaggtcattgacttgaacagtttcttggtcacccatagctaccagagaagcttgggaagggggtaattatcctttctccagccaagggaatatagtgtgtgggggagacaaaggaaaagggaattagaaatggctgttagatcagtaaaccaaaagtttctgaaagccaacaccctccttcccaatgtacgtccatttcccccttcccattctcccagcatagtaaagacaggtcatagctcagttagagtggtttttctgtgcttaaatccctcttttaccccagggttattctatgatttttttgtttgtttccttagtttttttaatatccaatcagtaattcacctccaaatcctttgacagaaatataaatttcttctttcccctggataattccctcatcatactgctctatgataagctctttaggcctgctgaacatcctgaaatctctcattaccattctgagatattgcttcttccctatgagagatctcctatttcttggatttgcaactctttcttggattactactttgtttggtgtggtggggatgggggttctgcagaagtttcggagaaatggtccactaaagaaaattttctaagtctctgcatctctgagagatctgcctttaagcttgattaatagtttatgtagatttgcatttctattttagaaactatttttccttggaattttgaagatattcctccagtgacttctaggttctgtagctgttgttgaaaggtatgaagccattctaattactaaaactttgaataagactttttaaaaacaaaaatctggaaggttttaggttgttttctttattcccaacattctgaaattttatggtgttgtgccttagtgtgtgtgagcaaagggttagtaaactccttctcctgtcttctgtgaaaatggcctcctggtgatcttccagcactctctctgcaatctatgaaaggtggaatgacagctgtgtgaccttacagcattgcctgtggtaaacataacccttgattggtaaagtgcatctgagctgggaggattgtgaatgaactataaatacttgaggagaagccatagctttgggctttcctgaatgtggtgtgacatacccaggtgttcttcttgttgagtcctggaaggacagcagtactctcgtaccaatcctgcataggttcaaaatatattgtattttatatgtggcatgaggctactaagctagagaggctcctacacccacctgtgtaatcttgtttccttgaacctgagctgtaatttggaagcaaaagaacagccctggactcctgtgaagacttgcattaaaggaacacatctgatgctgctctgctgctagacagtatgctttattcactgctgtatattcttctgcaaaactgagtaaactggtgaggggttggcctttttgggtcttgaaggtgtgattgcctaactgaaccaaaaaccatcgctgctgggtcaagtaaagtgtgcagtaggcctcaaagtgggatagacttttagatcttgactaaatgtagccaaggtactatgagataaaaaaggctgggtggtagggaagtgctaatgagacattgatgtctgggtagggacagatccacttatgattggatggcagaagctgtgtggctattgaggtgcctagggtgaaaattttaaggaagtcctcactcttagggctgtacctgcacttgtatattcctgagagtgcctccttaaattttctctaggcaccttatttgcctcaccctagtcctgcatctgagttgcacctgagaaggacgattctagttagagcagatgaaagctgaaatgagtaaatttggttgaaagaaaaagtgtttataaaaagataggggaaaaaagacaaaagacgagatgagaaatgctggctagggtttggagaagagggaaccctggaacactgttggtaggaaggtagattggtgcagccattatggaaaacagtatggaggtttctatctttaaatagaaattaaaaatagaactgctggtcaggcacagtggctcatgcctgtaatcccagcgctttgggaggccgaggcgggcagatcacctgaggtcaggagttcgagaccagattggccaacatggtgaaataccatctctactaaaaatacaaaaattagccaggcgtggtgccacgtgcctgtaatcacagctacttaggaggctgagacaggagaattgcttgaacccaggaagaggaggttgcagtgagctgagactgcacaactgcactccagcctggtcaacaagagtcccccccccgctccctccccgcagaaaaacagaactaccatatgacccagtaatccctttcttgggtatataccccaaagagttgaaatcaccgcctcataaagatatctgcactctcatgttcactgcagcattattcacggtaaccaagatatagaaacaacctaaatgtccaccagcagacaagggggtaaggaaaatgaggtatatatacaataggatattattcagccttaaaaaaagagagagattctgccatttgccacaacatggatggacctggaggacattaggctaagtgaaataagccagacacagaaagctattgcatgatctcagttatatgtggaatatatatgagatcaaaaacgagagaatgaaacagtagttaccacaggtgtggggagaggaactgaagagatgtagatcaaaggataccaaatagcagacaggtaggatgaacagatttggagatctaatgtgtaacatgaggactaaagtcagtaaaattgtattttacttaaataaggattttagctctcttgctacatatacaaaaatatgtgagatgatagctatgttaatttgcttcactatagtaaccattttactatccatatgtatttcatggtttcatgtaaaccttaaatatacacaataaaattcagtttttaaaaaaggaaaggtgctcattctcaccaaccatacattggacctgacccaaaaccaagccagctggggccagtttagacgagctcatgggaactgatcgtgggtatgcatgtcttctttcctgctccccctatgtgacagtagcctgaaattggccatagtttagagttataccatggaaatcagaaaacactgcaaaccagggtctccctccctccctacaccaatcttgtgaaactttatcagcatagcacagccaaaaacccggctgcagctgggctgacagaaatggtaccgcttttggtgtttttgatgcctttggccagatgccgtttgtggaaccgttagttatatcaaagccctggctgcagtggctacaagctaaatgtagcacaggggtctggttgatgggctgaggtgggcaatggagcccacagactccatgtttgtgagtgggattatgaaagaaccaaagaggttctattggattgattctgaaaatgccagagttcagacccgcgtggagaagtgcgggtcattgtggaggcgcacgtgtaccatgtgtttagggagctatgacagtcagccattgtactcgagtgtgttgatttaaccctgggctggagtcctctgccgccatctagagatggaaagtcaggatcaaaaactccctggagtaacctttaaagacaggcagtttgaaacagtgtgaagaacaatggccaagtgttttaagagccctagctaaggagaatgtagtgagaatcttgttccattgtgactggatataactgagcctttggattaaaaaaagacaatgtttctaaaaggggtaaaaaaaatttttactgcgttacgtttagtgtgctaaacatagtcccacaatgttttaaacttgcctgtgatttccaagataaaaatatattgtgagtttttcaaaaactagttagctgaaaactttgttcgttaggaagcagagagaatatcaacatctctttagataatatagttcctggtggtcatagacattaatcttggtattaatccaagctgatgtgagtgaaaaggagtaacagaaacctttctccttcctcaatagaaaattagcccaggttaactaacttttatgctatttttctagaaaatgcgataaagttgaaatgttagctgtataatcaagctacatccattatcattaaaaattactccattggggctgggtgcagtggtgtgtgcctgtagacccaactactggggaggctgaggcaagaggatcccttgacccgaggaattcaagtgcagcctgggcaacataatgagacacccatctcttaaaaaaattactccattggaaaattatacctcaattgggaggacggtgaatgaattataaatacctggtgggaagccatggctttggggctccctgcaccctacagggcaaatatactaggtttataggaagaaaatttatatgcagagaaatagtagagcacatatcatcccctgaactctcttttttttttttactgaacagagtaggcagagattatctggcattttggtcaatgtttccatagagagaggcgtgcctgtataatgctctacataatttatagagtaagagggccagggaatattgttccctggctggaaagtagccttgatagaaaggaggagcctgtagactccagtggctagtagtattattttgtagagtttactgagacctgttgagccagctctctgctaagccatcaaaagggggaaagaaggtgagcctacaggactatccagatttatttgttataaatctaccccagcccttgtgtgcttattaaatgttaagtatctccattggttctgattggcacctttctttagcatttcctgggagtagcaaagtttctgtactgttgtctgggattgtctaagattgagacatcaataagatccatgtctctaggcctaataggaagtgacatatccaacaccataagaaattcgtacttctaaacagtggctgaaatgtccctgaatgctatagcaaattcaccaggctgccaaggaatatttttaaatttcaaaacagacaccgccatacttgatatttgtcagacactgggtgaactactagcttgaggtggaactcagtttcaaagttacatgttatatcatagtacattctgtttgatgacatcataaatttgcaaagctggatctttttagcaattgttgtaatgaaaccaagtatatgtgaaaatcaatgtggcatttatcaataccccaaattaataaatatttatatcttaacaccttagtaaacatttgaaaaaatagcacatactttttaaaagtactattattttattcttaacaataattacttgctaatgggatgtgtttgctttttggacattcacagcttctcagaccctggaatcagattgtgtactatctcatttcctgttccacactgattttcacatatacttgctttttgcgacaacaattgctaaaaagacctaccttgcaaatgatatggtttggatctgtgttcctactcaaatctcatgttcagttgtaatctccaatgttggagatggggcctggaaggaggtgattggatcatgggggctgtttctaattatttagcaccgtcccctttgtgctgttatcatgatagagttctcacaacatctggttgtttaaaaatgtgtagcatcttccccctctccctcttcctcttgctctggccatgtaagacgagcctgcttccccttcaccttatgccatgagtgtaagtttcctgaggcctcccctgccacgcttcctgtacagcctgccgaatcatgagccaatcaaaactcctttctttataaattacccagtctcagatatttctttatagcagtgggagaacagatatatgtcatcaaacagtttgtaacatgatataacctgtagctttaaaactgagttctacctcaagttcacacggtgtctgacagatatcaagcctggctgtgtttttcttgaaatttaaaatattctttggaggctgggcgcggtggctcacgtctgtaatcccagcactttgggaggccgaggcgggcagatcacggggtcaggtgttcgagaccagcctggccaacatggtgaaaccccgtctctactaaaaatacaaaaattagccaggcatggtggtgggtacctgtagtcccagctactcgggaggctgaggcaggagaatcacttgaacctgggaggcagaggttgcagtgagctgagattgcgccattgcactccagcctgggtgacaagagtgaaactccatcttaaaataaataaataaataaaaatattctttggtagccctgtgaacacctcagccactgtttagaaaaaccacagatctaatggcaggtcagccacatgtttgtgaaagtggattaggttttagtagccaggtttggccctttattggaggtaagatttccatatgacagtggagctttcaagagttcgtccagccttatgggaatttagttcagagagaacgtattgcataataagatactggtttagtgaatcatgacttttctttcgataagacagtctgtctcaattaggcccagttaacaggctagcagtaacagccctgcagaaagaggaagtcctcgtgacctacaaattctgacgtagccttgttgccagagattctaatcagctgtgagtatagtcattgacatttgtaatttctttggatctgaaagagatagggaacttgtgggagggctttatttactcttgtccagactgcgtctaatgtttctaactgtagacttctctgctaacatgacagccatgtaatctccagtatttaacaagtcagggatgtggagggcttcttttggtagggaactagagaccagatccaaaacctagtcctgtcctgttcatcccatcctcataattaagaaaaaaaaatttaatagctttactgagttataattgatatgcaataaactgcacataaagtaaaatttagtaagttttgatatatgtatatgccaatgaaatcatcactacaatcaagacaatgagcattttacatttgttgcttacaaaagtttcattcctctttgcaattcctttctcctccctttccctgtttcccagtccccccaggcatctactaatgtacttgctgtcactacagattagttggcactgtctagagtttcattcaaatcttatcatacagtatattctcttttttgcctggcttctttcactcggcataattgttttgagattcatctgtgttgttgcatgtatcaatagtttatttatgctgttgtagaatagtggatataacacagtttacttgtctattcacctgttgatgagtacgtgggttgtttccagtccttggctattacaaataaaacttctgtgaacatgtatatacaagtctttgtatggacatatgctttcattacacttgagtaaatgcctaggaatgcattggctggattatatgataggtatatgtgtaactttggaagaagctgccaaatggttttccagagtacctgtaccattttacattctcaccaggagtgtataagagttctagctataccacattcttgccgacacttgatagatgtctttttaacagttctaaatagatatgtggtagtattttattgtagttttaatttgcatgttcctaatgagtaataatgttgagcatcttttcacatacttatttgccatttgtatatatttactgaaacacctgctcaaagatttttgtccacttttaatgaggttgttttcttatcttttgagaattatttatgtattgtaggtacgaggtttttgtctgatatgtgatttgcaaatattttctctgaatttgtagcttatcttttttttttttttttttgagacagagtctcgctctgtcacccaggctggagtacagtggcacaattttggctcactgcaacctctgcttcctgggttcaagcaattctcctgcctcagtctcccaagtagctgggactacaggcatgtgccatcacgcctggctaattttttgtatttttagtagagacagggtttcaccatgttggccaggctggccttgaactcctgacctgaagtgatccacctgcctcagcctcccaaagtgctgggattataggtgtgagccactgtgcctggtgatttatctttattccagtatcatatattgatcactatagctatataataaacctcgaaaccaggtagtgttcattgtattcttttcttgcaaagttgttttggtgattatatgttctttatgcttccatatgaattttagaatcaccttgtcaatttctacaatttctgcttggattttgattaagcttgccttgcatttatagatcaatatgagaagagttttaaaaaatatacttttccaactcatgaacacagcataacatctccatttatttaggtcttaatttctgtcagctgtatccaaatagtgttcagtgtgtaaggcttttccatctttcgtcagatttacctttaagtgttgtatgtatgaaaagtttatttcaccttcagttttgaaagctgttttcactgggtatagaattctagattgatcttttttttgtcttttagtagtttacaaatttactgttcctctgttgttttacttaaattgcttctgacaaaaaaatctgctgtgctcctcatttctgctcctctttatttagctcccctgctccccactggctgcttttaagactttgtgtttatcatacttatttggaccaatttgattatgatgtaacttagtgtcatttttttttcatgtatcttgtgcttggagttcattgaacttatggatttgtaggttcatagttttcatcatatttggaaagttgtgactactgtttgtgcaaatattttttcacccctctcttcttcctttagggattctgtttatatgtatattaaactgcttgaggttgtccccagctcaatgaaactctaatgtttcttgttattagtatttttctctgtttcatttttagatgttttctattgttttgtatatttcagtacttcattgctgccataacaaattaccacaaatttaatggtttaaaacaacacatctagatttattatcataaaattctgtatttcagaagcctgacataagtcttgctgagctgaaattaaggtgttggtagggctgcattccttcccaggagcttaggcaagaatctgttttcttgctttttccagcttccagaggttacctgcattccttggtttgtggcctccttcatccatcttcagtcagaaacagcatgttgatggccaggtgtggtggctcatgcctgtaatctcagcactttgggaggctgaggcaggaggatcacttgagttcaggagtttgagaccagcctgggcaacatagcgagaccctgtctctacaaaaaataaaataaaaaaagtatccaggcatggtggcatgcatctgtagttccagctgcctgtgatgggctgagatgggaggattgcttgagcccaagagttgatgttgcagtgagccacgactgcgccactgtgcactccagcctaagtgacagagggagaccctgagaccccatctcaaaaaagaaagaaacagcatgttgagtcctccgcacctcgcatctctctgatcatctcttctacttcttgttttttccacttttaagaatttatgttattagattgagctcacctggaaaatccaagataattgccccacctgaaggccagctaattagcaacattatttgcatcttcaaccattgttctcttttgccatgtaaaataacatattcacaggttctggggataggatgtagacctctttaagaagggtattattctgcataccacagtatgtcaagtttgctaatcttttttcttcagtgtctagtttgtcagtaattctatctggtgtatttttcatctcagaatttttatctctagaaattcaatttgggtctttttatattttccacgtctctacttaacacctgttagtagtaatgacatacactactgaatgtatcccccccaaaattcatatgttgaagccctaatcctcactgtgatggtatttggaggttgggccttcaagaagtaattaggtttagattaggttttgattaggtcatgagggctgggagtacccatgacggggctaatgtccttataagaagaggaaaggagaccatagctttgttctttctctgacataatgaggatatagtgagaaggtggctatctgaaagccaagaagaaagcctttaccagaaattgaacctgccattaccttgatcttggatttcccagctctggaattatgagaaataaaaatctgttgtttaagccatccagtcagggtattttgtgtggcagctggaggtaagacaacacctttaactattttttggacacatggaatacagttgtaatgactactttaatttacttttctgataatactaacatttgtgtcagctctgggttagtttcattagattgagttctcttgtcatgatgaattgtattttcctgcttctttgctggtagtttttgattgggtgccagatgctgtgaattttaccttgttgtgtgcatggtaattttatatttctaaaaatattcttgagctttgttctggtacatagttaatttactttagaacagtttgattgttttagggcttattcttcagattttctaggcagaaccagagacactttaatccagggctcattatttctcactgctgaggctgtacccttctcaatactctacctaatgcctgtgaattataaggttttccagcctggttgatgggaatagacactattcttgaccttgtgggttctttctctggccttgggtagttttctaacacatataatctgatcagcactccactgaatacttgagggaaaccctttgcagatctctggagttctctgtttgtgccactcctttctctctggtactctgtctataaaaattgaattatcttggtatattctttctggaaaaattttaaactacttaagggttggtaagttaaatttttctgggaatttgtccatttgcctttgtatttcaaattagtaggcataaagctgttcataatattctcatatctttttacatctgctgaatctgttgttaggtttcctttttcattccttatatatttatgcctcttcttttatttctggaccaattctcttatccatttttaaccctgctatttctttagaaactcaaaatagtttgattactgctattgaaaatgctaaacagaagattaaatccagagtttaaatagggaggagaaatgcaatcttaacaaaatgactctgtgttaaacattaaagaggccagtacagtggctcatgcttgtaatctcagcactttaggaggatgaggcaggtggatcatccaaggtcaggagttcaagaccagcctcgccaacatggtgaaaccctgcctctattaaaaatacaaaaattagctggatgtggtggtgggtgcctgtaatttcagctacttaggaggctgaggcaggagaattgcttgaacccaggaggcggaggttgcagtgagccgagatcgtgccactgcactccagcctgggtgacagagcgagactccatctcaaaaagaaaaaataataataaataaagatacccattcttttctattcaggaggccttcaaaaattttgtgcataaaaatcacttggagtgcttatttaaaatgcagatcacaaggcatccccctctagaaagtatgtagcaataatagtcctggctatggtcctggaatttgcctttttaataagcacccaggtgattctgaagtatgtggctggaaaactacactttgagaaacatgctctaacttgtgctacagacaaaaggcttttaaaatccccctggtgcctggtccccaggctgcacctttcaacttacatctgtagctttcttatccacaattcccctcaccttcaccttaccctcaaataagccctctggatgaggcttgtactcactcatctcctgctgagacaacatttttttttttcttttgagacagagttttgctcttgtcacccaggctggggtgcagtggcgcaatcttggctcactgcaaactctgcctcccatgttcaagtgattctccagcctcagcctcccgactagctgggattataggcacgcaccatcacgctggactaatttttgtatttttagtggagacggggtttcaccatgttggccaggctggtgtctaactcctgacctcaggtgatccacccgcccttggtctcccaaagtgctgagattacaggtgtgagccaccataccctgagacaacattttgtaataatctctagaaccaatttttaaatttctagtctagtcaaatgcctgagtttagcctcagggcactgtccagattctaacacatctgttatttcctggaccagtagaaagtggaccaaatcacctgggtttttggttcagacactcactacaaatggagcaggacttgagagcagattatagaagtatatatcttttttaggagccaggcctctctagggattctcctattgtaggtaaagaggctcctcctcaggtagctgaacttccagattagattagtgtgttcgtcaggtatgaagtagagaccacgaggcatctagacctttgttatgcattctggtaggccttccgtatggctcatactgcacccaatctgtatactgtctcactaaccttcttaccttactgctgttggctggtagattcccctttctgtcaagtctcaggggaatcactgcagtgctgacaactttttctagggcatcaccagtgagagcatctagggcctttcaaaaagtactgtcagatgccacgttctgttctccaaatattgtggatttcctcatatacaaatgaatattctggggcatgccaacccgttttctttatatgaatgtgaaggatctttgttcaaatgttaaaggatgttgaaggtctgattgagattcttcttcttcaaaggataggaattgttgtagtagagggataggtttgctgttgaggacgtttagtatctgaagagaggattaattggacaggtaaattttctcctaaattttgccgactaattatagaatagaatgataaggtattagccctggatgggcccttgaaagtcatttgaagcagtctcctagtaaaagatacagataagaaaactgaattccggaaagcttaggtgttttgtcagaggtcatatggctgtttggtggctgtactataaatactaaaatataattgttctgcaatttttttaaataattgagatagggtctcactctgtcacccaggctggagtgtagtagcatgatcacagctcactgcagcttcaacctcctgggctcaagcgatcctcccacctgaccctcctgagtagctgggactacaggtgtgtgccaccatgcctggctaatttaaaaaaaaaaattgtagaaatggggtctccctatgttgcccaggctggtcttgaactcctgggctgaagcgatcctcctgcatcagcctttcgaaatgctggggttacaggcatgagccaccatgcccagcctgcaatttgcatcttactaattatgagtctgataaaccaggagctgacagattaggttaccaacagccatagattaattgaaatatttactagggtatattatgtctaactaataaagctttatctttgtgtttcaggactaaaaaccgaaaactgtattgagaacctaggtaagatagctttaaagtcttatccctataataggaattttatcagttacttctcatagctatgggtcagagctaccccaccactgtactgtcgttctgtcaaacatcattttctcaaggctaaattgtgctactactgctagtaccttttcaggtggagagcctaggagcctttgctgccagtccccactgccaccctcatccccaccccaagacttgcctgtggctcttctctcagacactgcattggcctgggcatgaagggaacacgccactgtcatctgagcctgaccttataggagtttaaggactccttaattcccctacatcttcagccatttcccacttgactcctatgcaaagagctagctcctgttcctgtattttgttatcttaggaaataacatttgggagaccaatgaaggaatggcatgaatataggtcgaggaaggaggagaatgggatgacagaagggtaatgcggtagattttaacttcctcggggaaaaataagaggatgtgaccaaaaaaaaaaaaaaaatctttcttagaggactatgggaaagatttgggaaggcagacagaaaattctaagagtattaaggaacagcattatcaaagaggcctaataaatttgaattaaagataccaaaaatgcctttggattaagacatgctctgggtggatccttttgaagatttcctcattaaaaagtttaaaaacataccaaaggtatcagaagagagagaaagaaagttcaaaagcaaggttctgtttctagctgtttttctggctagctttcctgtgaatttttttttcatgtaacttaaatgaatccacatccagaggctgaggcgggtggattgcttaaggtcaggagtttgaggccagcctgggcaacatgtgaaactggctctactaaaaatacaaaaattagccaggtgtggtggcaggcgcctgtaatcctagctacttgggcggctgaagcaagagaattgcttgaaacccgggaggcagaggttgcagtgagccgggatcgtgccactgcactccagcctgggcgacaaagcaagactcttgtctcaaaaaaataaaagtgaattcacatccatttgtctttgaattgaaattttatatctcttatagtaactgtatttttatgtttcttaaatataagccaacacaatctttatttttaatgaacatttaaaaatagactgatcctgacattcacatctgagcatagtaccatgtaatgaaaacatgtctgtatttcagaatattttcaacccatctatgtctacaaccctggtgagtatgttctaatttttaaaaataatcttggttgggcatggtggctcacgcctgtaatcccagcgctttggaaggccgaggtgagtggatcacttgagcccaggagtttgagaccagcctgggcaacatggcggaaccccatctctacaaaaaatacaaaacttagccaggcatggtggtgtgcacctgtagtcccagctacttgggaggctgaggcaggaggatcacttgagtctgggaggcagaggttgcagtgagccaagattgcacccactgcactccagcctgggtgacagggtgaaactctgtctccaaagttaataataataatccttacctggatgtttaatagctctttcttgtttagcaaatgtatttcttagctgaagaaaatttgcagatataaagcagtgacttggcctatatgagaggaaaaaaataaagaacctattctagggaaatataccttcctcaaataagagaattggcttcgtggagatctgaacaatatggaaattttccggggaatacgggtggtgagaatgaagagctagagtcattcttgaccagttatgagggcttcttaggtatagctctgtattcagtcattgaaatgaacctgtgtgactccaaatactcagacaaaaatacaaaactcagcatgtttgcatctctcaaatatgcagatgcttgatgtttactatgatttaactaaaatatgtaggtgattagatgctcttaaagtttccactgaaggatatatggcccaaatcatttctttgcacataagttccttatcatgtgtttggctcatgtggctacaataaatttttctttgttgaaaagagaagaggttccagcctttttaaaacatgcaatttatttcatgtttgggaaaatacttcctgtcctgatagaagtgaagcactttataccttgaagacttgcttagcagcccttctttttattgttccgttgcagtcacaggttctactgatcacttcccagggactttagctgactcttcaacaaagacattttctcggctccttgagatccctggtagacaagctatttgtaatgacttttcttaatagtaggggcagagaatgttccagctcattagccaaggtacatttagactctgaccgacaacttaagtttagtagggtagtttcctggacgtatcaaatggttctttatagtcatatttcctgaaaataattttgctgtagcaatagtaactgccagttcttttgttccattgttaaaactgatgaacttcttttctgtgactcaggtgagaaaaaccagaagcttgaagaccatagtaagacatttttataaattctgggggcttggccaggcgtggtggcttatgcctgtaatcccagcactttgggaggccgaggcgggaggatcatgaggtcaggagattgagaccatcctggccaacatagtaaaaccccatctttactaaaaatacaaaaattagctgggcgtggtggcacatgcctgtagtcccagctactcgggaggctgaggcaggagaatcccttgaaccagggagctggaggttgcagtgagctgagatcgtgccacagcactgtagcctggaaacagagcgaggctccgtctcaaaaaaaaaaaaaaaaaaattctgggggcttgcattttgcaagatacctccctttacaggtgggaatattttcatatttcttgcaaataattttgctgtagctgtagtaactgccaattcttttgttccttcgttaaaactgatgagcttctttttgtgactcaggtgagaaaaactggaagcttgaagaccatggtaagacattttttataaattctgggggcttacattttacaagatacctccctttacaggtgggaatattttcatatttactgaaaataattttgctgtagctatagtaactgccaattcttttgttccattgttaaaactgataagcttctttttgtaactcaggtgagaaaaaccagaagcttgaagaccatggtaagacatttatgtaaattctgggggcttacattttgcaatatatctccctttacatgtgggaacagggaagaatgtcgtggtaagaaaagtgggaggaaggcagagctcaccttagcttactggtttggtatattagagactctcctgggtttcaggtagaattctttagaaaaatgacatagcagctctgtttctcctgtctaacaatctttaggtcatcccaccaaatagaggaaggtgtgactaattattccccacattcttgtgacctctaggatattgggcagggcataacaaatattgttttttctaaattaaaatgactattctttgtatttatttctgtcaccagcaatctgattaatatatgccattagctatatccatttgattatttagtacattccaagtgtaacttatcctcaagtatttgtttttgttttatttttaatattactcaaatggccgggcggggtggctcacgcctataatcccagcactttgggaggccaaagtgggcggatcacgagatcagcctggccaacatagtgaaaccccatctccactaaaaatacaaaaattagccgggcatggtggcacacgcctgtagtctcagctactcaggaggctgagtcaggagaatcacttgaacctgggaggtggaggttgcagtgagccgagatcgcgccactgcactctagcctgggtgacagagtgagactccatcttggaaaaaaaaaattactcagatgtcctcaaggataccgggacaggaacagtctcataaattactggcgagattataaattggaacttttttggagagcaatttagtagtatgtattactagtcttaaaaatgtttgtaccttttgactcggttataacacttttggatatttgtcccaaggaaattagagatgaacacaaagatttgtgtacaaaaatgcctatcacagtgttatggtagtgtcaaaagacaaaattacaacaaatttaaagagatcaattggctttatttgagattctagaattgggcaacactttattccatagaataagcgttcattgagctgagcacagaagtttggctttaaagacagagaagagccaaagaaagtggaagcaaagaacagagtatattaattacttttagacagaacagtagaaaaataactgattagttaacatcagtttatttcaggctaccttttttgtgtgtaaggattgaagcatcgggaacttcatttatcaagctgattgaagattttaaaatggccaatttgggaaattctgttatttctttctcctgatttcttagaagttcagacaacttagtttagatgatgtggaactttagcatgggtgactccatttcgatttttagtctggtctgttggggccttctgcagaaacttagtctgaagcaatggcctcctataatttttatttgacagtagcaaaaatttagaaacaacctgtgtccaaccattgggtattgttaaataaaatattatctatattatgaaacactaagcaacttaaaaatcatgttttcaaaaccatctaaagatagaagaaagtactcttaatacaatggtaaataattggatataaaactgcatatagagtataatattaacttttaaaaatgtatatgtatatatatgtatgcatagcaaaatgattgaaatacaccagaaatgttaagaatgagtagagtatttccgagatctgcagttttaagagaactttaatttttaataattttctgtatttttccaaattatctataacgtattatatagttaggaagcatattttatatattacatataatgccaattttgggtcgaggtctttgggttgaatttttaaaaaacgaacaagaggtgcttaacctaggagagattctgggtcactagccttagttcttatcatcagttaggctccagtgggttaaatctcttctttttgttaccttgtcctctgccatttctcaaagcgttctgagttttctactacagaagtcaagtataaggtcaaattaattttcaagctgattgcatttttttactaaatagttcttattctcgtccttaggaataaaaagccagaggctcactgtttcacctgggaaataatctatttactgagactagctacatggttaggagacgataaggattcctaggattaagaacattgtgaaaagccagcacagtggctcacacctataatcccagctctttgggaggcgtaggcaggagaatcatagtgagttatgatcgtgtcattgtaccccaccacagcctgagcgactcagcgagaccctgtctctcaaaaaagaaaaaaaaatgttactgagcctggagagtttgaggaatgagttagacaagaacaaagggacttcatttattgagtaccttttttcgctccgtgcagtgtaccaagcacttttatgcagtctttccttcaatcttcactaactacaaacctaagaggtaaatatttctcttgcaaagtgagaaactaaagttaggagggattaagtagtctgcccaaagtcacagagctaataactataattacgatagagctaaaccaagcagaaatgtaaaaccagtagtgtttcatccaaaaactgatatattgggactgccttctgaagataaagctggagagacgggttagatcgtggaagttcttgaagtccaggctaaggagtttggactctgtcacatggagaatgaagagccattgaaaggtgtttttgttgttgctgtttcttttttctttccccctgcctttttttttttttgaaagttggaaatggaggaaatatagacaaaagaagagtattaacagtataagataactgattaatacaaaccaatatttatttctgcctttaggtgtgaaaatccttgaacccacccaaatacctggtaagacagctttctatttactccctgagcccaagaatgagttgagcaggattcccaggcatttaagagaatactgtcatgagactattattcatgaatatttcccttatagctacctgccagtcatctacaaatatttagctggggaagtgtagagaagtctctttcctcctgtgcattcatgtgctcctggagcattgtctctggggcaggaaagttagttctgctctggatgttgctgagggaaaggctcctgggatctggatgcatcagtccaacaccttccaggttctacagctaaagttattcaatagaaacctacctttacgcacaagttgactgttagtcttggctaacatctcattgcctgtatctccaggtaacaaaacacgatattctcctggcataaacatgctcagtgaagtgctatggcagaagactcctctaatcatggtgtggatttgtataataagggtttacgtaagcagaacttttaaataaaaagccagaaactatagtgcattggggccttgggtgcttgcatctcttaagctcagcagacaagagtttgaaaattatactcagtggagcaaactgtaagtcattggaaacttccttctcatttaggaatgaaaattccagaaccttttccactacctggtaagcaactgataggcatgccagaggggaacatgccagtttggggagtacagtcaccattagatatgcatgggactttctatgcctcataattgtcatctatcaaatgtagccatcagtagtcacatgtacatgacaggaatatttgtaaggactataaaaccatggaatctcagggtgcaagccactgtccaatgcataaatccctttctcctgagttcatgtagtactttgaaatatttttttgcaggttttgttattatggaaatgatgatctgttaaggaaattagatatttggcatcttaaaaactatatccagccacacagtgctgaacttcacgtaacgctgctgtcaatggaagctgcgtgctgtataaagaaacagcgttttccattagttaaataaaggctcagagaacataggctcagagaaaagggtccaggacctcttttatattgacccaaatttgcactgttggatttatttggccacaactttgaagtgaacctctagtgacactgatgacacaccttgtgcgtctacatctcttcagctcgctagtcctgagtttgcacagtgccatcattggggtcttgctcatctggctatctgaaaggcagccaccgagcatggtgggagatgaacatgagctgtgtagacagatagacctggcttcaggaagtctctgccactttcctctgagtagctttatataagttacttcactttctacgcccctgctttcacatctgtaaaatgaggaaagcttctgtcttgcaggactgatgagataaagtacctagcaaagtacctagcaaaatgaatggtggtaacatagtagtaaatggtagctgcctttgttattatctgaaaacctctttcttgtttaggaataaaaatgatacaactgaatgaaaaacctggtaatatattctttattgggggtggaggcaccatggattctaagtcctttaccataatcattcagttagttcagtcttatggggtctggggaagacatctgggctgtacactttccgatatcccagtctgcaagccagacagggaaagtgttgagaatttctttcagtgtgagcagcaggctgctattacggttctctgggccaaacatcaaaaaaggcacttgatcttaaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccagtaggccactagattttgttgggactacagtgtattgtgccctctcctggaaagctatgtgtagctttttaaaaggtgatgtgaaaacagtacacaggagctcatttaatccaataagataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggcttcaaagctgttaaaatatggtaatatcataatatttctatgctaggcacacacttggtagtacagatggtctccaagttacaatggtcagtctgtaagaaacacgaaaaggtggcttgccagttaggacagatttattttagagaaaacaaacttgagaggcgccttctggccgagttaggttagaagcccacttttttacagactaagagtttttaaggatttagggtgggagagtttatcagaggcttggactgcttctgtgtctctttgttgtgcttatctgggagagagcgttgtgtgtctgttcccatacatcattctgcagctgcaggcatattccccaagtctgcttttagcttccctaacttagtgcacctgaagagaaaggaatgtgcttattaaggcccactgttttactggggcccactgtatgagggcgaagtttgggagttactcaagagactttccccccacctccctttgtgcccgagctgttttatctgtgttttactgtttgctccttctggctgcttgtagttagaagaggtgatttccttgaaatgcatgaggctagaaagggagctcgaatttaaagtggtggtgtttgtccaagatgacggtgctcctgctctatcaggttcaacttgggattttttgattttgcaatggtctgaaagccatacacattcagtaaaaaccatacttcaagtacccataccattctctttttcactttctgtacaatattcaatagattacatgagacattcaatattttattataaaataagctttatcttagctgatttcgcccaactgcaggctcatgtaagtgttctgagcacgtttaaggtaggctaggttaagccatgatgttctgtaggttgggtgagttaaatgcatttttgacttatggtattttcagcttacattggatttattgagacacaaccccatcataagtcgagaagcatctgtatagcatagtaattcagagcaaatttgaaattagatatttctagcaccaattacacccgtgattttatgcatggcattcctcaaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaaacccttcccctaaccccacacatacccgtaaacctattaccctgcccctcagacccactcacagagataaccaagtttgcttaatttttaatcagatctttcttttctggataaacagatatacaatataactaactcaaaatctctttatattttagaagataaaagtcaaggaaatatcaacaatcctagtaagaagtatctcatttcctcagttgataaatgcctgcttctgtaatatagaaaaagtgagaaatttatttttcctcaataaagggaacaaagttgcaaggttttaaggcatcttaataacagagtataatgtcatatccaaaagcttgtgtgtgcatgtgtgtgttggggacaatatagctttgttttttcgataatcgttttccattgtatctagagtttctactcttagaacagtggttcttaccagtctgaagactgggagcaaaatataaaaataaaaaagaaaatatatattaaaaaaaaaaagaacagtggttctcaacccaattctccctttataacaagtattttataaagtccttatattatccagaaagaagatccatagatgagatgcatttgtacccataaaaatcaacatcatgtctaaagtagaccgatgtttacatttatgcaaataaatttgggttgaagagaagattggaagctattctatacaggaagtataagaaaatggagtgaagaaatagagtagatactaaataaaaactgatgtttaatgtttatcaaaactattaaaaatatacataaaactgctttaggttctgagtttgattattttaaataggttttaacttacatgtatgtctagcagtacatttgaaagttgtgcaggaagttggtcaatttttcatggtccagaactagagcactgcaggatatctatccctctacctccactccactgttagcaatgattaaaaaaaaaaaacaaaaaactcttgacaatcgtccaaactgcctcttggggcagtaatgcccccctgagaaccactggtctgtggtaacatacagtcatgcattgcttaacgatggggatatgttctgattaatgtgttaagtgattttgtcgttgtgcaaacatcatagtgtgtacttacccaaccctagatggtataccctgctacacatgtaggctacatggtatagcctactgctcctaggctataaacctttacagcatgttattttgttgagtactgtaggcagcggtaacacaatggtaagtatttgtgtatctaaacatagaaaagttatggtaaaaatataaaagataaaaaatggtacaggtgtatagggcacttaacatgaatggagcttgtaggcccagaagttgctctgggtggtgttgagcggatgtgaaggcctgggacactactgtacactcctgtagactttatacatactatacagaggctacactaaattcataacaaattttccttcttcaatagtaaattaaccgtagcttaatgtaactgttttactttataaacttaattttaatctgactcttttgtaataacacttagcttaaaacacacattgtacagtagtacaaaaatattttttctttatatcctattctataaagcttttttatcaccttttttttaactttttaaacttttgttaacaactaagacacaaacatttacattagcctaggcctatacagggtcaggatcatcaatatcactgtcttgcacctccacatcttgttccactggaaggtcttcaggggtagtaacgtgcatggaactgtcacctcctatgataatgccttctggagtagctcctgaaggacctgcctcaggctgttttatagttaacgttttttaataagttgaaggagtacagtctaaaataatgattaaaagtatagtaagtacataaaacagtaacatagttgtttattatcagttatgtattatatataattgtatgtgctatacagttatacaactggcagtgcagtaggtttatttacaccatcatcaccccaaacacgtaatatgttacaacggcaacgatgttgctaggcagtaggaaattttcagctctattataattatagtcttatgggatctctgtcatacatgtggtctgtcattgatggaaacatcattatgcgttgcacgactgtactaatgcatgtgtgcatctgcctatccatttctctgtgtgtatacatccaactgcatgtttataactatggcaagtacattgataatatgaaggcttttacaaatctgactggctatttttcttggttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactgtggatcgaaaatatttgtgggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcagacaaactgcatgacctagaaatatatatatatataaaaagaaagtatgtcatgaatgcataaaatatatgtagatgctagtctatttttatcatttactaccataaaacatacacaaatctattgtaaaacgttagtatttatccaaatttgtgcacacagaccatatgtggcaccattcaaaatcaaaagaaacgtaaatgtaaagatgcggtattaaaacttaactgcataaaattaactataatacatactgtatcattgtaatcatttcatggccacctcctgttgctattgcagtgagttcaaatgtttcgagtatcctcttaaaacaccatgtgttgctaaacatctctgaggagttcatctccagtaaattgcacatcacagcaaaaagtgatctctcacagttctcctgtattttttgtcatgtttggtgcaataccaaaaaccttgaataacaccataggactcaaaggaagtgccactagtgaggccggaagtctcacaagcagagagaagccatgacattacaagaaaaagttgaattgcttgatatatagattcaggtctgcagctgcagttgccagccatttcagacagataattcatcttataaacagatgatgtaaactttgggtattagtaaatacagtacagtactgtaaatgtgttttctcttccttatgattttaatattttttctctattttattgtaaaaatacagtttatttatttatttatttatttgagctggagtcttgctctatcacccaggatggagtgcagtggtgcaatctctgctcactgcaagctctgcctcccaggttcacaccattctcctgcctcagcctcctgagtagcggggactacaggcgcccgccaccacgcccggctaattctgtatatttagtagagacggggttttgccgtgttagccaggatggtctcgatctcctgacctcatgatgtgcctgcctccgcctcccacagtgctgggattacaggcgtgagccaccacgcccagccaaaatacagtatataatacatttacaaaatatgtgctaatcaattatttttatctttttaaaaatagagatggggtctcgctatgttgcccaggctcaaactcctggtctcaagtggtcctcctgccttggcctcctaaaatgctggaattacaggtgtgagccaccatgccccaaccagaatacagtatataatacatataacatataaaatatgttaatcaacaatttctattatcagtaaggcttccagttaatggtaggctattagtagttaagtttttgggaatcaggttacatgtaggttttcattgtgtgggggttggcaccccaacacccgtattaagggtcaactgtatatggaaatatagcctgaaatctgtaatgaattacacttatttgaaaattgcttttggctggaagtatttcaggtaagtttctacttcaactttagtgtcattgtttacatattcaggatatattttataggtggatgatacttgacataaaaaatgatgtgtcagtgactgtgtattcttgttaacagctccaggtccagttcctgttccaggtcccaaaagccatccttctgcatccttgggcaaactgctgcttccacagtttgggatggtcatcattttaatcagtgtttctgctataaatctctttgttgctctgtagtttgatgcattgtttatctttcttattctttacttgaaataactatagggatacacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttcagaattgccagtatgctcaatactgttagtgtttaacatcaatttaatatctgaattagaactttaaggatagtctactcatctctttgtcttagtctgtttgggttgctgtaacagaccactgtagactaggtaacttgtaagcaacatttatttatttctcacagttccagaggctgggaagtccaagatcaaggtgccagcagacttagtttctggtgagtgtcctcttccttgtcctttcctcaccatctcacatggcagaagggacaagagagatagagcactaatcccattcatgaaggctccaccctcatcatgacctcccaaaagccatacctcctaaaatcaccatattgagtgttaggatttcaagatgaattttttgagaacacaaactactcagtctataacacttgcttcgataactgagtctagttatctcaccagttatatgctcaaggaccacaggcctgccttatatatgcagtcaccagtgggacagaaacccaacaggatgactgggcctgcctttttaaaaggctgaccttaggccctgtctggtatatttatctggttgaactagcaaccagcaatattagaacatgaaaaatcaaaggctagagaagcgaccatggtatgcatgatcagtgatccatccactagattatatagctcagtgagtaacaattctcatcaattagaccaacaactcttcctactataagggggtgtgcagagggacaaaaactcctatacttggctacatgggtaagaatgatggacatgcagatcttctgggccacggagaaaatgtggacaaggcaagaaattcctgtcccaacactgttggtattgcaatataatgggtaggaaagaatgatgagagggtagtagagtagtgtaacaaatttacacaccataaacttggcaaaagtagctgcatacttctggcagtcaatttggaaagaaacaatcagttttaaagttcctagtcttggccaggcatggaggttcaggcctgtaatcctagcactttggcaggccaaggtaggaggattgctggagtctaggagttcaagaccagcctgggcaacataacaagaccccatctctacacaaaataaaaaataatagccagttgtggtggtgcatgcctgtagtcccagctactcaagagtctgaggtgggaggactgcttaaacccaggaggtcaaggctgcagtgagtcgtgattgtgccactgtaccccagcctgggtgacagagagacttgtctcaaaaaaaaaaaaaaaaaaaaaaacccacaaaaaatcctagtctacacaactgtaacctatacaactgaggagaaatctcttcagtggattctcagaggatggactccagatagatatacagtgcatcacactcttcaccatccccatagtaaatacaatagcaagattcatgggcctgtttcttctaacacctgtcaatacaagccaaagcatcacagagaagtgcaaagttaaagcatctcaaaagcggccaacatgatgcagcccaaatatagtgtagtcagaaatactgtttaaaatgatccactggttaaagacccactatttaacactacttaatctgtttaactcagattttctagtatttcgaatactaatgacatattagggaattcttaatactagatgatatctgaagtaagttttacttgccataccctaatcaaaa

SEQ ID NO: 11905 - DNA, 54161 bp, Human
  misc_feature (1)...(54161): n = A,T,C or G
atcccagcactttgggagactgaggtgggtggatcacctgaggtcaggagttcaagaccagcctaggcaacatggcaaaagcctgtctctactaaaaatacaaaaaattagccaggtgtggtggtgggtgcctgtaattccagctgctcgggaggctgaggtataagaatcgcttgaacccgggaagtggaggttgcagtgagctgagatcatgccactgcactccagcctgggtgacagagtgagactctgtctcaaaaaaaaaaaaaaaaaaaaagacatggcttatgattttattctattatctacctaaaaggaaaattttgacttcatatagttaatattaaaatgataaattatataattaaaaaaataaacatgctttgattttcttatatttttagagattacagtatttcagtaactatcaaggaaattattcattgtttaaaaatgtgtgcatttatcatactatgcccttgaatatcttttttcgtttagtttatacatgaaagcatccatgatgaggttgtaaacagacttaaaaaggcctatgcacagatccgagttgggaacccatgggaccgtgagtatctccttctgctttcaaagcgatccctttttgagagctgttgttaacaagtgtttctgatctgagttttggagtttctttccctttcctgagaggcgtgaaggcacatgaagcaggttattaggctttggtgtatcgtgtctgctcctaggtttcgaccctggctgcttgatgtgtgctagtgggtgagactgggagaggttgtttagatggaatgagatttagtgtgcttctctctcattactattacccttgtccaagccgacaccatccctcttgtgcaaggctgcaagaatcccctaactgacctttctgcatccattgctacagaatgatttttaaaatgcaatcagataattcactctcctgcttaaaatacccctcagtaacttctcattgcttttagattttttttcctttcttttttttttttttttttttgagacacagtttcactctgttgctcaggctggagtgcagtggcttgatctcagctcactgcagcctccgcctcctgggttcaagcagttctcctgcctcagcctctcgaatagctgggattacaggtgcattccaccacgcttgactgattttcatatttttagtagagacagggttttgccacgttggccaggctggtctcgaacacctgacctcaagcagtctgcctgcctgggcctcccaaagtgctaagattacaggtgtgagccattgcgccaggcctgcttttagattaaaaccgagagtcctcttgatttcttcttttttgcaggctcccgatccttcctggtctgctctctgcctcctgccccgcttgccttctcaccagcctttctgtgtctattttccctcttgctcccagagctccaccttctccaacatcctttcagtgttccaggcatgccaggctctatcctactgtgctgtctgctggaaacattcttcacccagagtggggatggctctgctaacatgcctcctcctcatagaggcctacctacatcttccttcttctttgttgctgggtcactgtcagtgctctagtccccagcagccataacataggacagcatcattctcttcccccttgaattatacaccaactactgagactgtgatgtttccttagagaatggtcacactgtaatgagtaaactgaccctatattttgagtgcagtgctttgagtaattgatagccattcctttaaactagagattggcaaacagacttggctctgcctgtttctgtaaaaaaaagtttctcggcacatacccactcatttgcatgtcatttatggctgcttttgcactacaattacggagttgagtattgggatggagatcacgtatgtcctccaaagcataaaatatttaccatctggttctttatggaaaaaggatgctgacttatgttctcaattgagagcatataggaagggattggtctgttcattgagaaagctgttctaataataaaacgatgccataaagggcaaaatgatgagccagccttccttttctctctccagctaatgttctctatgggccactccacaccaagcaggcagtgagcatgtttcttggagcagtggaagaagcaaagaaagaaggtggcacagtggtctatgggggcaaggtaagggatgctctgagatcaattgtgacagctttttaaccttcttttccctgagacacaagcagggctctgggcatattggaaaagccaccccatttgacatccttcttctcctgtctttatttatatatattattataaaacaaggaaacacatgtttttgtttgtttgtctgtttttgagacagagtcttactctgtgcccaggatggagtgcagtggcgcaatcttggctcacggcaacctccgcctcccaggttcaagtgattctcctgcttcagcctcccgagtagctgggattacaggtgcatgtcaccacacccagctaatttttatattttttggtagagatggggtttcccatgttagccaggctggtctctaactcctggcctcaagtgatccacccaccctggcctcctaaggtgttgggattacaggcatgaaccaccacacttggctctgtttgtttttgtgacagggtcttgctctgccacctaggctggagtgcagtggtgcacgatctcagctcactgcaccctcttcctcctggactaaagcaatcctcccacctcaggctcctgcgtcttgctctgttgcccaggctggagtgcagtggcgtgatctcagctcactgcaacctcgcctcccaggttcaagcgattctcctgtctcagcctcccgagtagctgggattacaggcacccattaccatgcccagctaatttttgtatttttagtagagaaggggtttcaccatgttggccaggctggtctggaacttctgacttcgtgatccactgtccttggcctcccaaagtgctgggattacaggcgtgagccaccgtgcccagccagaaatacacgttttaaagaatgacaacaatgcttgctttggcagcacatatactaaaattggaaagatacagagaagattagcatggcttatgcacaatgatgatatgcaaattcatatccgtattttaaaaagtattccatattttaaaaaaagacagcagaaaatgcatgggacatttctggaaggacatagaagaaacggagtcatggttgcttttgaattgggtccttaatatttgtatggaaaggaaaattccttttcaagtacagtaggagactttgtattcagagcaattataatctatttattggttattttaaaaagtcagttaaggcaaggaataaaaaaatacatatcataagcattaaaaaagaaattaacacatattgccaggtgcagtggctcacacctgcaatctcagcactttgggaggctgtggtgggaggattgcttgaggccaggaattcaagacccacctggacaacatagtgagaccctgtctcaaaaaaaaattagctgagtatggtggcatgcacatgtagtgctagctacttgggaggctgaggtgggaggattgcttgagcccacaagttcgaggctgcaatgagtcatgatgatgtcactgcactgcagcttggacaacaaagcaagaccaaatcaaaaacaaaaaaccaaataataaaaaaaaaaaatcaaaaacaaaaaaccccccacatataaagatttgtttgtggccgggcatgttgactcacacctgtaatcccagcactctgggaggctgaggcaggtggatcacttgaggtcagaagttcaagaccagcctggccaaaatggtgaaacctggtctctactaaaaatacaaaaaaaatttagctgggcatggtggtgcatgcctgtagtcccagttacttgggaggctgaggtgggaggatggcttgaacccgggagacggaggttgcagtgagctgagatcaagccattgcactacaggctgagtgaaaataaccgcttgcagcagtgtttgttcaacataacttggttgtgtcacatggcatggctctctatccctgcctgactccttatttccatttttctctgaccaactaagttagaaccaatatcaggaagagagaattttctttcatgattggaagttattttggagaaataattcacctataaatgatgctaatttttttctttataaatgtaggcaaagattgcatcctctgaccccaagtcctagaaaacaaaatgctttcattctttttatttcatttctctgcattaggttatggatcgccctggaaattatgtagaaccgacaattgtgacaggtcttggccacgatgcgtccattgcacacacagagacttttgctccgattctctatgtctttaaattccaggtaaaaatgcattctgttcgctagcctaatgttgaaataaatgataagaggaaaatgatggtggattaaatttcactggatgaacctttaagagggttttagaaagtaatctgaatagtagatatatgaaggttcaggataaaatatgagataaacactttaaaactctatagcatgccaagctagctgccagggaaaccagattgggtagtggactagtgttggagtttatgaagtgtgtggtcctcatttcctgtgtcatcttaatcctgggctgtgtaggccatagagtcaccttctcctgaaccgtggtactggatagtttgatagcctgagtgctgtgaacatgtcagcagacaaaatgagaacatgtgggggtaatacaaagacctatagttggccaggcacggtggctcacacctgtaatcccagcactttgggagggtgaggcaggcagatcacctgaggtcaggagttcgagaccagcctggccaacatggtgaaaccccgtctctactaaaaaacaaaaaaattagccaggcgtggtgttgggcgcctgtaatctgtaataccagctacctgagaggctgaggcaggagaatcacttgaacccaggaggctgaggttgcagtgagccgagatcgcaccattgcactccagcctgggcaacagagtgagactccatctcaaaaaaaaaaaagacctatagttataaactccagcagaggacaggctgcggagttttgttttgttttccctgatctcatatcttgatctcaaactgtaaaggttttaataggtgaagaagctgggcacaatggctcatgcttgtaatctcagtgctttgggaggatcacttgaggccaggtgctcaagaccagcctgaccaacacagtgagaccttgtctgtacaaaaaaattaaaaaattagccaggtgttgtatgtacctatagtcctagctactcgggaggctgaggtgggaagagatcctgtctctaaaacaaacaaataaataaaacccaaaaaacccacacaggtggataaattagaagatctcattccctagcttgagacgggccctagcctcgccagtaaatatttaggattaattttgagactgcagagattgaatcaatatttgaatgtaccattattaacagtaaaataatagtgagaattgcatcttgttgcaattacatcattgcttctttatttcttgctttaaattgcctatcattgtttcacgtatggggactagagaatataattttgtgttttgtaatgtgtttgtgtacattatgaggctgtgtgagctcttgagcaaattagtctctgtaggcctcagttgcccaatctgtaaattgggaggtagtaggaaacctgtgttataggatgaggattaaataactaaatgcatgttaagtgcttagattggtgtgttacacacgtaagagctcaatagatattagctattatatgtagtagcttgaatgaaaggaagaatgtgttaatatttgtttctgataattaggggaaaaatcccaaaattttttacttattatcaatgatctgaattataagagaaacagagtgagtaaacttgactctttggtttccttttgtacactgaaattatactggtacacttcaggaaatgagtttaatgtcagtgaactttgacttgaacactataacatcttacagcttccaatgtctctccttttagaatgaagaagaggtctttgcatggaataatgaagtaaaacagggactttcaagtagcatctttaccaaagatctgggcagaatctttcgctggcttgggtacaactttgtctattttgaaaatttatataagtctgatttatgtggtgagtggacttaaaaaaactgctgtagtctaaaatcagtttttcagtattgaaagcctttgagctttggtttagattttttatttatttttgtttgtttttaatttcctgttcattgctctcaccatgcctccctttttacacagacctaaaggatcagactgtggcattgtaaatgtcaacattccaacaagtggggctgagattggaggtgcctttggtacgtagagaatcatttctccttttccatgttgggcagcaaagaaaaaccagtagtagcttttagaaaaggctgaccaagagactgaaacactccttatattctgaaataaccttatgtgatctaacatatctgaaaaagcttacattctgtattcaaagttatcgcatagagtcctgcgtcatctcctcagaggcagcatcaggttagagcagaggcccttaacttgaaatgtgtgaacccctgaaatggtggcatttgttttctggggagaagtttccagacccaaaaaagattaagaatccctgcttcaaagccagaaaattttatatgaaatattctggtttttatttgcaaagtaggcatataaatgttaaacatactctttttcactagatggaatacaaagttgtttcttttcactgggccctgctcctgtttcctcttaataagccatacattattaatgctgaaacttggtagtagtttttccttaaaaactctccctaaccattgtatattaagtattatttattaaaaatgatccaaagtaaaataaaacagattgcttgttttttttaaatatagaagcaaaacaaacatgcattaatacttgtaaaagtttatatcattagtggcattcttttacatttttagagcagatactacaattactatttgatgcatggactttgctgttttcagttcaccccttgcccctgcactccactgtgcagttgcctgaatgcatgagtgtctatcttctccttttgtactaatttaatccctgtttccaacccatgcctgctctctctgattgactattccttttttttttttttttttttttttgagctgggggcttgctatgttgcccaggctggagtgcagtggcgcgatcacagctcactgcagccaccacctcccaggctcaagcattcctctcgcctcagcctcatgaatagctgagattacaggcatgtgcctccacaccagctaattaaattttttttttttttttttttttttagaaacaggccctcactatgttgcccaggctggtcttaaattcctgggctcaagccatccacctgccttggcttcccagagtgttgggattacaggcatgagccactgcacccagtcaattgactattcttcatttaagcttttataattaatttttaaagttttggtgcccaggcacagtagcttacacctgaaatcctggcactttgggaggcagaggtgggccgatcgcttgagctcaggagttcaagaccagcctgggcaacatggcaaaaactcatctctacaaaaattacaaaaattagctaggcatgatggtgtgtgcctgtagtcccagctacttgggaggctgaggtgggaggatctcttgagtctgggaggcagaggttgcagtgagccaagattgtgccagtgcactcaagtctggggacagagtgagaccctgtcttcccccgcaaaaaaaaaaaaaaaagttttgggctgggcatggtggctcatgcctgtaattgcttaagcccaggagtttgagatgaacctgggcaacatggtaggaccctgtctctacaaaaattaaaaaaaactagccagttgtggtgtcacacacttgtattcccagctactcgtgagtctgaggtgcaaggctcgcttaagccaagagtttgaggctgtagtaagccatgatcccaccactgcacttcagcctgggtgacagagtgagtgtgaccctgtctctaaataaataaaagttttaaaaaagtcttataatggaaaaagtagttttgctcatacttttcttctcctcctcctttcccagaggctacattgagattctttttttttttttgagacggaatcttgctctgttgcctatgctggagtgcagtggtgcaatattggctcgctgcaacatccacctccccagttcaagcaattctcccgcctcaacctcgtgagtagctgggattacaggtgcacgccaccatgcctggctaatttttgtatttttttagtagagatggggtttcaccatgttggccaggctggtcttgaactcctgaccttgtgatccacctgcctcggcctcccaaagtgctgggaatacaggtgtgagccaccgtacctggccgagattctttttactaaaagaaaaaagcaaatttacctttgaattgatgtcagtttttctaactagtgtgctttcactgctgtctccttgaaagctttagacattatgtattgaccctctgttatgatagaggtttctgtccaggagcaggacacatgggagtcaactagtaggagaaagtagaagaagctgttcttttcattttcttcttggatgcacccagtacccttgcatactgaagaagcagtagaaaacagaggcagggagggccctgcaggcctggctagcaagcggagggcagtggggtaccagctctcagaatagtgagcatggtccttgaaagtggattagttcattcccccagcatgtgcgtagctggatagggagtctcttgggagattttgactaggacttgtttcttctgcttttattcgctctctccctactccctccctgcccaccttgggtagaaatagcttttattcaagtgcaataaaagagtttgttggggaagacccatgaggtgttatcttgtagaatgagcactgggtgaggaaccaagagacaccatcccagtcccatttactgctgtcactagctccggaacctcaggcaggtgctcagccttggttccttagagcctctgcgactctgttcctgccaggagtttcagaggcgctgttagctgtggtttgttttatttcaaatgtgtgcaggctttttgctggcttcccattctttgaagtcagttatgtctctttttactttgcttgtgcatttgagagctagaagggcaaacattcagctgtgatttttctggaacccatttaatggagattctttccctctcatgagaaagaccaggtgagtagttaatagagaagcttttatttcaaaattgttatattttcttaatgtatttctatcaaatgggaatatttgtgttttccctgataatttaatacaagttattgagagagataaagaagacagttacagctcccatattcttgtgccctgctcaaaagaaaaactatgaataacatgtgtgggctgggcacggtggggttacaggcatgcaccaccacgcccagctaatgggatttttttttttttttaccgtttctttctgtttccatttcttcttaattccttatattttattttccctcttaattccttttttctgtttgttttggtctcttggtctctgtctttgatttgtttgcaggggagatattgtgggctaaatgtaaagtaaataatcaggttgttctggtgtccttttggtatcttcttttcattgataccaactatgagcccacatggaaactgctcagaagatatgatattattttttatttctctaggaggagaaaagcacactggtggtggcagggagtctggcagtgatgcctggaaacagtacatgagaaggtctacttggtaagaaaaggctttgggaagataggtttgggcttaaaacccttgggaatgggcttttacactttcctactgtctgtgctgtctttgtgcagtgtcatttgatttgatttttccagcattccacagctgtctcctctaagtatctatttggtgctatttttctagccttcttgtctagcttcagctagtgcccagcacccaacaatgaaatggtctcgtgcgtggtttctgtatttttagtagagttggggtttctccatgttggtcaggctggtctcgaactcccgacctcaggtgatccacccgccttggcctcccaaagtgctgagattacaggcgtgagccacagcacccggctaatttttgtatttttagtagagattgggtttcaccgtgttggccaggctgttgttgaactcctgacctcaggtgatctgcctgcctcggcctctcaaagtcctgggattacaggcatgagccaccatgctgggctgtttcttgcacttttgagggcacacttttttttttttttgagatggagtcttgctctgtcacccaggctggagtgcagtggcctgatctcagctcactgcagcctcagcctccgcctcccagattccagcgattctcctgcctcagcctcccaagtagctgtcatcacaggcctgcaccaccatgccaggctaatttttgcatttttagtagagaccgggtttcaccatgttggccaggctggtcttgaactcctgacctcaggtgataccacgcctgcagtggctcatgcctgtaatccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagagtgagaccctgtctcaaaacaaaacaaacaaacaaacaaaaaccaccaacaacaaaaaaaaccatgtatggtatgtctttccagatttttatgtttctgtcttttttcttttaaataaaacgggatccatactaacattgtcttttatcttaaaggtttgtcttaaaaagttgtaacttggagatcttgccttgttaatatatacagatctgctacattttaaaagtgggcatgaaaatcttctgttatgtatgtactgtcattaattctgttattttttcccactagtactatcaactacagtaaagaccttcctctggcccaaggaatcaagtttcagtaaaggtgttttagatgaacatcccttaatttgaggtgttccagcagctgtttttggagaagacaaagaagattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttacgcctataatcccagcactttgagaggccgaggcgggtggatcagtagaggctaggagtttgagaccagcctggccgatatggtgaaaccccgtctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctattatgtactctgcttcctactttctctttcagggtgggaatctgttaagcctcctctctctcttgctctgcaaccacagaacacttctttttttttggtgtctcagttttgcccacactggagtgcagtggtgcaatagtggctcactgcagcctccaactcctgggctcaatctatccttccacctcatgctccccagtagctgggactacaggtgcatgccactgtgcccagctgattattatttttttttgtaaagattgggtcatactacattgctcatgctcatcttgaacttgtggcctcaagcgatcctcctgcctcagcctcttgagttgttgggattacaggagtgtgccaccatgcccagctctgtggaaaattctctgtggcattctgtctcctgaaaatgctgaagggaccaagagggctctgtgtccttcctcttctcttccctggcactttcagaccattttcttgttgccttcattctaacaaaggttgcagattggaaagctgatttggaatgctttttaagtgttttcagtttcaatatttttatgaaattcctatggtctccaacaaacttttttttttttttttttttctacacctggagcttatcctgcagaagcttcctgccaatgattgttttggaggaaattaaaagaaaaccaaacgaaacctctcctatccaaggggaagaactttatccccatattgattgaatataggattctagatttaaaatgttgtaggcagttagagtttgctcttttttttttttctattggaaaggtccacaaatgttttattgacatttttgtctttaatccatttggatttggggtacatgttacgatttgtctacgttaatttcccttttaaaaataaaaataattcctcaactccaattagacaattgggttgtccttttcacactgatacctcttttatagtacactgcattcttacatataacaggatctgtttttagctgtgtatcctgattcagtaattggtatatgtgtgtgtgtatatagataaatagaatgccatttccctgtgcagacggaagggcaagcttattcccttttctgcgactacatctcctgtcaggtgtcgcctctgctgtggctctataggattctgttagatagtggtggtcattgcacaactctacaaatatactaaatgctactcaattgctcattttaaaatggttaaaatggtgagttttatgttgtattttacaataagagaaaaaaacatacaaagcaaattaagcaataaaaagggcagttactaactccagggaaaataacatttgattctgtgatcttttaaatttcttctacttaaattgttttagagttctacatatattagccatgtgacctgcaaaaagtaacctaatctctttgaacttcattttcttgtctgtaacgtgggttgtatcagttcggtttctttgtggcaagctgcggaaaccaattatggctttagcaaacatggtctgttttggaaagcccagatccaatttgcctctccagaaccactctctgacattctcctgcagtgtgtccttagggactgatctctacggtccacttcatctgggcttgctttatcctctggcttctgattgtgtttggccagtggtagaaaatcagagcagaaaaaaaaatgtcagagtattaattttcccactccttccctgccagtctgtggtagttactgtctttttttttttttttttttttaaggaaaatgtacacaaagcgtgtttattgggatgatttctcattcatcctgatcacggttgctgcttcctcctaaggaacattcttctgtaagctttgcttgtccttctgtaggctgataggacagtggaacagccaacacacacaactttgggcatgacgaaagagcatggtgacttgatagcatcctggtcatttcacatccatgaagaaggaattggttcgtcaccaggagcttctcatgttttctggagaggcatgaaggagatccttctctagagacatctcgctggaaagcttattcctttttctgtgtctacatctcctgttagatggcccctctgctgtggctctgtagattctactaacatgactccttttttttattctttagtctgcaagtggagatggaattctgttgctattttctgagtttgtctccttacctctagggacctagctaggtaacaggtaaaaatcaactgtcttgtggaaacgccactgctagaatgagtgaacttcaactgtttttaggctttttgtttctcaaaattaaaactgcaggaaaggaccaagcaatttgcctagcatggatcatttacctttaaggtaatttacctgccccttggcaaggggagagcaaagcacctggattaatagtcctaatgctgaaatcaaggacagataattcccctaaaagaaatgagagttgttatcctaggtaagaaacacagatgctgctaagcttaaataatctatttccactgtatgaggatgctgataatatctgtcccatacaattgttaggattaaagcgtaaaattataaaagttaacagtgcctggtaagttcatgataagggctcaataaatgttgggtactgttattaagatgttttccacattcgttttcagcttttaatattttaattattttcctaaataaaatttagaaacattttccaggtttttaaaaaatttctttgggatttttattggactcaaatttataagttaggaagaactaatatataatacttagatcttaaaaacatcaatgatacgtattttgatcaaatttttatggttcctagcaaaattctgcagtttatttcatgcaacgtcttaacaacttttgtgtttattcctatatattttatgatttcggatttttttttttaagtctctgttgcccagtctggagtgcagtggtgctatctcagctgactgcaacctctgcctcccgggttcaagtgattctcatacctcagcttctggagtagctgggattacaggtgcgcaccaccatgcctggctaatttttgtatttttagtagagacagtgttttgccatgttggccaggctgccttggcctcccaaagtgctgggattacaggtgtgagccaccgtgcccggctcagttgttacggtgaatgggattccccatcttatgcataaattactgcagagaccagttacttcctaaggtagattaggtttgaaaatagaaatatagatccaacaactactcaatgtttgctatttgcttgttgagaatccttacagcctggcaattccagggttatagaaatctggcccacattcagatataattgaattgtctttacagtgttgacctgtaggtgtcactgttggtcaaagcaatcatctgtttagcagggaagtgagtcgtgttgactttgtatccaggaggtcaccatggaaaagtttttgcagtcaacagacaatgccccacatttatgagctgctttactttccagcaccattggtaacttgcctttcctactgcctataattgcaggtttgtatcttttaagttaaaaatgtggctggacgtaatggcttatccctgtaatccaaacatttggggaggctgaggagggagggttgcttgagcccagaaatttgagacaagcctaggcaacatagtgagaccctgtcctaacaaaacaaaacaaaacaaaactttttttaaaaaaattttccatccattcttctttccctgcagtgagcatatgtgtgaggttattccattttgaataactccatgggtcattcgttttatttacacttaaatgatgcttactgtgttccaggcacttttaaaagcacttggcaaatataaacccatggaattctcataaccctaggaaatagatactattatgatcttcactttattgatttggaaactgaggcacagagaggttgagtaactttccccaagtcacacagctgataaatgatggggctgagatttgaatccaagtagcctggcctcatagtattcttgtgaatgtgaatagtgtccctgaaatagcagagttcttatttgctcaccttccctgtctgactcttaattgttgacttttccttttttttgcagtgtcttttattgtgacataatcgtaacttaaagaaaagttgcaagtacatagaacttttccccctaaattatttgagaatgttgttgatctgatgccctgttactcccaaatgctttagtgtatatttcccacagacaaggacattttcctgcataactacattacaaccatcaaaatcagaaaattaggattgatgtgtgtattagtctgttctcacagtgctataaagaactacctgagactgagtaatttatgagaaaagaggtttaattgactcacagttccacaggctgtacgggaggtgtggctggggaggcctcacgaaacttatcatggcggaaggcgaagggaagcaggcatggtcttcacgtggtcggagccggaggaagaaagtgaggggggaagagctacacactttttttttttttttttttttttgagacggagtctcgctctgtcctccaggatggagtccagtggcgtgatctccgctcagtggtgcgatctctgctcactgcaagctccgcctcccctcccgggttcacgccattgtcctgcctcagcttcccaagtagctgggactacagacgcgtgccaccatgcccggctaatttttttgtacttttagtagagacgaggtttcaccgtgttagccacgatggtctggatctctgacctcgtgatccacccaccttggcctcccaaagtgctgggattacaggcgtgagccaccgcgcccggccgcgctacacacttttaaaccaccaggtctcttgagaactctatcacaagacagcactatggggatggcgctaaaccattagaaaccacccatatgatccaatcagcttccaccaggctccacctccaacaatggggatcacaatatgtaagattcgggtggagacacatagccgaatcctatcaacgtgttactaatatctaatcctcagatcccgttcaacttttgccccttgtatgttgtcatatctctttagtctcttttagtcttctcttgactttcatgcttttgaaattacacgccacttatttcatagatcatccctcgacttgacgtttcctcataatgtaattcaggttgtgcatcttaagccctacactcacagagaaacaccgtattctcacctgcatcctaccaggcagtgtgtgatgtcatttccgtttgcccataccaatgatattaactttgattcttgattaaggtggtgtctgccagcgttctcccctgtgaaacatctcttttaccctttgtaaattaataggtctttgtgaggggagatactttgaaactatgaacctgtcctgctctccatcaaactttccattgattcacttatttatatttgtatgtacttaaatttttctattttatccaatgagttataatccatttattacattacttactttgatgctcgaactaaatttttatatccctgatttggccagcaggactcccttcaagctggcttcactgtcctttcaacacgttcctgtccttctctgagcacttcctttctttttggcacaagatgttccaggttcagtttgtacttttcctgcccaagccctagaatcagccgtttcttcaaggatcccaggtcttttttggtaaagcatcatgtttataagccagagtctagtgtagggatgcctgttgatgtgggcatgtcactgctcccaggcccttgcagctggcagacatttacatctacatttatttataaatctgtttatatggacaagtgtgagtttacataaaacttccgaatcctatccaacaccacagcgttcctttttagttttccctttcactatctgcaactcttgtctctgatgagaaacctgcctcactacccttgatgcatttttttgtagatcactccttgtgtatcacttatctcccatctcatgaggacgccctccccacctctctccggttctgatggtgctggacttgtccttacatgagtgccctcatcacctagttgaggctctgacacccatgtacagctcctctatgtggaggcactcttctcacccatctaatggcttcaggactgaattgtttgggaagagaagaggtagagaaagaagaactgatctttccttaaatgcagaattttgagtcagaatcaaaatagtacttgactgccccatgcttgctctggggcagaaaggagagatgcctggacttaagctggaagagtggaataggcggagtgggcacaggtcccggaggtagagcacctgcattccaggcacagctctgtttctaaggggccaaatgatcttagagaagtaatttgatctctttgtgccccagctcttccaataatgaattggaccaaatctaaatcaaagactggtgccctatggccaaaattggtctaagtgcttattttgtttgggagtcaacttcctttctttctttctttctttttttttttttttgagacaggtctcccactgttgcccaggctggagtgcagtgttgtggtcatggctcactgcagccttgactgcctgggctcaagtaatcctcccacttcaacctctcaagtagctggtaccacaggcgcatgccaccatgcctggcgaatttttgtatttcttgtagagatagggttttgccatgtttcctaggctgctctcaaaatcctgagctcaagcaatccacccgcctcagcctcccaatgtgctgggagtgatacagagaggaggcagggagatactgcgtagaagagggtggttccctggcaaagtccccaccctgaagcttggaaacccacggccctaaatgggaagaagcattcctgtttttgtgcccaaatgttgctttttggcccaccatgccccccatcctgtacccatataaatcccaaacctcaggctccacgagcagaagagcagaggagcataagagcagtgcagcagagaaggagagaagggaaggagcatctgaatgttgagaggagtttgcctggggatgataggagaggagattggctgtgggtctgcctaactccaggggaagatcatcttcccactccatcccctcgccaggtccccatccatcccgctgagagccacctccatctggcaataaaatccccctcatttaccatccttcaatttgtccgtgtgacctgattcttcctggatgccggacaaggacccggagagggcactgagctagttaacacttaagccatctgtgacggcagagctaaaaaagtactgtaatatgcccactggggcttcagaagttacaggcacccacccctagatgctactgtggggtcagagcccagaagcgcttgccccagctcctgcgtgctccccctcctctaaggggtttgagtgcacagtggccgaacagatgagccacattcggtcacacgtctctgaggggggtcagggaactctcccatttcaggattataggcgttagccactgcaccaggccaggagacaactttcaaaaaaatcaaatttaagtttctttagttggaggctgtgcactccaattagccctagatgggtgacagctcagaccatctttcccaactttatacatttctctctccaggctaagttacatttcaagcctcttctagctcagcatggcctcttctccatttgctatgctctggctcagcagattcttaatctatggcaccaggcctgtcaagagacctgcatttgattcccaacttttagccaggaaacactgggaacaccacatctgagtgtgttgctgctgctggcttgggtggccaggttttattccctcatttggccctgcccacatcctgctgattggtccattttacagagtgctgattggtccattttagagtgctgattagtccatttacaatcctttagctagacacagaacactgattggtgaatttacaatcctctagctagagagaaaagttctctaagtccccactccacccaggaagtacagctggcttcacctctcagtgttattgatggaagcgcttagagctccctgctttctgtgtggagctggtctaggcctggaccatccttggggcactcatttaattaagcgaggctcagaggtctggactgatgggtcaccctgattcaaagagtatttcttcagtaaacagggtctaggggaaaccacatagtctgggggctagggccccgtttggcaggtccagggattgagcaagaatgagcagagaaaggagacggggctgtgtcttgagtctataggctgggtcactggaggtatggtaggatctctagagctgcctctaatgacagcggagtctcttcaagaaacttttgaaagggaccaaattctttttctgattacctttctagcttctctggctgagcccctatgcattggattgacatagacagattaacaaaagaaaacaatcagaattttattagtatgtgcactgcaattacatgcgggaacactcagagatgaataaactcaaaggtttggttggaacatgggcttatagcattttagcaaaggaccaatacatttttttttcttttttttgagacagagtttcactcttgttgtccaggctggagtgcaatggcacaatctcagctcaccacaacctctgcctcccgggttcaagccattctgctgcttcagcctcccgagtagctgggattacaggtgtgtgccacctcacccggctaagttttgtattgttggtagagacggggtttcataatgttggccaggctggtcttgaactcctgacctcaggtgatctgcctgcctcggccacccaaagtgctaggattacgggcgtgatcttctcaattgccttcagctcaaaataatccttatgtcaaagtgtcatattttgaggtggcatattctgccagccgacagacccaagaaccttggctagaatggattggtcttggattgcagtgagttgaacccctgtacagaagtgtagaagaaggaaacatcttctagttgagttttagcttctgtctgttttgagctggtgaactcaaattgttcactgaatatttaaattctttgactttcacctgtgaaaatctcctgaatgaaatgagatatttgatcctatttagtgggtcactgaacatgcttctaacatgaaaacattcagctttgagctaggaaggtgagctgtgctcacaatctcaaacagggtaggggagagaagatttacatgttctgtgccctgtgccctttcttggggcctagaggacacattgacttatcttttctggggatagtataaaggaacatcaacttgctcctattttgtgctggagaagcttagagaatcagatgctagttttatactacatccctcagtattaaaagctttaatttaaaaaagaaaaaataacagctgggcacagtggcttatgcttgtaatcccaacactttgggaggctgatgtgggaggatcgcttgaggtcaggagttggcgactagcttgggcaacatagcaagaccctgaatctacaaaaagtaaacaaattagccagacgtggtggtgcgtgcctgtagtcccagctacttgggaggctgaggcgggaggatccttgagctcaggaattcaaggttgcagtgagctatgattgtaccattgcactccagcctgggtgacagagtgagatgctatctctgaaaataagtgaataaatagataaaaataaaaaaggaaaaaagttcatctttggccaaatgtcaacaaagaaaataaaaggagaaaaaaagaattaacgattcattgaaaattttttttccttccttgaagaaacaatttgttccaacctaaaaaattatgcaaaatcattgtaatgtttccccggtgctttaaatccagatttcaggtgccccaaagagagagatcaagtgattttaaccacctgaaatgaaaaaaaaaaaaaaaaaaaaaagaggccgggcacagtggctcacgcctataatcccagcactttgagaggccgaggtgggtggatcacctgaggtcaggagttctagaccagctggccaacatagtgaaaccccgtctctactaaaaatgctaaaacaaaaattagccgggtgtggtggtgcacatctgtctgaggcccaagaatcgcttgaacctgggatatggcagtgagctgagatcacacactgcactccagcctgggagacagagtgagactccgtctcaaagaaaacaaaaaagataaataaaaagcatcagacaattttctatagcttctagaccatagaacctgcagcaataactcaatgagtttttattctcatgtttgccctgtgcaaggagcagaccaagagaagggatttgcctgcccttgactttctctgccatccaccccagctgccaggtaaatcacaaatcatgtagtattttctgtgaatgcaggtaagcttagcacccctggcctcattcccttccttttattttttgacctctacatttaactatgacttttctggcgaacacattgccttctttcctcctcaagggatttcattttattcttgctcaccggaagcacagaaccaccccagctgtggctagtttagccttcccagggctctctccactgtggcctcccagaacttctaatctacacaagaagcctgccctactgttgacattttataacctatgtgcctctgtgactaaatggctagagttatcacatctgctcagtcctgcatctttattaaaaaaaacctgggcaatgtgccatcctctctgtccaccaacaagatttttctctgtgaaacgctttctttaaagtctgtgcacaaaagcataattgttccctcagagttgctaaaatgacttgaagggcttgagttttttagtagctttcagaaacaaaaggagctttctaactggacaagctattccctccagcaaaggatccttggctgaactttgtttaccatattaagcagcatagcgcaagctgcactgtggcttattgttaaatagtcactacagaaaattcacttcagggttatttctggtttgttataacatgtatttcttttctcttgtctgtatcgcttaataacagtaaggaaggttacagaaagctttttatgaccatcctcaccccaaagtcaaattaacttctccctctttttgtccctaacagatgcagcgcaccctgattttttcatgtctgtttcactcactcagtggacgctctgtgagggcaggaccttgtctagtttgttcacgctctcttgctttcctgtgttcattgagcaagatgcctggcatatagtgtgaaattagttaacatttgtgaagaagcaaataaatggatgaatttgtggaggtattggcttctttttatatgtttggtagaatttggtgatggtagagacagctatttcctaccccatatccatcccctctgttctagggtgggcacaaagctgcttggaataaagtcagcctcttctgccttctgactggaggtatggccaggtgaaaaagtagacagggttcctgaggacttctaggcatcgccagaccagctccgaattgcctacctgtaggctcttaaacttccattttgttcattttttaaaaaatcacttgcagccaaatctagtcataacaggtatgttggtttaacatgtgtgtctgtgaagaccagggagagattgggataaaaaaatctaaatccaaggatggatacaatggtccatgcctgtaatcacagcattttgggaggccaaggagggaggatagcttgagcccaggagttcaagaccagcctgggtaacatagtgagatcctgtttctatgaaaaatgaaacaaaaaaaaaattagctgggcatggtggtgtgtgcctgtagtcccagctacttgggaggtggaggcaggaggatcgtttgagctcaggtggcctaggctgcagtgagccatagtcatgtcaaccgtactccaccctaagcgacagatagagaccctgtctcaatcaatcaatcaacataaataaaaataaataaaatgaaaataaaaatctagatctagctaggatgaccatagaaaaccatgccagtttagaggtgtttagaattaactaagcttatattctttaatttatttcatatctattcagttacaaatgcggggcatttcccctttttatcttcttactcattggtttaggaatagtaataatattattagtatattaaaatgttgatatatttgaatgcatcatgctaggctcaaaatatctatgtaagtgcaactggcaacaaagcaggaagtttgatacacccaccttggtatttttttcactctcagacataaggggaaggcagccaattgtgatttttttataagtttttctcctattatttttatgtcacagaagccaatttctattttatcttaaagaattttgttattattattatttttttttattattatactttaagttttagggtacatgtgcacaatgtgcaggttagttacatatgtatacatgtgacatgctggtgcgctgcacccactaactcgtcatctagcattaggtatatctcctaatgctatccctcccccctccccccaccccacaacagtccccagagtgtgatgttccccttcctgtgtccatgtgatctcattgttcaattcccacatatgagtgagaatatgcggtgtttggttttttgttcttgtgatagtttactgagaatgatgatttccaatttcatccatgtccctacaaaggacatgaactcatccttttttatggctgcatagtattccatggtgtatatgtgcctcattttcttaatccagtctatcattgttggacatttgggttggttccaagtctttgctattgtgaatagtgccgcaataaacatacatgtgcatgtgtctttatagcagcatgatttatagtcatttgggtatatacccagtaatgggatggctgggtcgaatgctatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtaggttctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctacgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggatcgacttggtgatgcgggctcttttttggttccatatgaactttaaagtagttattattattatttttagatgatgtctcattctgtcacctaggctggagtgcagcggcacaatctgggctcactgcaacctccacctcctggattcaagcaattctgtctcagtctccccagtagctgggattacaggcgctagccaccatgcccagctaatttttgtatttttagtagagacagggtttcactatgttggccaggctggtcttgaactccttacctcaagtaatctgcctgcctcagcctgggattacaggtgtgagccattgcactcggccaaatttttattacctcacttaacttagctcatataaatatgagcttccttatttggaaggaaaaacactggaatgttcctatatttctttaactggtgctttcccatatatactcattgtctaaactatgctttacttaccatcttagcaataaaggaacaaggaaattctatctttttaaaaggggtgataactgtgggtggctgtggcaatgtgagcagacagtggggaggtggtgatctatgagctaagataaacagatttgtgaaccatggctttatgggaaaattctttttcttcaattttaagtgagtcatactttttttttctcttcttatagaaattctcatgaagcacagacagtcatgaagttgggaacttatcaatctagttggagccatgggacattaaaataatgttttctcctcagtgcccctggaccttgaactagtaggaagcaaaaagcagaggtttccattgagttgggctatttggggaacttccattgacttggacaatggaggttcagctatccatcaaactatttgcagagtccaaatttttatgcttcccactgaacccccaagtcaaaaaaaccataaattatgttgtaccatatcaaattgtcattttaaaaaaagtttaaaaataatcaaatattggcagttttatttggttcaaagtatagatgagttttcaattttcatgattttttgaagagttaacttctaaaaatagcaagcaagaatattaccagtaacaaaatgttaaatatagagcaatagttgaaaattgatatttaaaaaataatttatatataagaacactaaggcttggagagtttagactgtttgcccacatgcacacagctgggagctggaagggtcataatgagaacctggatctggctgaacctgaaacccaggctggagtgcagttgtgtgatcatggctcactccagccttgacctctcaggctcaagtgattctcctgtctcagcctccagagtagctgagacaactacaggcctgtgccaacacacccagctaatgtgtttttattttttgtagagatgagatctcactatgttgcccgggctgatcttaaactcctgggctcaagtgagcctcaagccttggccacccaaagggctaggattataggcgtgagccacggtgcccagcctcagcatgttgttaacattaacaaccatcttatcttattttcttgttatgaaacagggcatttgaaaaaaacctagaaaatataggtaggcaaaagaaaaatttggagaataagcagatatcagtttttgccctcagtctagagaaggggaaagtcaataaacaagtaaatcagcaaatatattgaccacaaattgagatatttgaaacaaaatgccattaaaaagagaaaagacttttagaatatagaataatggggtcagggaggtgtgggggaatatcctaacttaaggaggtcagcaaagcccttgttgaggagatgacaagatgacatttcagctgagatgagaatggaaggagtgatgcaagcagctgagtgtccaggcaagggtcagtcagggcagtgtaaaggattagaatgtaccatctcaaaatatgctgctttggcatattcattattttcagatgaaggcagttgagaaacagcatatgcaggaagggctctctgccctccccttttctacctaaaagcagagcataaatttcccataagtaccctccccgtaccaggaagaagagtagaacattcttatcattggagatggagagttgatactgagatgaatctataaaaacaaatcttactaaaataacttatatcttccattagtttctttatatattttatagtcacttttccacaattcactacccctagcccaagcctttttttcctttgtcttgccacatctttacaatttattgccctttgttaaaatggtatatgagcccctaggtctaacggtcctttggattttcatttttttctatgaagcctctcatgttatataaaaatactaattaatatcaaataaaatgtgtatagttttcctcctgttagtctgttttttgtccgttcaagctatcatctccagactcagaacctaagggggtagaggaaaagcctttcctcttctacagcaggaaggaggttggcatatttgatattcttcccaggaagaggaaaaagaggaggaagccagtggggctggcttggagtgaaacaggggatgtgggtgtgtgcaggatccctgctgttgtaggactttctccttagttcagctaacaacggggttcttgtcacacaaccatgagagattaggcttgcagacacttcgaaggtttgagaaaaattgaatttattaggcaaaaaagggaaaaaacaggaaacagggactctcagcaaagcagaagtcctgctagttggcttcctgcctcacggactgaatcccgggttccaccctggaacaggagaggccaggctcctcccacctgcaaatgacatgaacttcctgaggctccaccccatcctcccagtgtgcaggctggttgaagtttctgccagggggccctttttacttggctgtctcactgccacacacttttgtagattttggaagagagttgaaattctgtcttatgaggaaattaattatttatgtaattaaaaaaaatggaggcccagcatgatggctcatacctgtaatcctagaactttgggaggttgagatgggaggatcacttgagctcaggagttcaagaacagcctgggaaacatagtgagaccttgtctttactattattttaaagaaaaaaaaatatttaaaatggaataattctaggtacttggtgatttgtaactttccttaattgccaatacatgtatattgggtacttagtccttttgatatgtcaagtgtccctaccagctgaccctattatagataaaactgttaaataaacaataactgggttttgttttgttttgtttttttgagagagtctccctctgttgcctaggctggtgtgcaatggcgcaatcttggctcactgcaacctctgcctactgatttcaaataattctcctgcctcaacctcctgagtagctggggttacaggcatgcaccaccacacctggctaatttttttttttttttaaatttttagtagaggccgggtttcaccatgttggccaagctggtctggactcctgacctcaggtgatctgcctgccttggccccccaaagtgctgggattacaggcgtgagccaccgcacctggtccaacaataactgtttattgctaactattctcttactgcctttgtaggacagaactagactttctattcctactacatgaggtaaattggaaacagaaaaaaaactgccacttctctatatatgcatctttaaaagcagttcccctgggactgagtaaaaaaaatgccagaaatggacatttctatggcaggaaaagattctttcttgttaccggcttgtctgctgttctttctgaagccctggcagaagataaaatctaatttgtacacaatgttaatgtcattaattaaactatgacaccttacaaatcacattatgtacctactcttattttcttcagaatctgacataacttagcttagtatttagccagaatgatactttggtttctccaggcgctgatgttgatgtgcctctctgccctgcagctggtggatgagggggatctggggaagatactttgtttcctgcctcactatatgctctttttggtcactatcgctgttttcagttgacatttctgaatgaccacagggagtgtagcacatcccagtgctgagacatgagttgcttttagagttttaacattgagaatcacaatatccagtcctgccaagtcaaacttcataggctcaagtgagaaattaatgttttgagagtcaagtacagcaagaatgctttggcatattttcagtggtgcttgataacaggcttacccaagacagagcaaataaacagaacaagccagggaccactttagacatgatgggtaattttccatggcttataggggtctcggagaaattcttttcagatttgtgtactgaaaagcttcgctcgattaagcgtgagcagacacctccagagtctcacacacccaatctgagggaaaaaccacctcaatccgcacccagcttgaattccccacttgatgcacttcaccataaaacctaagatctggtatgtgacagctggctgtagctgcagtcccatgagcccagaacattctatgtttgtggtgtgtgtgtgtgtgtgtgtgtgttgttgttatcggtggtggtagcagcctttctatccactgcaaaattaggccagtctgagatttagaagatttgggactgttacactgggcagttggttttctgaaatataaaacaaggaatcaatggaatgcaaataggctgggcgcagcggcctgtaatcccagcactttgagaggccgaggcgggtggatcacctggggtcaggagtttgagaccagcctggccaacatggtgaaaccttatctgtacgaaaaatacaaaaattagctggtggtgcatacctgtaatccctgctactccggaagctgaggcaggagaattgcttgaacccgggaggcagaggttgcagtgagccaagatggctccactgtcctccagccctccagcctgagtagcagagcagaaaaaaaaaaaaaaaaagaatacaaatagatattacttttaatagattttctttaaataaacatagttgtcacatgtagagggagaaagacacatgaaatgtattttacttacgcaagtctgatgcacagagagaggatggaaaaactgccatatgtgaatcaggatctacggaggctgcaagtaaacataggtgttcttgggtacagcatttgaatgaatggatggaagtcagggcttagattttctccacagaatggcttccaaaagcacgggagattttatttaattgcactaacttcgaaacaatgctcactggcacaagagtaaagttgtcattaaaaaaaaatccttggggccaggcatggtggctcatgcctgtgatcccagcactttgggaggccgaggcgggcggatcacctgaggtcgggagtttgagaccagcctgaccaacatggagaaaccccgtctctactgaaaatacaaaattagctgggtgtggtggtgcatgcctgtaatcccagctacttgggaggctgaggcaggagaatcgcttgaacctgggaggcggaggttgcggtgagtcgagatcacgccattgcactctagcctgggcaataagagtgaaactcagtctaaaaaaaaaaaaaaaatccttggagtttttactgacctttggaatcttaagcactttaatacatgtactctcaggagattattaagcaattgaaagtttggacccctaaaactgctttgtgcgagattcaaatgataactgatttgaaatggtccctgatatctttggttccagggcaatgggtgctagctgggcaggtcctggcttgagagagaattagatgaaggtcactgtgctgctggggctaacagtgcctatgctgtcctcaagagctggggccagaggcaagtggtagaaggacctggtccagcctctaaggcctattgaaaggtcctgggcagccttgtgcagagcttttgttcctaggaatttcaattttctattcccttctctgaaaaggaaactttttctgtgaatgtttatctttaggaagcaaattaatggtattaggacatgattcccagcctaataagaaatgacccccagtattatttacctggtttctcattttgattttggcctcccttggttccagatggtgaaaatacatttcaggtattataagattggagggacctgatgaaatagtagagtttactgatgttgtgctattaaaaagaaacaataataatctcaattatcccacattctgagctcagaagtcagtctgggctaggtgtggtggctcatggctgtaatcccagtactttaggaggctggagtgggaggatcacttgaggccaagagttcaagaccagcttggacaacatggagaaactcccatctctacaaaaaattgaaaaaaataaaaaattagccaggcctggtggcatgcacctgtagtccccgctgcttgaaaggctgaggtgggaggatttatcttgagaagctgaggtgggaggattttgcttgagctgagaagttcgagggtgcagtgagttaggattgagccactgcattcctgtctgggtgacagagaaagaccctgtctctttaaataaacaaataaatagaagtcagtctggatatgtaatttttttcagagtgctttgtagttactagacttggaaattgatctaattttggtcatctgtaaacacgttgcagacttccttttcttacacactgtataccaagtgtagcactttgttaaggacacttctgtgaacttcagtttctggaggtgcagaagatgtgggtttagacaggacacagcttagcatagtggtcagaagcaaggcttctggaaccaaagcaccaaatcctggttctgctattgactagccctgacttttgataagttactttatttctctgtgactcagttccaccacctacaaaatgggaatgtgtggtggtcactagaatgtgctttgcaaatcttcaactacagggagtataattgactaagggccccagctgctgtgctctaaatctatcactgtgtggaagggcctgcctggctgcttctggccaactgagtgcatcaaggatactaaggcacacccaatcctgggccacacagagctcctttgattgccactttggcttgtggactccttgatggcttttctaacaaaagctttatcttgtttccaccctaccttctctccctgtctcctcactgggattagacctgcatcatggcctgagggctctccaagcctagccagctctttccctattttctctcactcaaggatttctcctaagacagagttgtcagtttagaaacaaacaagcatcaggatgtccagtgaaatttgaatttcagataaacaacaaataattttttattataaatatatttatactttcattttacttattttccatctggaaaaaaattcagacatctttattctcatctaggcatttgcttcttggaggacctaatctaacagtgggcgctaataattgtacctaccccataggtagaattaaatgagtaaaagatataaagtaattagagctggacttggcacttaataagtgctcaacaaattttagttactatcaaagacacaggatgtgatcagtactgaatggctctccttgggttgttgtgcctttcccctagaggggaaggaaaaaaatctctgtcttctactctcctagatttagtgtctggggtcttgcaaattgaaccaacaaaagacagattaacaggagaaaaagatttatttaatatgcataatggggcctcacagaaattaaatgaaaaccccaaagaggtgaccaaagacttatatagcattttaacaaaggatgataaatttgtggagaagttggatctcctaggcaccgtaccttgtgggaaggtaaatatatgggtaatgaaagataagggttatttcagcaaggtttatttatgcagattcaagccagtgcatctccagtgataagaattgtttctttttcctggtatgggagaggagagaaaagtgccttcacaaagagaaatttatgtcctgcttttaggcagatgggggagggtagagagctttttcagcagtctgttatttctcaattgccttcagctcaacacaatcctttgccaaagtggcatattttggggtggcatattctgatcctgatcattcccaaaggtgtcagtgggactagttggcctccaggccttgtgccagcttcagggcagcccccacacggagtggtcttgtgttggtgcttgcagggtgggtagaagtgagaatgatccctcaggaaagcagctctgttctcttttctgctgtctaaatgaacgctgctgggctccctgcctgtcagtgtttttcctctgcacggcagcagctgtttcttacctcttctgctgtttttctcttatgatcttgtttctcctttgctttagtagccttcatacaaagaatcaggcttggtcatcagaaaagcagaatgctttttttttttggcaaatctccaaaagttgtgtttctagttagtctttctggcacttctctttatagttgtttgatttacttttgccttacaagttcctttatcaccaatgatgttttcttctttttcccttaactatcaggttctgcaggagtctggttgcttgagaatcctggagggttgaaatctcgatatttgaggtgatgtgaataaattgtatagaagtaggtggacactaatggaacaaaggaggaatttcatggctacctgggagaattaaaaatgttaaagctcggccgggcatggtggctcacacctgtaaccccagtactttgggaggctgaggtgagcagatcacctgaggtcaggagttcaagaccagcctgaccaacatgaagaaaccctgtctctactaaaaatacaaaattagccaggtgtggtggcacatgcctgtaatcctatctacttggcaggctgaggcaggagaatcacttgaacctgggaggcggggcggaggttgcggtgagctgagatcatgccattgcattccagcccggacaacaagagcaaaactctgtctaaaaaaaaaaaaaaaaaaaaaaagttaaagctcaaaacaaaatgccttgggtgtttcaaatagattctggaagtttgactcttatgtgttaggaccagaggcatttgagaaattcaatagcagtaatacattattgatttacattttcctaaaatccagaaaaacagttatttcaaaataccatgtggacatcaattaatttttatcagttaactttgggataaatttttttcccccttaatagcagccttaccttgtcaacaaagagtcaaacactgcaaaatatttgaaaagatttattctgggccaaatatgagtgaccaatggcctgcgacacaatcccaggagaccctgagaacatgtgcccaaggtggctgggctacagcttgttttttttttgtttgttttttgagacggagtctcgctctgccacccaggctggagtgaagtggcacaatctaagctcactgcaaactccacctcctgggttcaaacaattctcctgcctcagcctctcaagtagctgggattacaggcgctcatcaccatacctggctaatttttgtatttttaatagagacagcgttccgccatgttggccaggctggtctcgaactcctgacctcaggtgatctgcctgcctcagcctcccaaagtgttgggattacaagcgtgagccaccacacccagcctacagcttggttttatacattttagggagacataagacatcaatcaatacaggtaggatgtacattggttcagtccagagaggtgggacaacttgaagtgggggcttctaggtcacaggtggatttaaagattttttgattaaagacctggaatcaatagaagggagtgtctgggttgagataaggggctgtgaagaccaaggttcttattatgtagatgaagcttccaggtagcaggcttcagagagaatagattgtagctatttcttttcaggcttaaaaaggtaccagactcttagttaattttgtcctggattaggaaaaagacctagaaagggaaaaggattctcttcagaaagtggatattctccacaagagacagctttgcaggaccatttcaaaatatgtcaaagaaatatattttggggtaaaatactttgatttctttcagagcctatctgtcatgttgatatcttattgctacaaagactctgttttgtcagtgttaaggtctatcttaatattaatactagtcagctgtgcctgaattccagtgggaggagggcataatgaggcatgtcagacaactcactcatgtcatggcatgaactacgtttcgggtttactttttattttttattttcgagatggagttttgctcttgttgctcaggctggagtgcagtggcatgatcctcagctcactgcaacctccgcctcctgggttcaagtgattctcctgcctcagcctcccaagtagctgagattacaggtgcctgccatcatacctggctaacttttgtatttttagtagagacagggtataattatgttggccaggctggtctcgaacacctgacctcaggtgatccacctgtctcgtcnnnnnnnnnnnnnnnnnnnncacacccagcccagaccgacttatgagctcagaatgtgggataattgagattattattgtttctttttaatagcactgggcccagggtttactttagaatgcccttagcaggtcaggcgtggtggctcatgcctgtaatcccagcactttggaggccgaggcgggtggatcatgaggtcaggagttcaagaccagcctggccaagatggtgaaaccccgtctctactgaaaatgcaaaatttagcccagtgtggtggcaggcacctgtaatcccagctactcgggaggctgatgcagagaattgcttgaacctgggaggtagaggttgcagtaagccgagattgcaccactgcactccagcttgggcggcagagcgagactccatctcaaaaaaaaaaaaaaaaaaaaaaatagagaatgccctcagctgagaggaggagcccattcagttggttgggggggtctcagaattttatttttgttttacaacatgttgattaaagttcttcatactgatgcaagttattagtggcaaaattgtaatcacaaatgctggtcttacaactaatttcaattttaggtgtcattaaaagtcatagaatcatagaataaaaactgattttgaaaggctgttgagtccaaagctttgcccttaagcaaaggcaagtcattccaaacaagataaaaatcaatcttatttcaaagttcccagagcaggctttgcataacctaaggcaaaatttaaattcttgagctgtgatatacttaacaaaaaaagcaaactgagttatttaaagaagtattgtgccaataatgtctatgtaatagcttgtttgtgatgtttgctggttaatggaatataacatgtaatctacaattattttaatttcaggagtctttggaattaatattttcttctactagttataaggttcctcaaaggattacactgtatttaggacattcatgaggtatatagtaggaaggtgctgggattttgaatcagaacacctggatttaagtgtgttcccctacaatttagtcccttgggaaagtcatttagctttttggaatttatcttcttcatcagtaaaatgttaatacaaatttgtgtctggacttttttttttttaccagatttttgtgtgccctgaaggtggggttgtataaacaaggctttgtaacaagttcttgttaccatttgtatgaataacataatgttcatataatttgtcgatcatgagaagaaactgcaggtttgttgttaattccattcaattatgaggtgctcatctccaacacaagtgatccttaaccaagtaagaaatccccctaaagagggaatgtgtatgtgtataatgttcattgtaagtgaagttctggctctcttccagcgatgctaccagcagcagctgccctgggcacataacaacactgttactgcatcactgtgctctactgtgtttattatctcattcaattatcccaacaagcctgcagaattttaagtcattattctcattgcaggtgatgtgactaatgcttaaaaacttaggaaactttgtcaaacctcactattagtaagtcacagaaaaaaaaaaaaaatgaatccagagacttgggctccagaatccatgctctcaaacttgaaaaatttgccttccagcttacaaaagtcattgggtttgggagcatcgtcttcactggtatattccttctttcaggacttctggaaatatcaagaatatcaaggttctttggcttggccagatctgacctaagaatacaaaattcttttttatttcttaggtttttggaaattttcataagatgtatgagtcaaagaaaatgcaaaattcttctcgttgttctaaaaggttaatggcacaaatggttcacatttccacaaacttagtattgtaaaaaagaagaaactgttcctctattctcttaaatttagtggctggggcctgtgagttaaactgacaaaagacagattagcaggagaaaacatatatcgattttattgatgttaattttatgtgcacagagggccttatagaaaaaagtaaaaagctcatataagtggttagatgtgggggtttatatatacctatcttagtagagaaaagggaaggggagaaagggcacttggggaaaaacaaatgactttttggaaagataagtgggcccttgggagaatagatgggagatacaatagtcttgtgaaagtgtcccaatcctctaatcatgcctctgtctggacttcttatctcagaaaagattaaaattgctcccaggggaggagatttgagattgagttcttttgagatgcttttagggagatcagggatttcagcagctcaaatgcttttagctcaaaatagtttttatgccaaagtagtatattttgggatggtatatcatgatccctgagatatgaaatatatgtataggttttgtccatggtacctggctcccagcacccataatccttgtaatttcttaaatgattagagaaataggagtatctttaattaaaatatttagcctttggttcttggttcttgaaacagctccagaacacctccagagtgataaaggtcaacgatgttgtagtgaatgcttataattctacgttgcctccgcatccatttcgaatgtagtttggctttcttgtgccgagacagggctcagtcacctgtgatgcagttgccagttctatatcatgtcccaatgcctcaagctggtggccagagataagaacatagaggcgtctctcctgcctagcagactgggctccccacgatccctcctcttcctttaaagggaccatttatttgtctgtcaagttaaagtgacccacaccctattcccttatatacattgctggttgccaccactttgttttctcttctctcttcctgtctatgctccctaaggctttcttccgtgtggcctccaggagtgccatgttccttcctgggtctgtaagcactaaaatctcttagactttcacattgtgattatgtaattgaagcccacaatacaacccttgtagaccatccatacaggtggattccttcctgatgctttttggtcagtcagggttggggacggtaactaccagctaagttgacggagaaactcaaagactttcattgaaaatgtcagagacgtctgaacaagagcaactccaccttgaataggggctgggtaaaataaggctgagacctgctgggctgcatccccaggaagttaggcattcttagtcacagggtgagataggaggtcggcacaagtacaggtcacaaacgccttgctgataaaacaggttgcgataaagaggctggccaaaacccaccaaaaccaagatgatgaggaaagtgacctttggtcatcctgactgctcataatatgctaaaaataatgcattagcatgctaaaagacactcccaccagtgccatgacattttacaaatgccatggcaacgacaggaagtttccctatatggtctacaaggggaggaactctcaattccaggaattgcccaccccttttcctgaaaactcatgaataatccaccccttgtttagcatataatcaagaaataagtatatgtatacttaggcagcccatttcaatgctctgcctatggagtagccattcttttattcctttactttcttaaaaaacttgctttcactttatggacttgcctcgaattctttcttgtgtgaggtccaagaaccctcttttggggtcaggatcaggaaccctttctggtaacaaaaacagacatgttattcataacaaggctgttttggaaaaaactccaacagtgttttcttcccctctctctcacacaacatcaacgcaaaagacttctgtgaccctaaaaatatgtggggatttctctgcaccagtgagcaagcaatcaattcggcagcagataccagctgggtgtccttcagttcaattccaacactgtctactcggagatagtttcagactgtttcccccttagacaccagtcccaagtctgagcctctggaacttctgaccaattgcctttaaattggagttccctaggcccttctttgtgttcgattaatttgctggagtggcttgcagaactcagggaaacacttatgcttactggtttattataaagaatatgacaaagtatacgatgaagagattcatagggtgaggtatgggggagggggtgtggagttttcatgccctccctgggtgttcccctccccccatccaggagcttccatgtgttcagctatccagaagctctctgaaccctgtcctcttgggtttttatggaggcttcattacataagcatgattggttaaaacattggccattagtgacaagcatggccttcaactcctttcttctccctggaggttggggatggggttgaaagtctcaaccctctaattatgccttcgtctttccactgaccagccccatcctgaagctgtcagtcaacattagcctacaaaaagacagcactttggagattccaaagattttagaagttatagccaggaaaaagggagaagaccaaatgtgtatttcataatatcacaaagctcctttcaactacatctgagtttatgttaataaggtgatttgggaaagttcctaaccacaggatgggagctggttgccaggggaaccaaaagtatgattggagggttccaactcacagccccaaccctgagaaagggagaggggctgaaggttaggagatcaccaatggccaatgattgaatcagtcacacctacataatgaagcctgcctgaaaatctggaaggaccaggtttgaggagcttccaggttggtgaacaaaaatatatccacttgctgggagggtggcataccccaactcacggggacagaagctctggcccttgggacacttccagacctcatcctatgtatctcttcatctggctgttcaatatgctttgtaatgaatgggtaaatgtaagcaaagtgttttcctgagttctgtgagctgctctaacaaagtaatcaaacctgatgagggaagcatggaaaccctgatttatagctggtcagtcagaaccacaggtcacaacctgggatttgtcattggcatctgaagtggggggcagtcttgtggaaccgaggcctcaacttgtgggatctaatgctatctccaggtagacaagagttggaattgaattgaattgaattgaatcgaattgaattgaataagaggacatcaagctggtgtctgctggagactcggatatcagaagtgttgtgttgagtaactgtgagaataggacaatacagcttggtttttacactttgcttttttcctatgtatctctacaaatccccttcagcatgtttgagaactacctacaagttacctagtaagtgtgatatttagttactatcatttgatacagtctatgaagacaatcttactcactttgcagctggtaaacaaattccttgcagggagggctgcctctttcggggaggctatgcatggacaagccccatcagggatgaaggtggcctccaaggtagggggtgctgactggctggagggctgctacctgtggtgcatgctcaggaaagctcaaatggtatgggtaaggaccttggcaaagggcagactctgagagatcagggtgaggaggaggaagagcaatgtgataggtgtgatagcccaaggctaggtgaagcatggtgagtgctctccccaggacccctcatatcactagtcaatttatacattcaggaacctgcaccacatcttttgaaaactgatgaagatggtggtatacaggtcaccagcacctacagacacagaagtggcaacatggccaccaggaggatgtaaaaagtgggcgtggtaaatgctttctttctttttctttttttttttttttttgagacagggtctcactctgtcacccagcttggagtgcagtggtacgatctgggctcactgcaacctccacctccctggttcaagaaattctcctgcctcagcctcccaagtagctgggattacagacatgcaccaccacgcccacctaatttctgtatttttagtagagacaggttttcaccatgttggccaggctggtctcgaactcctagcctcaaatgatctgcttgccatggcctcccaaagtgctgagataacaggtgtgaaccactgtgtccagctgatgctttcttattgagcaaaaactaaatactaaaatatataaaatatatagatatatacatatatgtgtacacacacactaggccacatagaattcctcaataaattccaaaaggaacaatatcattatatcatctagactatgttctctgaccataattgtcaataaaattagaaatcaataacagaaaacagtcattatgtatggagtatgaaggtccctcaaaaaattaaaaatagaactaccatattatctatgaatcccacttctgggtatatattcaaaagaaataaaatcagtatgttaaagagacatatgtgccctcaggcttattacagcactattcacaatggccaagatatgggaccaacctatgtccatcaatggatgaatggataaagaaaatgtggtacatatacatgatgaagtattattcagccttcaaaaataaggaaattctgtcactggaacaacatgaatgaacttggaggattttatgttaagtgaaataagccaaacacagaaagataaataccacattatctcacttatatatgcagccaaaaaaaaagtcaaactcatagaaatagaatagaatggtggtgaccagagactggggatagtggggattggggagacgttatgatttggctcttcatccccacccaaatctcatgttgaattgtaatccctagtgttggaagtggggcctggtgggaggtgattaaatcatgggggtggacatcccccttgctgttctcatgatagtgagtgagttctcctgagatctggttgtttaaaagtgtgtagcacttactctttctctcttcctctcctgctccaccatgtgaagatgtgcctgcttccccttcacccttctaacatgattgtaggtttcctgagacttccccagccatgcttcctgtacagcctgtggaagtgtgagtcaattaaacctcctttctcaaaaattacacagtctcaggtagttccttacagcaatgtgagaatggactaatataggagatgttggccaaagggcacaaaatttcaattacacaagaggagtaaatccaagagatttattgtacatcatggtgactatagttaataacaatatattgtatatttgaaaatcactaagagactagatttgaagtgttctcacaaagaaacaagtcagtgaggtgatgcatttgttaatttgcttgatttagctgttccacaatgtatacatatttcaaaacataatgtcgtataccctaaatatatataatttgtagttgccaattaaaaaataaagaatgaaggaaatcaataacagaagaatagcttaaacatcttatatgttggaaatcaaataatgttactaaagaaattttgggcagagtgcagtggctcacgcctgtaatcccagcactttgggagactgaggtgagtggatcacttgagaccaggagtttgagagcagcctggattacatggagacacctcatccctacaaaaaacaaaaaagccccagaacataaaaattagccaggtgtggtggtgcatacctgtagtctcagctactttggaggctgaggtggaggatccattgagtttgggaggttgaggctgcagtgagccatgattgcaccaccgcacgccagcctgggcaacagaatgagactcggtctcaaaacaacaacaaaagaagtcttggagttaaaaagaagtcatacaaaattttaaaatattttgaactgaattagaggtgaggcagtcccagatgtggatcctaatggactgaagtcaggttgacctaaatctctgagatacagaaagtccacagctgtcaggagtgtctgtgcgctagaattagtgggttgctagataatcctgaggctacgttctcagaattttactgccaataatgttacaaagttcttactgagcaagtgcgtatctagatgcttggaattcccacacttttcttgaaggatgtgttgtttgtgaattatcgcttgggtgaccatatgtactagattgcctggaacagttccggttcacgttggctgtcctgataaaattattaagggcaccaccttttactttcagaagtgtcctgttatgagtgatacattatgtcatcaccctaattatcagttttaacttaagttggccatgatcttaaagggttgatatttttgcattaaataatgtatttgtaaattatcatcacagtattcttttggtcattgttttttttcttgtataattactgcattactaccattttgattgatttgttcctctcctctaattctttgttatgatgctttttgtcccatgggaaagttagaatggatgagatgggcaagctgtggggaacattgtgtccccaagtggagcacattcaaaagactatgtgagtcacatttctttgaggtctgcttcctgctgtgaagctgacttcctgtttcagtacattctcatttctgatccagaagtaaacacatttcaggacacttaacatttaaattctatcaagaaatttattttctttgatgtggatgcagccaatttaaatttcatcacaggtgcagaagaaccagaagcaatagaaagaggagcaaatcgatcatcatctagtgcctgtgagctggatttgggtcacctgggtgcctccctgcttcgagaaccaacagtgtggtggtttcaaggacctcggcttctggtttgggaccacaaatatttcctaatctctagaaatgctctcagtttacgatctgctttagacacgcactactaagtttatatcaaaggacactctggtttgaaatgtgctctggtatccatcaatgaacatttttcttcatgctcggtagcaatgatggtttaaaactgttcttgccattaataaatctggaataggggcgaggtgcggtggctcacacctgtaatcccagcattttgggaggccgaggcaggcagagtacttgaggtcaggagtttcagaccagcctggtcaacatggtgaaaccctgtctctgctaaaaatacaaaaattagctgggtgtggtggcaggtgcctgtaatcccagctactcaggaggctaaggcaggagaattgcttgaacctgggaggcagacgttgcagtgagccgagaacgcacacctgcactccagcctgggcggcagagcaagactccatctcaaaacataagtaagtaagtaaataaatttatctggaataggcataaccaacatattttgcaaccataaagacagtcctaggttatgtccccagggccgaaaagaaatctggggtggcacaaagcaattcaaaacgagcagaaaataatgtgagttgcttcttcctatttccttttctgcttgggtctcacaaaattcacagcatgtctgctgtatggctttttgttctttaaggttcctgcaggggaaaggacaacctacgggcaagatgtgtggaggccaggcttggttgcttatgcctgtaatcccagcactttgggaggccgaggcaggcagatcacatgagactaggagttctagaccagcctggccaacaggatgaaaccccatctctactaaaaatacaaaaattagccaggcatggtggtgcacatctgtcgtctcagctactcgggaggctgaggcaggagaattgcttgaacccgggaggtggaggttgcagtgagccgagatcatgccactgcactccagcctgggagacagagcaggactctatctcaaaaaataaaaaaattaaaaaagatggatggaacatgtatgaagttttagggtatgtatgttgatacactactttgctagagggtagacttatagcagtctggaatatttagaaacatgggtagaaactggaggttactggaaaagatctttgaactctggaaattagtgctatgaagcacagtaccaaaaagccaccaactgtcctcctaggaaagacccttcgctcattttctcataacaccttgatatggtttggatgtgtgtcccctccaaatctcatgttgaaatgtgatcccaggtgctggaggtgcggcctcttgggaggtgtttggtcgtggaggtgggtcctcatgacctcgtgggtgctatcctcttggtaatgagtgagttctcgctctgggtttatgtgagatatggttgtttaaaagtgtgtggcatctcccccacctcctcttgctccctgtctcaccatgcgctgcttccgccttcaccttcagtcatgattgtaagctccctgaggccctcaccagaagtaaatgctggcatcacacttcctgtacagcctgcagaactatgaatccattaaacctcttttctttataaattacctaatctcaggtattcatttatagcaacacaaaaaatggactaatacacacctaaactcgaattttgctcataaggttcccttacacttttaaagggcctgacagtttataaccacggactagtgagccagtttgagttcaaccattttactttcttctgatgtacactctcctaagtgggtggcactacaatcccaaacccaccactagagattttaattcaggaaatctgatggaggggtgggtctaaggatcagtttcaacaaacatctacctcccttggattctctggtgggtgttcctaggaccacaccgttgtggcgggaaggccacgttctgtgggacagctggggaagcacagggtaccaactggaagagcccaagctgggatcctcctcaggctgagtccacggtctcggatttgtgagattcagagtccggggcagatctgttgcagcaggtctgtgttttctccatggccaaagcaagtcaggtgagcagtgcacctgtgacagctggcaaggcaggtgaaacttgcatacctaggaaaatgagcacttataccttcaagtgtttcaaccttgggaaggttgtatgatggctgcttaaattaggatgtctttggattattgcagtgtccagttattgttgggtgctgtattcattattggtgccaaataccaagaaataaataatattctcaaacatgaaataaaaatgtttatatgattctaaatatttaatagaaaccaaattcatgggaggaaaaactaagtcccatgttttttcatttcctcaaaccagtctaaatagcatgggtatgtaggaggataaacatccgcgtgacacgcttccaggttgaaaggaagcagaatggcctaaagtcagtccccattgttctatcgtggctgcttggcctctggaaaattacttaatcttgctgtctcaggtattgtttgtgaagttggaagcaggggatgggagtgacatattttgtcctttataaacatcatgggctgatttattaaaattcacccaagtgacaggatgtcttacaaagcatgaaggtattggaacaaaaggctagaaaaatactgatttagaaatggtcgaacttcctatgtttccaggaagaccatgtgcctggttctacacattcacttgagtagctggtgtggtcacgtggaaatatttaccaggaggagaaccaagtagaaagctgacacttttcacacaaatctacctaagccattgtgcctacatgtattggagaaaatgcagttccagctctctaggtgccatcgtcagaatatggttttatgctttaagcgttttatggttgtcctcatttcatattcatcactacttcctcagacaaaatttagcaaactttaatctttattaaggtttcatataaaaatggaggccaggtacagtggctcacgcctgtgatcccaatactttgggaggctgaggcaggaggattgcttgagcccaggagttcaagaatagcctgggcaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaagaatagcctgggcaaaatagttagatcctgtctctaccaaacaaaaagaaaaacaaaaacaaaacccgaaatttgctgggcatggtagcatggacttgtagtcccagctattcaggagactgaggtgggaggatctcttgggcctggagggagagtctgcagtgagccaagattgagccactgcacaccagcctggtaaaaaataaaataaaataaaaatacataaaaaataaaaaaaataatggcaccgggctttgtggctcacgcctgtgatcccagcactttgggaggccaaggcaggcagattacctgagatcagcagttcaagaccagcctggccaacatggtgaaactccatctctaataaaaatacaaaattagccaggcatagtggtgcacacctgtagtcccagctacctgggaggctgaggcaggggaattgcttgaacccgggaggtggaggttgcagtgagcagagatcgcgccattgcactccagcctgggtgacaagagtgaaactccatcttaaaaaaaaaaaaaaaaaggaagattctagttctgagtgaacccagccattttctttccttccctgactacatcatgggagaacatatttccaagatccttttttttgagactgcacttgatgtagagtttgaattcccacctaatttaatactttgcccctcaaaaggagaaatgacccaattgttcaaggctttatagttattccaaatgaccaccaaattcatgtcattttggagacctgctttcatgtcatttttctttgaaattaagattattctagacattgaaaatagaaagaaaaagataagtaacctaagggagctgaagcccctccaagcatccatatatagtcattttttttataaaccttaattcaaaaatctgtttgggcagtaggatcaatgcagtcacaagcctatgagacagaactgccttgggcttaatttgttgcagtgttagagaaaataatgttaggggaaagtatcaacatcctatactacacactgattatacaaaagggtataaaatacaattgacagtatcttttaaggtttcccaggagttaaaaaaacaatgacagcaaaaggatatgtatgtcgacccaaagcttattcacttcttttagcaagactgccaaaaggattctgttcctggggagtcgtttgagccaggatggagaccgatttattgggtttggcacactaggtcactggtggaccaggagaggcaggtaggaaggtaggaatcaccttgtgtttcattgctgagtgaatcccttttcctccctgttatttaatttttttttctagggtgactttaggatttatataacattttattcggttcagcagccacttggctttgattgtgcaatcagtactctgccgtcaattttcttctatcagtaaactacttctctggaacaactgcctggcaaacaaattgggtcacaatatgcttgtctgtaaagctgacagcacatcacatcctccacgcagcgttacccagatcaactgtgtcagagtcccagcattatcacatgactgttgttcttctcagtttagcaagaaatgacttaattttctatagatgagcttaacccttgaatgggactttgccagtcttaaccgtgaaagaatgtgcagtggaggaaatgcagatttctcattcaccactgtcctctcctgaagtagtcagcataaccatttaacaccaagcaatccaggaaatattttcacaccctccagactgctgactggctctgatgacttcctaactgagcaatcactaaacaaataacttttaaacaagtccaatgttgacaggcagactgtgaatatcttaattttttttggaaatgtggctataagtgatagagtctttgctttgttttcaatctaaaataactcaatcaaatgtcaattttctggtgttttttttttagacggagtctcactctgtcacccaggctggagtgcaatggtgatcttgactcactgcaacctctgcctcccaggttcaagcgatcctcccatctcagtcaccctagtagctggactataggtctgtgccaccacatatgctagtttttgtatttttagtagagacggggtttcaccatgttggccaggctgttctcgaacccctgaccttaggtgatctgcccacctcggcctcccaaagtgctgggattataggcatgagccactgcacctggctttttttttttttttttttttttgagacagggactcactctgttgctcaggctggagtgtagtggcatgatcatggctcactgcagcctcaacctccttggctcaagcaatcttcccacctcagcctcctgagtagctgggactacaggcgtgtgtcaccatgcccggctaatatttgtgttttttgtagagatgggttttttctttgcctaggctgacctctaactcctgggctcaagtgattctcctgccttggcctctcaaagtgctgggattacaggtgtgagtcactgggctcagcccaaatgttaatctttaaatagagaataaatatgattattaccaagttttgttctggattcacccatacagacttcccctaaggaaggctgactcgactgagtgcctaacgtggcaacagcaggcactgtcactgagcccggatttggtgccacttccctgcaaatcaacaagccatgtggtggcaaggtgattacattggacctttccccattggggaaataaatttgtcttatttgggatagacctatgttctttgtattgatctgccttccttgactgtaatgtttctgctttacgcgctatcaatagtgacttcatattccacatcatattgcttctaatcaagaaagtcatttcacagcaaaagaagtgtagcagtgggcttgtgcctacttgcatccactgtttttaccacattctccattacccagaagctgctggcttagggcagtggcatgacctcctgaagacgctgtcaggccatgaggggatgcaccccagacgcatggaattctatcttagaggatgcagtaggtgctatgaagcagaaaccaatatttgtgcgccctttatctagccagaat

SEQ ID NO: 11906 - DNA, 11641 bp, Human
caacctcaggtgatcagccagcctcggcctcccaaagtgctgggattacaggcgtgagccaccgtgcccgaccaattttttttttttttttttgagacggagtctcattctgtcacccaggctggagtgcagtggcgtgatctcggctcactgcaagctctgcctcctgagttcacgccattctcctgcctcagcctcccatgtagctgggactacaggcgcctgccaccatgcccggctaatttttttgtatttttagtagagacggggtttcaccatgttagccaggatggtctcaatctcctgacctcaggtgatccacctgccttggcctcccttttgtgtatttttaaaagagacggggtttcgccatgttaggcaagctggtcttgaactcctgacctcaggtgatctgcctgcctcgggctcccaaagtgctgggatgggattacaggcgtgagccaccgtgcccggccttttttttttttttttttttttttctagagacagactctccctctgttgccctggtgcaatcatagcttactgcagcctcgacctcctgggctcaagcaatcctcccacctcagcctccccagtagctaagaccacaggcatacaacaccatgccttgctaatttttttttttttttttttttttttggtataagcagggtattgctgttgcccaggctggcctggaactcctgcacctggcctcaagcgatcctcttgccttggcctcccaaatggctgggatgggattctaggcgtgacacaccgcagctggctgccttttttgttgttgttgagacaaggtcttgctctgttgcccagggcggaatgcagtggtgcaaacatggctcactgtggcctcgacttcctgtgctcaggtgatcctcctgcctcagcctcctaggtagctgggaccaccaaatgcacaggtgtgcactaccatacccagctaatttctaatttttttttgtagagacatggtctcactttgttgcccaggctggtcttgaactcctgggctcaagcaatcctcccacctcagccttccaaagtgttgggattacaggcgtgagccactgggcccagcctctattgagttttaatctccgtttacttgactatcaccttcaggatttcaaacatccagagaccaccaaggtgcatggtgcacaggtctaaattgcaggttgaatctcaatctagtattagtattccccaatgcgactacagaactgattattactatttattttttttgagatggagtcttgcactgtcaccagggctggagtgcaatggcgcaatcctggtttactgcaacctccacctcccaggttcaagggattctcctgcctcagccttccaactagctgggattacaggcgcccgccaccacacccagctaattttttgtatttttagtagagacggggtttcaccatgttagccagaatggtctcgatctcttgacctcgtgatctgcctgcctcagcctcccaaggtgctgggattataggcgtgagccaccgcgcctggcccagaactgatgattaacccagctgagcctctgttcatctgaatgggtattgtcaacagcactcacttacaagagttgctgagaagatccaatgagacaaatagttgctaaagtgccaggcatgcagcagtgcttaagaaacttctcaccctgggttttttattggtattgattgatgtagaggtgggggagaagatcaaagacaaggattgagaatcagggatgggaaaagcagtgggccactgacagccgccctgcctgcctgggaggtggggtggggaaagtgggcgggacatgctcctgggcctggcccacccagatcacccctacaggctgtcggcctgtgcgtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggtaagctggaagggtcttgtccatcctcccagatctcagcagccccagccccagggtggggcagggagcctgccgggagccgggtggggaaggggaagctcaaggcttccctgggcaggtctgccgccccggctggggacctgatcctgccatgcctgcctctggctgcccctcacagcttcccctcttggcccagccctggatgccggagaactgtaagaactgggtcctttaacagtctgggagatgggagtggaggtcagagccaaggtcaagggcagagagagaactttctcagcgcttgctgctgcccaacatccctagactgggtccagggcctggccaggcatgtatccctgggcaacattcatcggggcccagcaagcccaggaagtcgggggtggctcccctcaccgggaatttaggccacttggatgggggaggcagagctaggcctgagtcagcataggttgctggccttggtgggtgttctgaggctctacctgctcccctcggaagcctggggtgttggtagagggagttggaggtgcagtcagcatcctccagccctactgtcctgggggtgccgggtcctggagactggggaagaaggaaggccatcttatgtaaggagctacggggggtgggaggcaagcaaaactctttttttttgttttttgaaatggagtctcgctctgttgcccaggctggagtgcagtggcgcaatctcggctgaccgcaacctccgcctccaaggttcaagcgattctcctgcctcagcctcccgagtagctgggactacaggcgcacgccaccatgcccagctaatttttgtatttttagtagagatggggtttcattatgttggccaggctggtcttgaacttctgacctcgtgggccactatgcccggctgcaaagttctgttttaacaaggccttgcccctagaggtggaggagaggagggtctgccttcaccctgtccctgtccggcagatcgaggaggagtggggagctgggtgagggcacaggtggtccagccctcctccaccccttcttgagagctcttggggcactttcgaaaacactcccaggcctagcggaaggagggtgggcgaaggtccccaggccctgggcggtgggggtggggctgtgtgcttggcccagggtggggctgcacaccccctccctctgggataggaggagggcgctctccttctgagggctggaggctgcctggggaaatggggctctgggaggggtgcaaactgaaagtgaaacagctgacatccaggaaacactcgccctgatgaggggtcacagcaggttggggctgcggtcaggaccaggcaaagaggaaaattggggccggggacagaagaccaggtgtgtggtgggagtacgaggcaggttatggggcttcaaagaaggccctgatcctgagggctccctccggtcactgcaaggcagcagtggggaaggcacagacaggaggtaaatagggaaagttgccctgagaaagaacacactctgaggtccacaaactggaaaagaaatcttgcatgcgtgttgagtacatggactcacggagattcagacaaacaacctgactttccgtgactaacgatgtgacctcgggcactcaactctttgtgcctcacttttcctgcctgtaaagtgggtatgatggcgctcaccctgctgggttcatgtgagtttccagtgttcaccacccacagagtgctcctaagtgggagagtatatcttaggctctcaggaaatgtttgcggctaacagcccagagttaaaaaacaggtgtgttctggccagccagagggaagtagggcctctgaggacagccttcatgggccattggctgggcagtggctcgcttgcaataagcatgtgctgggtgggctgcaggaggccccaggaacagctaaaaaccccccaggctcttgccccaggagtggcatgaacttgagagccagcgggcactgctgcagccacaccctcctcgatggtgcagatacctcagtctgcccttggctgcctcaccttcttaccctgtctccctcaaagagggagtgttcagtaagttgtttcctcccagcagacttcactgggacccatgctggagtaagaataaaaagtcccagaggaggccaggcacggtggctcacacctgtaatcccagcactgtggatggccgaggcagactcacgaggtcaggagtttgagaccggcctggccaaagtcccagaggactaagggcctttctgggaatgggggatcctctctcctatgtggacatggcaacctgtatggggtccccagtcacaggtctgtgctcacccccatctctgctttttctcgcccttccccgcaggctgatcccgtcctccactgagacctgaaaaatggcttcggggcaaggcccaggtcctcccaggcaggagtgcggagagcctgccctgccctctgcttctggtaagggtcttcctgccccctcacccatcccataaccatgagtgctgtcgtgaggatggaaggagcaggactcaggcaggctccttcgcctcggttcacccactgtggctggggaatactcttccccacccacgggctcagaggctggagctgctgtcaaggttaagcccaggagggggaggagtctggactggggagggcctggaggttgggagaggccaggaagtgagtgtaaggtaggcacagtgccaccggggcagagggctgggtcacgggcgagggaggcaggaattagagtggggcctggctgctgtatccctccagcgggagaaataaggaagtaagctggccaatcacccagtcaggtctgctcaacagggaacgcaattattgtgacttggggaggaagtaagatggctgccctccttccctcttcccaggggatagccagggaagccccagctcacacctcacggcgggctgttccctggacttgggaatcaggtcccaggtctgtcactatctccctgtgtgacttttctgggccgcagctacaaattcagattttgtttcccacatttccctgcacgcaaagggctgcggagctgagatgtactaatgtagactcaggaccccaaatgcccgggactgtcccggttccccggcttgttctggctgtatgaccttgcacacgttactcagacaccctgtgccattttccccctgccagctggggattgcctgctcccagggctactgtgaggactcaatgcaagtgccggaacaactctccacacagcataagctctaggggcggctaaggtgctgaagtagggatatttcttttcttttttttttttttgttttttttgttgttgttgttttgttttgttttgttttttgagatggagtctcgctctattgcccaggctggagtgcagtggcgtgatctaggctcactgcaagctccaactcccgggttcacgccattctcctgcctcagcctcccgagtagctgggactacaggcgcctcccaccacgcctggctaattttttgtattttgtttagtagagacggggtttcaccatgttagccaggatggtctcaatctcctgacctcgtgatccgcccgccttggcctcccaaagtgctgggattacaggcatgagccaccacacccggccattttttttttttttttgagacagagtttcgctcttgttgcctaggctggagtgcagtggcacgatctccgctcaccgcaacctccgcctcccggggtcaagtaattctcctgcctcagcctcttcttgagtaggtgggattacaggcatgtgccaccacacccggctaattttgtatttttagtagagacagagtttctccatgttggtcaggctggtcttgaactcccgacctcaggtgatctgcccacctcggcctcccaaagtgctgggattataggcgtgagccaccgcacctggttgggatatttctttccatgggtgaggacagctatggccttaggaagagtgaatcccctataaggcatggggctgccagggttcggccctctctccctgactcccagctttgatcctcagaggagcaggtagcccaggacacagaggaggttttccgcagctacgttttttaccgccatcagcaggaacaggaggctgaaggggtggctgcccctgccgacccagagatggtcaccttacctctgcaacctagcaggtgagctacaaccgctgggcccacaaggacatcttcagggaggcagtagctcgcatgggtctctgtgcaggtcctgggagctggggaggcctcgggggtcttgcccttctctcatggttgctcctcttttatgttgggctcccacccccatccaggaccttgtatcctttttagcccatgcctgccccttctcctggagcccagcactcatgtcttagaacactgtcagggacctccaagaagggatgcacagggccatggacagctcaggcagaacccctctgccatgagccagggcctggtcccgactgcctggttactggctcacctgcatgcctcctgctcctacagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggtaccccagccacctccctgccagctccagtcactcctctgtcatgtcacaaccataccataccctgcctgcatgatgctctcctggcatggggagaagccttctgtcagtgtccaatgtctgctgtgaactcacatgtggtctcggccccctatttttctctttcggggtcccagacttgtattttgggcattagctcacagctcttttgagctctgactccaaggtcttgactggttagatcaggactctagagggggcctgaggtggggacgtcccccacagctccccagcccagctgggacatagctgtccttcatagttccaatttgaaaccacatatcacactgaagatggtgagggtgctaacctctgccaggtcctagaaatggctcctacttgctataatctggcatccaagtggttaaagacaccgaatatttgggtgcaaatccaagctttgccacttactgccttcgtgaagcttcctagcccttagtctcctggtttgtaaaatagggaaaatatgcttagattagtgtccaccttacaaagtgttagccattgctaccaccagagttagggaagtcagtgtcggagtagatttgaaactggaggtgaaggtaggagtaagtgatagattttagaattagtgctcagagctgaaatatccagtccgtgaacttagaggccagccttcataccactgtgatgacaggaactaccctaatcttttctgtccttttctctctgctgtccctcgggctgccaggccagcagcaacacccacaggtaatctccccgctgactccatccacttgctctgccctctgccctctctgtgccccgttgcacctgagcgtacaccccagcagtggcatccagctcatctgcccctgagctttctcctttcgcagagacccaggttgttcccaaatacaggccaggttggggcagcctctgcggccttaattcacagctaagctatttagcttccagctgggagaggggtgggagaggccaggcaggctgaagggcttcctgggggctctccaccaatgctatgggatgctctgcccacagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtgagtatccaaggactgcaatgtcctccctgctgttggggctgcccctctcccaggccccaccccttcctcgggttcctatatcttctgctagcctctctgtgaccaccttgtttctcccggcaggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctgacttagtttttgtattctctgctacccctctttccatcaggccagactgtgggaacctgggcacgcctggcatacatctggcttattactgaataaaacctcacactaggcctccagaatcccatagaggcctgagtatggttctgcagcccccactccgatggaaggcgttcgcccctccccatgaacttctctcatctcgttgggtttcatgcagtttccaccctttaggaagtctgggaggtcctttagctacagagctggtggagcagctgcacatatctgaggacccccacaggctacctctgacctgggctgaattcttctcccaccctggggctaccacccacgctggtccaaaaggcccttctcccccacatttagctctgcctgggacacaatgtcccagctcccccttcctgatgtctccacagtcagcacacacgcagggctttcattctagttttatgctgcttgggagtccctatgggtacccagccaggggtgataaaaataacaagcatgggggcgtttaaatgttccaaaatctacagtctttccagtcctgggcaccctggtctgtgtttctgacgcccttccaaaagggtcacatgcaagtccaagagaactcgtgagtttcaccttcaccctcctggggtgggcttgccaagccccttttccctccacaaggtcttcagagtctagtacagacgcgatcttggaaaagggaaaaggcggcgctgcaggcagtggtggctggaaggtggttgctacaaggcaccccgcagtgtacaggaaaagctcacagacaacatttatagaacacatactgtgtgccaggctttatgctgagagttcatcatctgcccaaataataggtaggagacgggggtgggggtactcaaactactatttacagataaggaaacgggtgctttctcagagtcacccaaggagtgaggacttgccaccaggaaactggctcgagttttacgtggaggccggagagcaatgtggggctcgcgagcacaggtttaagaggcccagagtgcggggtcgcctccctcccggagcgatgccatagaggttagaagtgggcggctgcccgagtccaagatggccgccgccgcgagcacgcaagcgtgcccttccttgggcggggcctttggggcgcacccactccagcctctgggctttgaacagcatgcggcattgagcggcgaacagatcgttgcatcgctggaagaaaggcgggtgggctgtggttagcctactcgtctaaggagctgcaacgctaaccggaaaggcatgggtggggcagcccaaaaagttttggcctgcaccgccccccaacgccctctattccgctgccaggatattctgaaaccagggggcgagaagttaggtcggacacagtcagccaggggctgcgaggataacgggagtgtaggggctctgtgggtattagggaagagaaaccaaaaaaactcatttctactcaaactgtgcgctgcttctgagattgtggcttggtttccaccaaatacgtctgggttcgtcacagtctgtgatgtcactgagctggggcagcccggccagggaaaggagcggtgtgcagctgtcacctgcttagttctgcagtttcagtatgaatacccgcccttccttgcacacaacagcctcacattctccccacccccaccctgccgttttaccttcacgtatttatttttacctcctctgaagagtatattttagagagtcaccgagtgtccatccaaaccctttcatttgaaaaaatccttccttagcctaaaatcactcagtatattgaacaagttattatgacatagtcacctgaatgcattaaaataaatttacatgtattcattaaacttaaaccaccatatccactagttttttttgtttttgttttgttttttcacccgtgacaaaaatgtacccctcctgctccagttgtatgcacttcagatg

SEQ ID NO: 11907 - DNA, 31868 bp, Human
  misc_feature (1)...(31868): n = A,T,C or G
gtggtggcaggcgcctgtaatcccagctactccggaggctgaggcaggagaatcgcttaaacccgggagtcggaggttgcagtgagccgaggtcacgtcactgcactccagcctgggcggcgacagagcgagactccaactcaaaaataaataaatacataaataaacagataaatacagagtactccggcctgggcaaggggtcagagtgagtgtgccgaggccagggagggtccccgtgcacactgacaggcgctggcctgggtaagcctgtgggctgcagagccgtcgccaggatctggtgacaaggaccccgagccacagcctcccttgtgacttgcgggttctgccggcgcctgcaggaggcgtctttctgcttctcccactgccaggcatgggcggttctcgtgccgtgcgggtcccgcctcctccctgctcccagccgcgagccctggggctctggcgacctgcccggcctgacatcttcccagggtgaacataaaagaacccccttcagctggagcacgcatctgcctcggggcgggccacagcctggcactgccaactgtgccgcccgcccggcctctcccgcaccaccttgggacaaacagctgtcctgcccgcctatgcggaggtggccggcggggccggcgtgggggcgcagggatccccagggtgtggggcagccaggccgaggcgagagacacggtcgggctcagcccatccactgtcagccgggcacatgctggccctccctcaagtaccactgagtgcctcctgggtgtaggaagagggccatctctgccccggtggcctcgaggtgcagatgggtggggggcacccggcacacgggacatcgtggctgagaggacgtcaggccaggtgccaggagggtcccaggagggcctcctgcctccaggtggggatgttcagcctccacttcttcgagtgtgactgtctgtctcctctctctcacttgccagcttcctcacctgccccctcccggctgtctggtgggctgggtggctagggacagaggcctcatgtcacctggcaccaagcagcacccacgcccagccggcttcggcccagaagcagagccttgggaagcacctgtctcagagctggggactggaggcactgggggcacagctgcacccggagtccgaggggtcggggaaaggaggcaaccccggggcagggggctctggtacccgtgcgaaggcgctagtgggctttgggtctccctgtgaccccaatctaaagcccaccagacctagaggagacccccgccgcacggctccccagggcactgtttgaggggtgggtgggaaccccacaccctcgggtggcttttccagttttccttgtctggctgggcttggcctcagtttcctcaaatgcagaccagggagaggagtgcctgagtctcccagaacggcgcccaagccggcctgcccctccccacgcactcaagggtctctgtccagggcccacaggcgacccagcaagggctcctgtgacctttagaaacaccctttcgtcgtggaagtcttcaaacctcacagaaagcaaggaggcgctggccgtggcggcctctcccgtctcccaggcccgcgtccaccctccccgcgccggtgccctccggacagaggtggaagccgcggcgcaggagaggcggctccggccgggcagcggggcccggtgaccttgggcgcgtccttacacgtcgcgggcctcagtttcccctcctggggagaggcccgcgcggggctccgaggcctcgggccgcgtgaccttggggcgcccccgaccccgcggcccgagtttcccggcgccgagcggaggcggcgcgcggggagggggcgcagccgaggcgggtctcccgcccccgcccctcccccgcccctcccccgccgcgaggctccgccccccgcggctccgccccgccccgcccccgcctcccccctccctcgggctccggccggcggcggcggcggcggctccgctccgcactgcccggcgccgcctcgccatggacgcgcgcgggggcggcgggcggcccggggagagcccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggtaccgcctccgggagggccggtcggcgcgagggggcccggggagccgggcgcgcggggagccgtccttggagcgcctggggagggcggggcggcgcgccgggccggtgacctcggggctcctcggtgacctcgggcgtgtccgggacccgccccggagtgaccccggcgcgcgaggctccgcctctgggggggctccccgggtgaccgcggagcgcccccctcccacgcaccccgacatcctccgccctgcggcgcggcgggtggggtgggccgcagggccagggtctgagcgcagaggggcagagaggacgaatagaggggaacgtgggccccagagaggcggcggagcgggagggaggaggaacgaagggcgcccgggaaggacgcgccccagggaggccgggggagagggggttaagcggctcccacggcgtccacccgcgccccgcctgcgaggaggcgcgcccggggccgcgggcctggaaagcgtgcgggtccccaggctgtgtccccgggagccgctccacccgagccgcgggcggtgcgcgcatgcggcggtgggtgtgtagacgccgctgtggatccagccggctaatgcgtggaaggctcggagcagggccggcgcggggccaccgccactgatgtttgcggtcgtggttcctgggctgtgcgtgctgtggccggagagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctcacacacgcgaccatggagggatgcgtgtgtgtttgtgtatccacgagtggggtgtgaggtggggtgtggagggtgcaggtggagggtgtaggtggggcccgccgggctagcgaggccgggcgcgcgggacgggcgcggtttcagcaccacggacagcgcgccggacctgggaagcctgcggttttcccgcctgtctctcctcctccaggcctgggcgccccaggacagcccccacggaccctggacccccggaactgggcagggaggctgtggggttctctcttcccctggattctctgcacccctagtgcttgactggagaaactgaggcctggggcacatgcgtcctggacagagcctggaggaaggccctggaatcctcctcccaccccaggccttcctgagaggtgaatacagctttgaccagaagcctggatttcgagacaggccaggggtgggaggagccccgaaatccccagaggggctgtgtccggcccctcccaccctgcctctgtgccccaccgggagagcttggtcagcatctgggctctggcctgcgaaatgtggacagtgagcgggaaggactggacttccagggctgctggtcggcctggccccacttccagtcgggcagtggcaccccctgaccggagagggacgcggtggagagggagctgtagaacgtgcccactcccctccgtcccctccagcatgaccttcgacagagatgggtgcaccgcagcgtgggggctggcaggtggaggcccacaccagccactccctcccctgggcagctccagcgaccccctggctgcagaggggcggtcggtggcctggggggcaggtgggcagatggctgatcccggggcttggggggaaggccggtggtaggagtgaagccctctcatccttccaccctccttgggcgtggtcgcctggaggcctgggcaggctgtggccccgctctgtgctctgaggcatagagggctcagaggcccctgtgtggaccaagtgcagccccaccccggcagatgagtgttgaagtggaactgagcaggcagggaatggggttagcggggcctgtcttcgggactaggggagtcacggcagtcagattttaaaaaaggatttcgatgttgccaagctgggtgcacggggcccctaggaccctccccaggcttgggacctgtgccagtgtggaatcagtgtggaaaaagacccccaagaatatctcaaaagctccctaagcaggcggccggaccctgctgtggagggtgttttggggcagcccacagcaagcgaaggggcctctacgtttgcagctgactcaggagcctggccccaactggcttcgggcccaaggcctcctgtgcctggctgggtgtcttgggtcctcgctgggcccctctgcctcagtttccccaattgcacggtggggatggtatgagggagaaggatggggtctttcacagccttgccagtgtctcagcctcacgtctcacactctcttcacctccccttcctgctgagagagtgctgtgctccttgcccagcctgtgccccccaggcacgccctcaccccggttcttcctcgctgcccagctgtctccgccacgcccaagtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccagcactttgggaggctgaggcgggcggatcacctgaggtcaggagttcgagagcagcctggccaacatggtgagatgatcccgtctctactaaaaatgcaaaaattagctgggcatcgtgacgagcgcctgtaatcccagctactcgggaggctgaggcaggagaatcacttgaatccaggaggcagaggttgcagtgagccgagatcgcgctgctgcactccagcctggctgacagagtgggacttggtctcaaaaaaaaagaaaaggaagaagaagtgcagttggtctattgctgaagtctctggggctgtgggtggctctacaccccggcctgacgtctgaaagtccccagaggcatgctgggcgcttccctggggtgctggtggaagagcaagttcaaggacccaagttcaaggttttgggttccagaggctcaagttcccttccttgtaggtgatcacggttggtgcctgaattggaacaggcgtgaaaaccaagaaggaaggggtttggccttatgcaacccccagggcttcggcagggtcttctgtgcctcccagagcaaaattaggtcaaaaataagtatagttcattcctactcccttcaccccagccgccgctgattctaaaggccacacaggtccacttgggaaagcctgagtcgtgcaaaggagggtgtctccgcaggagaggggcaggggctggaggtctctgcacgagaagggctggggctggagggtgtctccgcaggagaggggctggggctggaggggacacgaaggcccagggaggggcggtctgaggaggtcgcgttctccgaagcttgctgtcatccaccctccctgcccccggtgtcaccgagggggctgggcagacctggcggggtggagacctgggcagatccggggtttgtgccctgggagctctggggggcacagggcaggtgtcgggtggagagaggctggcggcttcctgactgccctcggtccagttccagggctaagtgccctgtggccgccctgccgtctcctgctgctgctgacttgcaggtctgtgtttctgaattgtcttcagctggggaggccccgtgtgaggggagacagacgagatgctccccaaagccaggatctgttatgtcccctggggtccccgagaggactggtcggggaggagctgctccaagaccccaccaggacaggcggcccctgggccccgcctcagatggctgagtgggtcagcgggagatcagcctgggggtgcagctctgcaaatccgcagtgatgaatcccagcattagggcgtgggaataaaccccccattatcctggggggatggccccgggggcagggcgaggcgagggtttgtctggctctggtcacggcaggaaggcccagcgtgtgcaggatggtggggtgtgcatggacccatatcccaggtggcggtggcctgccctctggtctgcgtggaggggtcaggggtcggggtggccaaggcctccccgctctcttcagggccttccctatgttccctgctcgaaaacggacatctttgtccaggcactgtggctcatgcctgtaatgccagtcctttgggaggcggaggcgggaggatcgcttgagcccaggagttcgagaccagcctgggcaacatagcaagacccccatctctacaaaaagttaaaaaattagccaggcgtggtggcgtgcacctgtagtcccagctactctggaggctgaggcgggaggatcacctgagcccaggaggttgaggctgcagtgagctatgatcgtgccactgcactccggcccgggaaacagagtgagaccctgtctcaaaaaaataaaaaaaacctaaaaacccacatattcaagtcaccttcatcagccccccactcacttgggccgggccctgcctcaccccccaccccacggttcagcctcgcaccctgtgcgctggccgcctctctcctgccagatgcctccccgtccccctttctggcctcccggctgtcagcatgggcctctccagacatcggtccttctttccctgtcacctctacctcctccctggctccagccctccccagtcatgtcccctggtcccgaggccgcccaccggccttgaagggaacccggagcatcaacctccgcacctgctgcccctcttcagccactgccctcccctcaccatctcatccacccacacgccacctcctccaaggagccctcccacctgcctggggctgacaggcccatcccatgtgtctgtcttggggctgggcctgtgtggtcatcgtgtgccccggcgcccggcgagagttcggtgaacatctgccccgtcgggatcacccgggaacccgagatctcccccacccgtagcagctccctttcttaatcctgggcacctgccacggatctggccatgactccacagctgagagtgccgtctcctaatcccccggcccgaggctctcccttaatcaccgacctccggcccctaatcctctcccggattgtccccatctgtaaatcctggacggcctccggcctgaggctgggctcctgcggggagggcctggctgccctcgcccgttccccaacccgggactcaggctccagcaggggctgaagaccccctgggcaggccctcccctgggatccaaggggctgagggtcctgggccttctgttgccaggagacctggtgtcctcgtggggtttgggagccgggtcggcggcctcctcccccaagcttcatccagccctggagagacggggacctgcgtcggctttgggaacttcaggggaagaaccctgagctcggggcaggagaatgacatggtctgtctgggttcccatcccactgtttcacttatggctggaggagcctcagtttccgtgtcagagccgagagagaggctgggcggctgttggaggagggctgagctcacatcggtgtcaggtgccgggggccccactgaagccactctggagtgagagggggtccgaggcttcttccggtcccccaggtgtgagagctgaggccggaaggtttccccagggacccagcctcatcccggcctccggagctggtctccctccctgcctgcgagggccaagctggacaaagtggcaggacccccgcgtttccgaggaaggggccctcgtagaggcctcactgttacctgtcggggatgggttttaaatacaggatttaatgatggtcactgatgtttctgtgacagctgaggggggcctgtccctgctcagcactggggttggacaaggagggcacagggtgcccggggagtgctggggcccgcctgggtccctatggtggccggatggggaaagggctgccggacgcggctgcacagagtgtgagggggagtggggttgggctttgggccttcccctgaccccaggtcccctctctggggtcctgtcttctggagctgcctccccctccccagggcgagaggcaggagagggtctcccaaggtcactcagtctagtgttgggcaaggagagggttggggtggagagggttggggtgcaccggcagagacagtgacgccctgcagggctctggggtcccctctgccccaggcctcggtttccccttggtaggggacatgcgtgggcgcccttcttccttctgacctctggctggtgacgacgagggttgcggccccaagccctgcttggaggcattgtggttggaacgggcaggcccagccccacaagggaccctcagggtggccaccccacctgtcccttctcctaggcccctctgctctgacccccgtaatccccaggaatactgccctgctgggcaagatgggctgaggagtcctttctggggacacaggagcagaaggctcaagggaggtggtttccagacagtgtgggccgtggataagaggacagtcctggggtctcatcctgcagtcccacttccatcagaggggaggtgtggtacctgcccccagctcaccccaagaataaagggggagaatgtctgttaatcatcacctggaaaggaggccttcatgttatatggccgtttaaaaccaggtaccccttggcggtttctaggtcctcctggtggtttctaggtctccttggcggtttctaggtcccccttgacagtttctaggtctccttggtggtttctaggtcttcctggtggtttgtagatctccttggcggtttctaggtcctcctggtggtttctaggtcccccttggtggtttctaggtcctcctcgtggtttctaggtctccttggcggtttctaggtcccccttgacagtttctaggtctccttggtggtttctaggtcttcctggtggtttctaggtcctcctggtggtttctaggtcctcctggtggtttctaggtcccccttggtggtttctaggccctcctggtggtttctaggtctccttggcagtttctaggtcctcctggtggtttctaggtctccttggcggtttctaggtctccttggcagtttctaggtcccccttggtggtctctggagccccctgggagtttctcctcgcccctcgtgggggaggtttctaggccctgtggccttctcaactgctctttcctgctggttttgtcccaagactggtgctcgaaggtgggaggcaggtctcaatccagagggtgaggctggggctgagctccacggtgagccccctcggggctgaggggcagggggccagcggcaggcgggtggcatcccctcagcccactcggtgctggggccctgggggtctcgttgctgagcagatgtgtcggactgggggcctgagccctcatgtcctgtctagactcagggaaaggaaggccttaaatttctagtccttttagtcatttgatttcacccttcaagcttgtgaggggacccctccccaccccgagatcaagtcagccttttttttttttgagacagagtctcactctgtcacccaggctggagtgcaatggtgcagttttggctcactgcagcctcgacttcatgggctcgagcaatcctcctacctcagcctcccaagtagctgggtccacaggtgcgcaccaccacgctggctaatttttgtattttttgtagagacgggatctcactatcttgcccaggctggtcctgaactcctgagcttctgtgatcctttagtcttggcctcccaaggtgctggcattagaagcatgagcccctgcacccacccttcccttcttttttgagacggagtctcgctctgtcgcccaggctggagtgcgatggcgcgatctcggctcactgcaagctccgcctcccgggttcatgccgttctcctgcctcagcctcccgagtagctgggcctacaggcgcccgccacctcacacaaaaaaataatacatttttgtatttttagtagagacggggtttcaccgtgttggccaggatggtctcgatctcttgaccttgtaatctgcccgcctcagcctccttaagccctggaattacaggcgtgagccaccgtgcccagcctgagtcagcccttctctaggttttatccccagcctgggtggttcttggggggtgtcccgaaggctcagcccctccccatcccgaggcggtggatgcttggaagaagagactgaggttctcaggggctgcaggaacttgtccaaggtcactgtgccagcaggcgggtgccagcccaggtctggctgatgccaccacgatgtgagtcgctgggtcccttccagcgtttggctcttgcagaccgagctgctgtgaacattttggtacaaatggctttttaatttttttctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtggggaccccggccatgatagggaggggctgggcctggggtggggataaggcctcaagaattggccgggcgcggtggctcacgcctgtaatcccagcactttaggaggccaaggcgggcggatcacgaggtcaggagttcgagaccatcctggctaacatggtgaaaccccgtctctactaaaaatacaaaaaaaaaaaaaaattatctgggcgtggtggcgggcgcctatagtcccagctactcgggagggtgaggcaagagaatggtgtgaaccctggaggcggagcttgcagtgagccgagattgtgccatcgcactccagcctgggcgacagagtgagactctgtctcaaaaaagaaaacctcaagaactaagaaggctgagttggtacagggatgggaaggggtcccgtgtgtgtgtgtgtgtgtgtgtgtgtgtgtgtgtgtgtgtgtgtgtgtgtcagagggtctcatgttacccaggctggtcttgaactcctgggctcaagcgatcctcctacctcagcctcccaaaatgttggaattataggcatgagccagtgtgtttggcctagcccccagtgttaatggcaaaatcctatgaatctttgtgctggaaattcaagaccctcccttgtctgagtcaggcacacgcaggccatgtgggctcagaccccagtctggaacctccccttcagcaagagcccttggccccagagcccagaggtttttgttttgttgtgttttgttctttgagacagagtctcgctctgttgccccggctggaatgcagtggcacgatctcggctcactgcaacctccacctcccgggttcaaacaattcacctgcttcagcgtcccgagtagctggtactacaggcgcccgccaccacgcccggctaatttttgtattattattttttgagatggggtctcactctgttgccaggctggagtgccatggcgtgatctcagctcactgcaacctccgcctcactggttcaagcgattctcctgcctcagcctcccgagtagctgggactacaggcacgtgccatcatgcccagccaatttttttttttgtattttttgtagagctggggtttcactctgttggccaggctggtcctgatctcttgacctcatgatgcgaccacctttgcctcccagagtgctgggattacagacgtgagccaccacacccggcctaatttctgtatttttagtagagacggggtttcaccatattggccaggctggtctcaaacccctgacctcaagtgatccgcctgccttggcctcccaaagtgctgggaacacaggcgtgagccaccgcacccagcaggcttttttcttttatcagttttccaattagccattgtaaaacctatcaatcagtgtcattaagcccattcttgctgttgtacaaccgtcaccactatccatagtccatacctttctcattcccccggacagaaaccgcaccccgcacatgccacttctcacccctccaacccccggcccccggcacccatgcatccccttcctgtctctggattggcctgtcctggacatttcgtagaaatgggctcacacggccgggcgcagtggctcaggccggtaatccccacactttgcgaggcctaggcagaaggatcatgaggtcagggtttcgagaccagcctgaccaacatggtgaaaccctgtctctactaaaaatacaaaaatgagccaggagtggtggctcatgcctgtaatcccagctactcaggaggctgaggcaggagaatcgcttgaacttgggaggcggaggtggcagtgagccgagatggtgccactgcactccagcctgggcgacagggtgagactccgtctcggaaaaaaaaagaaatggcttctctcactgaacgtgacgtcctcaaggggcatctgcgccgtggcctgggtcagagcctcactccttttcgtggctgagtcgtgttccatggtggacgggtcgcgccgtgtttgtccctccgtttggtgatgggcacctgggctgcctctgcctttttgctactgtggatcgagctggtgtgaacacagcggagtggtcgtcgtccgcagtcgagctggtgtgaacacggtggggtggttgtcgtccgcaatcaagctggtgtgaacacggcggggtgctcgtccgtccttgttttcatttctttgggtataatctcggggcagggagaggctggtaattttatgtctttttaaggagccacccgtgtttgctccgagtcgttttgattttcattttctcgatagcgaaagggttgggcatctgtccagtagccatttgctgaccctctatgacctcctgtgtggacgcggcactcccagcaccgtgtctggcccgccatacgcaggccctgaaccgacaggaccttttctgccagagcttcccagggagagttttgggatccaccttggggacttggactctggccgggtgtatctgggagtggaaacgccctctggtctcttgtccacgggtatttatcatacggaacgtccgaatggtgccaagtccggctcggccgttcctcccaccctctcggcctcccctgtggcgccagccccgtctctgcttggcttccctccctcctgtgtggacgccccacttcctcccctctcctcctgcgtggacgccccactccctcctctctcctcctgcgtggacgccccacttcctcctctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccacttcctcctctctcctcctgcgtggacgccccacttcctcctctctcctcctgcgtggacgccccacttcctctggaaatgcagccggtgctgccctggttcagtcttcctgtggcccctgtggaggctcccgcttctcagtaaggcatctggggccctcacctcccggcgtgagctgagcacggttcatttcccaccctggcttcccgccttcgctctccctgtgcgcgccgccctgcctcgccctgctgcttcccagtgcccctctgcaccccggctcctctctgctcctctgctgtcctgtcctgtctatttttttaacgccaaccttgtgccaggcacattgtccctctctggtcatgtgaagcacttaatctattttgagccacctcttgggccttgtgaggtctcctgcatcttcaaggacacggggtcaaagttgggcctgaggaagggacctgggctagggcagcgcagtgggcgttgggctccctcggggctgggtggccttcctggggtgggagcctggtcccgagggaggagtgcccagggcttgtcctgcaggcgcctggggggaaggcaccggcctgaggtgtgggcaccctcgccccccagggaggaatgcccggggctggtcccataggtgcctgggggaaggcaccagcctgaagtgtgggtacccctcgcccccagggaggagtgcccagggctggtcctgcaggcgcctggggggaaggcaccagcctgaggtgtgggcaccctcgccccccagggaggaatgcccggggctggtcccataggtgcctgggggaaggcaccagcctgaggtgtgggcacccttgccccccagggaggagtgcccagggctggtcctgcaggcgcctggggggaaggcactggcctgaggtgtgggcaccctcgtcccccagggaggaatgcccggggctggtcccataggtgcctgggggaaggcaccagcctgaggtgtgggtgcccctcgcccccagggaggaatgcccggggctggtcccataggcgcctggggggaaggcaccggcctgagctgtgggcaccctcgtcccccagggaggaatgcccggggctggtcctgcaggcgcctggggggaaggcaccggcctgaggtgtgggcaccctcgccccccagggaggaatgcccggggctggtcccataggtgcctgggggaaggcaccagcttgaggtgtgggtgcccctcgtcccatagggaagagggcccggggctggtcccataggtgcctgggggaatgcaccagcctgagctgtgggcaccctcgccccccagggaggaatgcccggggctggtacccataggtgctggggggaaggcaccagcctgaggtgtgggcaccctcgccccccagggaggaatgcccggggctggtcccataggtgcctgggggaaggcaccagcctgaggtgtgggtgcccctcgtcccacagggaagagggcccggggctggtcccgcaggctcctcggaggaggcactggctcgaggtgtgggcgcccctcgtccccccaaggaagagtgcccggggctggtcccgcaggtgccccggggaggcactggcctgaggtgtgggcaccctcgcccccaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggaggtgaggtggggcgggggcggggccaaggcagcaggggcggggctataatggtgcgtgggcggggccaaggcagcaggggcggggctataatggtgcatgggtggggccaaggcagcaggggtggggctatgagagatctgggtggggtcaaggccccaggggtggggctatgggagatctgggtggggtcaaggccccaggggtggggctatgggagatctgagtggggtcaaggccccagggatggggctatgagagatctgggtggggtcaaggccccaggggtggggctatgggagatctgggtggggtcaaggccccagggatggggctatgagagatctgggtggggtcaaggccccaggggtggggctatgagggtgcaggggtggagctacaatggtgcagtggtagagccaagacagcaggggtggggctatcaggttgctgagcagggtcgaggcagcaggggcagggctatgatgctgctggggtggagtcaagcagcaggggtggggccgtgatatctgggtggggtcaaggagcaggggcagggctgtgagggtgctgggcggggtcaaggcatcaggggcggggctatgagggttgtgctgagcggggtcagacatccgagtggagatatgagggttgtgctgggcggggtcaggcagcaagggcgggactatgagggttgtgctgggcggggtcaggcagcaggggcggggcaatgcgggttttgctggggcagggccagacatcaggggtggggatatgagggttgtgctggggcggtgtcagacatcaggggtggggagctgtggatttggggggtgtcctagggcgggggctgtggatttgggggggtcctgcagtgaaggctgtagaggtgggcgggggtcctggggtgggggctgtgggtttggagggcgggggtcccggggcagggctgcagggtggggccgggggtcctgtgcggggccttggatttgggggagggggccaggagctcccgcagtgggggcgcacggggctggggctctgaaggtgggggccggggggtcagcgggtagggtgggctcacggcgccttcctgcagatcttccacatgacctatgacctggccagcgcggtgatgaggatctgcaatctcatcagcatgatgctgctgctctgccactgggacggctgcctgcagttcctggtgcccatgctgcaggacttcccgcgcaactgctgggtgtccatcaatggcatggtggtgagcgccgcgggccctgacggagggggagacgcaggctcccatacagaggggggacccaggcccccttatcccgcttacagagggttgaacccaagcctttcagaggtggggacccaggcgcccccttatggaggggaggactcgggccctttcagaggtggggacccaggcgcccccttatggaggggaggactcgggccctttcagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggcggggacccaggccgccttacagagggagagacacaggcccttcaggggtggggacaagacccccttacacgggaggactcaggcctctttacagagggggacccaggactgcagccccggcactggccccttaatgtccctgggggtctgaaacagccacttggaacctttcaggcctgggatcgtccgtggagagaagctgagtgtggttatgatgagtcctgtcacccagacatctgcttagcgcgttttccaatggatttcccttttaattaacccacattaattattattattttatttacttatttttttttgagactgagtttcactctgtcgtccgggctggagtgcagtggcacgatctcagcttaccacaaaccccacctcccagggttcaagggattctcttgcctcagcctcccgagtagctgggactacaggcgcccgccaccacgcctggataattttcgtacttttagtagagacagggtctcgccatgttggtcaggctggtctcgaactcctgacctcaggtgatccgcctgcctcggcctcccaaagtgttgggattacaggcgtgagccaccgcgcccggcctggttggatcccttgagcccagaagttgaggctgcagtgagccatgattgcaccactgcactccagcctgggtcacagagcaagacctgatctctaacaactaaagaaaaatttacaacatggccctgaaatgggaaagtggtatcaccatgccaaagaaataataaatgggccaggcatggctgctcatgcctgtaatcccagcactttgggaggctgaggcaggcggatcacctgaggtcaggagtttgagaccagcctgaccaacatgctgaaaccctgtctctactaaaaataaaaaattagccaggcgtggtggcgcgcacctgtaattccagctactgtagaggctgaggcaggagaatcgcttgaacccgggagcagaggttgcagcgagctgagatcacaccattgcactccagcctgggcaacagagccagactttgtctcaaagaaataaataaaaataagtaaaagcaaaaggaagaggccgggcgcggtggctcacgcctgtaatcccagcactttgggaagccgaggcgggctgatcacctgaggtcaggagtttgagaccagcctgaccaacatggagaaaccccgtctctactaaaaatacaaaactagtttggcgtggtggcgcatgcctgtaatcccagctacttgagaggccaaggcaggagaatcgcttgaacccgggagcggaggttgccgtgagccaagatcgtgccactgcactccagcctgggcgacaagagcgaaactccgtcaaaaaagaaggaataataaatgaagttaggtcccagatactccttgcttcctagctgagatgtgctgactgttaagaagggttagttatgggagccctcggccgctacagtcaggttagtggccagtgagcctttgtccctgcctggggagtgctgtgccccagcgtccagccacatatgggacttgggatgtgtttggtttggacacagagcaggtgggcattgatggggtcaggagctacagagggaagacccgccagtgcccctccccagagcctggcacagctgcccaggctgaggcagcccattgtctggctgccacccgcacatgcggtcccatttcctgaacagagccccgcggctcccctttcccggccgggtcagctgaggacttggtgcggcaggacctcctgggccggcctggtgtctctgcccgccctgcccctctgctctggcccagatgctccctggaacttttgccccctcttgacctcacagatgctctgatctcagaggctgcaaaaggcgggacccagactctcgcccttggggtctcagtttccccaggagtgaagcgggcaggtagaatcagccctggccctcctgccaactcactgtgacaagtgtgcaaaccatgtcatctacctgggtctccatttctcttggttacctctgaacatggggagctcaccacctccagtgcttggcagagggtgggcgctgggcccttgaggaccgagggctcctggggcgtgagcacctgcccaccaccgcccctcctgctggccttgcagaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaaggtctgagggaggcgggccccggcctgggttctgatgggggaggcgggcctggatctggggtctgagagagagtcaggccaggccctggggtctgatggagggaggcaggcccggtcctggggtctgaggctggagggaggccttgccctggggtctgagggcggaggtagtccttgtcccggggtctgaggggaggggcgggcccggccccggggtctgaggggagaggcagtctcagcccttcactcagcttcaagtggcgcgctcagggcagagaccgcgtgatggggagcaggggaccctgggggtctgtggctgtgattaggaggagaaacggccggtggtgagaggttctctgaccctgtgacagggagggaggtccagagcctggagatggacgtggggcgggggctggggaggggatgcaggctgggcaggaaggggtgagttgggatcagggcaggacagggtcagtctttggacatcgggaagcccccgggctgaaggggcattgccaggaggctgggcccacctgggggtctctaggccggctcaggatggggctgggttagggaagggcctggcggggtctgagaggcctggggttgcttcaggacacgccggtggccggcagtcagggccaggcttcagggagagcaaggctgccccactgctcagatgcggcctctggcctgcagcgtccattgggttaatcctaggcttggcagtggaggggacacgggggagctgggaggggtggagggagattaggattggccccattggcagcccctggagttgggcctcatgcaccactctgtgcctcagtttccccatgttaggcggctggctggtcctggctgggagccaagtgcccccctctcccgcgccccgagcagtggctggctgggtcagctgggccccgtgccaggcgccctgctgtccggaagccacgggcctcacacccaaacataagctggtgccaccacccgcccgccgtcacgggttccgctgagctcagggcagctgcggccgggcggggctggggcggaagtgaggctggagctgccggggggcaccgtcctggggacagcagggcctggcacccccgcccagcacccacgctcccttccctgctcaggaggggctgacccgatggtttctggaaagatcatcagggaagggccagagcccccgggaagggggtcctgtgtgtcagggtacctggggcctctcctcgtagagtcaggtgcccacccattcctcagggatagggttgctagataaagttcagggcacccggcctggtgcagtggctcctgcctgtaatcccggcactctgggaggccgagacaggccgatcgcctgaggtcaggagtttaagaccagcctgagcaacacggcgagacctcatcgctacaaaaaattaaaaaattagcagggcagggtggtgcacacctgtaatccccactactcaggaggccgaggtgggaggatcccttgagcccaggagttcaagaccagcctgtgcaatatggcgagacctcatctccacaaaaaataaaagaatcagccaggcgtggtggcgcacacctgcagtcccctgctactcaggaggctgaggtgggaggattgcttgagcccataggcggaggctgcagtgagctgtgattgcaccactgcactccagcgtgggccacagagcgagacagtgtctcagaaaaaaaaaatggaatttatcattgaaacgaattcaactttgatttaaatagaagcatgtttatttgctcttgttgaatctggccgcccctgtgtgtggcggaggcctgtctccccgctgtgggcgggggctttgtctgacccagccctgaccccccacagtacaagcaggtgtgaaggcctatctccccgccacaggccggggggctgtctgacccacaagcaggtgcccgtgtgcccgctgcaggctgggggcggtgtctgacccagcctcgcctccccacagtacaagcaggtgcccctgtgcccgctgcaggccgggggcggtgtctgacccagcctcgcctcctccccacagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggtgaggcgggcgccgggcgggcgggaggcagcctccggtacagggccggcctccctctcctggagcccaggagccggtccctgagggaggcgaggtgcctaggctgcagcaggagggactcgagctagacctgcgtacacaccctcccctccccgccccgtgagcctctgcacccccaggacccccgccacccccgccttgcttcccgctgcccccttagcagaactgcctgggtctgtgcctgacagggcggggcagaagcagggcagggggtggggagggaggagccgcagaggccccgctgagcaccaggtcctgggggcactgaggctgattggagcgggtttaactcccagctctgttccggtagcctgagtgaccctgggcaagtttcccagggttgcgggaacaaatacccacaggctgagtggcttgaacagcggagattcggcctcccaccgtcctggaggccggaagcccaacatcaaggcgtgggccgggccgtgctacccccccggagcccctggggaggatccttcctgcctcttccggcgtctggggctccaggcgccctcggcttgcagattgatctccctgatctctgcctccatctgctcacagccttctcccctgtgtgtctctgtctcttcttgtaaattcatccgtcgttggatcagggcccacccggttcctcgtggcctcgccttaactgggccatgtctgcagagaccctatttccacataaggtcctattcacaggaaccgggggtcaggatgtcagcctgtctttctgggagatgtagttcaacccacaacacacatcaaacagttattgagcgccgactgcgtgccctgccgtgtgcttgaaggtcccaccctcaggaagcggggcctagggatggcggccgtgatcacgcaggcagcagagagcagctctgggaagcggggagggacgaggacggggaggcgacatcagcaaggccgtgtgtgagccaggcagggtgtccccggtgtagcacctggctcgggcagaggccccgaggaggggctggaggagctgggcgaggaggcgggcaggacgggcctgacactagggacctcgggccccgggaatgcctctgggggggcgtgtacacccgttgctcccaggaggcacacactgcggttcgcttcgccaagaatgtttaattgcatttgatgactacggtttccattcattcatttgtagagatataacactcagaccacaaaatgcataaaatgcggtggcttttagtattaacagagtgctgcacccgataccacagcctcactccagaacattctcatgggcccaaaaggagacctggggtgttagtcaccagctcactccccgtccccagcccctggcaacccacgctacttagtcattatttaggtgtttaggagttgcaaagtcaaatctttaaacccacatatggccaggcgtggtggctcacgcctgtaatcccagcactttcagaggccgaggcgggcagatcacctgaggtcaggagttcgagaccagcctggccaacatggtgaagccccgtctccactaaaaatacaaaattagccgggcgtggtggtgggcgcctgtaatcccagctactctggaggctgagacaggagaatcgcttgaacccaagaggcggcggttgcagtgagccgagattgtgccactgcactccagcctggacaacagagcgagactccgtctcaaaaaaaaaaaaagtaccaaaaagtgccccaggtcataagggcacagctcgatagctggtccctaaagggaacgtggtgtaaccaccacacagaacgaagctggaacgttcctgccgtccttagaagctgcctttgctaaggggaattgccctgacttcccacaccattgattcatctccagacccttggttttcatgttgatttttcaaaaatcacctgatagtctgaccgaatgtagctttccactggtgtgtgtgtgtgtgtgtgtgtgtgtgagagagagagagagatggagtctcgctctgtcacccgggctccagtgcagttgtgtgatcttggttcactgtaacctcctcctcccgggttcaagagactcgtgcctcagcctcccgagtagctgggattacaggcacccgccaccacacccagctaattttttgtatttttagtagagatggggtttcaccatgttggccaggctggtctcgaactcctgacatcaggcgatccacccaccttggcctcccagagtgctgggattacaggtgtgagccaccacgcccggccttatttttcccccattttctttttttttttttttgagtcagggtcttgttctgcgctcaggctggagggcagtggtgtggggatcacggctcactgcagcctcgacttcctgcaccaccacgcctggctgttttttttttttccggtagagacgggggtcttaccgtgttgcccaggctggtctagaactcctgggctcaagcgatcctcccgcctcggcctccgcaaatgctgagatcacacgcgtgagcccccgcacccggcctcctttccaccgctcttgtctacagccgcccctcctggtccgattgtattggcagatgtcgccaatacggtgtcaaacggcgaaggggcactgagcgttttttctttctcccgtccttggcggcagcagctcggttccggctacggggctgagcccgtctctcagacgaggaaactggggtccgagaggtgagccggtcccagaggcagggcgagggggaagcgggagtggggtccgcagcggacccagccctgcctcccccctgcaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcgggggtgagcttgaggggggcgcgcctggagggggagggggcacgcgacccccgcggtgtgcagagccagggggccggggccggggccggggccggggatggggatggggatggggatggggccggggatggggatggggatggggatggggccggggatggggatggggatggggccggggatggggatggggccggggatggggccggggatggggccggggatggggccggggccggcaccagggagagcctgggtgggaagcgcccacgctggccaaggtgcagaggccgggccgtgtgcctgggcggggagggccgcggcgcccgcctcgtccagcaacccccccctgcgcgccacgtgcagagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggtgagcgggccgggggcgtggccggggcgggtgccctggcgggggaggggcgtggccaaggcatcaggagagtggcttggacagtggcagggggaagggcgtggctgtggcatcaggggcacggttggggcagagacgtggccaaggcatcaggagtgtggccatggcagcaggggcgtggctggggcaggggcagcggctggccgctcctaggacccctttgggtctagaggctgattttctgacctattgtcctacttcagccagaggcagcctgtttcccaagggagggaatgcacagggtgtttgcggttgtgccgaatgctcggtgagcacctgctgtgtgctgggggtgcaggggacagacccgggggcccactcagactcccagggaggcttatggactggtgatgaaatcacacacgactgggctgtgtgccagcagggcaggtggggccggtgggcttccctgagttgggaatgcagagtggagaccagggtaagggatgccatgtggaaacggggaggaagatgtgttcgtggagtggacacagcacatcccaaggccctgaggtggaaaagaggcctagagtccagagagccagggaggcctggaggaggttggggaagaaggggaggccagacacacagggcccagtgggcggcagggagagtttagactaaatcaggagcatcagggagccatggagggttctaggtgggcggaggacctggtcagattgtatccgccaaggcgggccgtgtccaggagggagacggtgacctggcctctcaggggggcagtctctggggcagggaggggcagagccctgatgactggatgtaggcgccagagagatggcggctcatgctgctgttcgtgggaatgggaatgaagaccatggctgaaacgcaggacaggtgcgacggagtggtgtcagggagctccctggtgtacagtaggaagctctccacaacttgctctatacagtgagtatgcaacccgttcctgagtatcaggtgcttaggttataacttctgtatacagcaggtgctcagcacaggctgtgtacaggcaggtgttttcggtatgcctgtggcacactggaggcagtcattacataatcagcgtatacaggtggtacacatgcatacttggtgcacagtgatacctgctccatgtacacagcaggcattaaatacctgtttactgccaggcgcggtggctcacgcctgtagtcccagcactttcggaggccaaggtgggtggatcacgaggtcaggagattgagaccatcctggctaacatggtgaaaccccgtctctactaaaaaaaaaatacaaaaaattagccgggtgtggtggcgggcgcctgtagtcccagctactcgggaggatgaggcaggagaatggtgtgaacccgggaggtggaccttgcagtgggccgagatcgcgccactgcactccagcccgggcgacagagcaagactccgtctcagaaacaaagcaaaacaaaagccctgctttctgtatgcaggtgcttcatgcatgctggctgtgcatagcaggtgctcagcctgtatatggcaggtactcaatatccatactataggccagagatgctacatatgtgcttattgtatacagtaggtggtaaatgcatgcttgctctacacggcaagcactgtgtgcgcacccgcggtgcagagtaggtgctcggtgcccgctgtacgcagcaggcgctccctgtgcacacgctaacgccccctctcccgcaggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgtccccggccgtccccccttatcgccctgcgcccactcccatcgcccctgcccccggcggcggcctcgcgtgcgagggggctcccttcacctcagtgcctcagttcccctagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaagcctggccgcgtgtgattgcccgagacccgcagggcgtgcacccttcctgaagacagtggctcctgggggtggcaaaagagctttatttacacactgacaaggctcacggggtgtcagctgaagaagtaggtggaacgcttcacctgctccaggtcgaaggcccctgcggaggaagcagagcggacggcgtgggtggcgggaaagccccgccctggcccgcagttcgagccacccttgcgaggctgcccacccgcctacctggcttgggcaccgcctgcagtgtctccttcagctggctggcctccaagatcttctggggcctggggttggaagcagggtggggtgaggctgaggccaggttttggggtggggggggaatccaggtagttggggtcagggagcgccttactcagagcagaaccgcttgaccaggaatctggacaggtcctgcaggatgggctcgctgtgcaagcggacaaactgctcccggcacacctgggcaggagtcagaggatccccaggggtgatcaggcaggctctgggcaccacccctacccaacgccccagtgtgggggccccacccatgggtggactgaggctcagactacgggggcacctggttcatgacggagacatcagctgcgtgagtccagtaacagtcgtgcacagagacgaaggtcaggcccttcctgtggcagagcggaggactcctgaagggaggggagctcacagggccacccagtgaccagcatcctggccctgcgctcagccccctccacttgaggtccagggaagcccaccctcctgcaggcctcgccccacccctcgccccgcccctccccaaacatcctgggttaggtatcagtacagggggaggaaatgttcccagaagcctcctcgccccacccctgccgccccccacgctgctgtgggagcctcagctccgagggcggctacgaggtcccctcctgccagggccaccaccccgcatcctgagcattcccagctcccgtggccggtagattctgctggaacgacctccacgtgctccagatctaaccacacatcgcggtgccaagaaatgcccagcaggaaggggcagcgcccatgctcggctctccctgtcgggccacaggaggggagctgccaggaccacctacattcggggcacacagcctcagggcctctacacaggccccacagacacagcagatccactctgcccagtccctgcccccagctagacccagccttgccagctgtgccctgctagccagaagacgcccctgggaggcgagcggcacccacgccgtccggagacgcccacctgtagcagtgcagggcggtgagcatcatgtgggaggagtccagcgagtggatgaagttgggcgggaagccgttcttctgcttacgtgtgttgggctttctgaggacggaacaggtgccggtgggggcggcccagggacacccctaactggccgctgtctccaccgtggctgctctccagacccccggccaggccccagcccgggccccccactcaccggctgatgtctccgttgtgggtgtaggtgatgctctgaattccacctcctatttgctaaaaaggggaaggggccggtgagtcccacccgaggcccagcacggtggtggtacattgaggtggtggtacactggggtagtggcacgctaggatggtggcacactggcgcgggatggggtggcacactggggcggtggtacactggggtggtggtacgctggggcactggtacactgggacgctgttacactgggatggtggcacactggggagggatggggtggtacactgaccttgaccttggagtccaggcgatagggctggatgacggggacgcccaggggtgtgacccactccaccacagagcccatgtgggagatgaggcgggcactctcggtcagccagtgctgtgggacacaggccgtctcagggcagggg

SEQ ID NO: 11908 - DNA, 41431 bp, Human
tcgtgaggaagcctgaagtcaatttaccatgctatcagcatggtatatgtgcacctacaaaaatattcatgtggttatcctcaatttgaccatacaattacattttatgtatttttatttattatttttatttttataaataaaagaaatgggggtctcactatgttgccaaggctcgtcttgaactcctggcctcaagagatcctcccactttggcctcccaaagttctggattagaggtgtggtccactgcacctggccaaatctaattttaaatggtttaagaaaatagaacaataaccatgccaccagcacagtttagggccttgcagagctttattccagacggaatctattatcttgaggtaatattttggtgtaataataaactccacaaagatctgtgtaattttctttctctatctttgataactatgactttaatttgtagtataatcacacacaatccatatagttagtaattatatggtactactaatccttttaagaaaacaacccttttgatacttatttttaaagttggagatatgacaaaatatttacattcagaaacattctcatcaagtggtattaatttcttttcttaaatttacttttaaatttgtcaaagtctagctattaattatatatatatattttaaaagcttgtccttaaaatccaactattagttccataataaaaattaaaatggaacataatggcacaaaatcctttattattctcgaattgagggttggccaattaatggcggatcacttgagcccaggagtttgagtcctgcctgggcaacatagcaagaccccatctcattttttattaaaatttttttgtattacattttatgttaaaaaaagaaaaagaaaaaagcaatctttttttctttttctttttttttttttttttgagacggagtctcactctgttacccaggctggagtgcagtggggcgatctcggctcactgcagcctccgcctcccaggttccagcgattctcctgcctcagcctcccaggtagctgggattactggcacacgccaccacgcctggctaattttggtatttttagtagagacggagtttcaccatgttggccaggctggcctcgaactcaggtgatccgcccgcctcggcctcccaaagtgctaggattacaggcgtgaaccacctattacaggcccatgggtggggctctatttgttttttccattcaagaaagcatgtcaaactccatcagagcatgggtgaattataaaaacataaccgtgcatgtctcctaagttattgtaggcttttatgcacgggtattactaagaaattacttgcgccacacctcactacttaatggagacatgccattttattttgcatccatggttaagaacctctgctatacagaagggtcctaaacgtcatgttatgattatgaaaaagaattgcatgcataaccgagcaattggaaataaaaaagaccaaaagaaaaaaaaaagaattgcttaagtaatcagaaaaaaaaaatggcattgttaaagagttctacaattgagtttgaatgcaagaggagacaaagtgacaagccctgggctcttgagctagtccaagtttaaagagttcgcttggggattccttcacagtccccagtggaaccagtgaaaagagcgtcatggctcccgtgtcccctgaccctccattcaatcaaaagcaacaggcctgaacaatcacggaacaaaaacctcattgcccagcgtaaccttccaaccccggagctgtatgggccgctaatccgccgcacaaagcgggccgctgctcttttcttctcccgcgcccgggcccagcgtggcgcccaactgctgatcggctctggaacgtcccagcagcgcgccgggggcctccggtgtttatttagcgggctgcgggctgcgccgggggcctcctggagagccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtaagcggcggccatcgggggaaaccgaggcagggcgtgggccgtcccggcggcgcggggctgggagcacgctgctaccatgcaggggtggagcgccgtctctggtcccctgtcgatcgatgacctcatccctgcacgcaggtggcacatttccttaagctaagactggcttctgttttgatggcacgtcacagtttacacgaagttgtatcatttacttttcatctatttttaaattttggtataacttacatgttataaaatgcacagatttgaagtgcatagttcagtgagttttgacaaatgtatatacccgtgttaccacgaaaacaagtgagatatttccactacccctgaaagttccctcctcccctttcccagtcagtcccctttgccccagaccggaggcacccattctgatttctatcaccatagattgactttgcctattctacagttccacaaaaatagaatcttacgggatgtactctattgtctggcttcttttgctcagcacattggttttgagatgtaccgatgttatttaatccttacatacttatctttactgcacctgttttacagatgaggcgactgaggctcagaaaatgtagggatttggccagcaaggcccctcagctggcgaactgctgtcccgggactggaatttaggtcctgggcatgctaagtctaattgccttcatggcatagcagctgacacctgggaattatgctcagtatgtgtcctctagtgtcttgatactcaaagtgcggtccatggaccagcagtattggcatcacccgggagtttgctagaaatacagattcttgggcccaccctagaactccagaatcagaatctgcattttaacaagctccccaggtgattttcagtttaaaaagttaaatgttgactaagcagcactggtccagggcatggtctcccctcccacagattgagtaatgtgttaaaatcacataggagctgttaaaaaaaagatgcaatttgtcaacattttttcaagttataaatgtgtgtgctctttgactcagaaggctactttgaggaatgtattataggatgcactccagcaggtgtgcaatggcatgcctccaccaatactgcagcaggtacactccagcaggtgtgcaatggcatggctgcaaagatactcactgcaacaggtacactccagcaggtgtgcaatggcatgcctgcaaagatactcactgcagcaggatctgcaataagcctggaaccaaataaatgcccattaaaaggagacaggtgcttcctccatgtaatggaatactatgcagtggaaaaaagtatgttattgtcatgtagtcttttaaaaggggaggagagtagagttttttttttgcttgcataaaaagaatttcaggacacacacaaagacacacacacacagacacacacacaggcacatgccccaatgacactggctacctgagggagataagtgagtaggaactgagcaattgggagacagaggtgggaaggagacttttaacagaacatctttttatatctttaaaaaaattatttaactatgggctgggtgcagtggctcacgcctgtaatcccagcactttgggaggccaaggcaggcagaacacttgaggtcaggagttccagaccagcctggccaacattgtgaaaccctgtgtctactttaaaaaatacaaaaattagctgggtgtagtggcacacgcctgtagttccagctacccgggaggctgaggcaggagaatcacttgaatctgggaggcggaggctgcagtgagctgagattgcgccactgcactccagcctgggtgacagagtgagactctgtctcacacacacacacacacacacacacacacttatttaaccatgtaagatattcatccatttaaaattacataaatgaattttaaaatacagatgtctaggctctaccctggacctcaagaggggcccagaagcttaaacatttttaatgagtgccactggtcattccagccagatttgggaacccttggcatagggtagtcagaggatttctgtaaacctgctctatgtttgagttccagtttctcaatctgaatcttgggcaggttattcattgttgtgttctgaacacatttatcaaatcacatttattgattcgattcctgtcagctcttttgtcttggggtttaatctgtagaaacagacttggagctggtagaagggacctgaaaatccacttgttacagaacttcatggggaaactgagcctgggagagggcctgtgggtggcagaacttgaacctgggttttctcaccctgggcctatgctctttcgggaacactgtatcttgagataatccgttcttggactcctgcagcctaaggcccagaaataggacctcattcagatgaagctcatgttctccaaagcaaagggggaaagtgccctgtggctcagacatccggggcagcttgatggaccatcaagattccctggatggcctttgtgttggcattagaccatagtctactgtactttggctggtaagcatgacatccatgagtcctagttgaaggaaaggccatgttgggttttcctggtctttactgattgcacttggttctgagttatatgcccatcatgaagcagttccatcaggctctgtgatttatttaaaattcatattaatttattccctccctttgcccccttggagaagttttgacatttggattgtggtagtgggaactgaaaatcattatagaaatgctcatccacatccataggcacacacacatacacatacatgccaggctggagtttacattccagaggtgagttgatggctacctaaagccaggggaaaataatgcagcaatgggttagtatgtgcaggcttggttccatgccagtgctaggcatagtctctacctggcagttgaataatttcaaaatcaggtctttaacaggtcaaagactaaacaaaacactgaataaaacaagaatgaaataaaaacaaaactatcaaaatacaacaacagagtcaattattcaaattgttgaaaactaaaaataatttatgtaaaacagttaattgaagccagttttttcactttatgaatatacttatatgaatatacacatcatgaattctttgtagtgaaatcactctctctctctcttattttattttattattttttttgatacagagtctcgctctgtcacccagcctggagtgcagtggcgtgatctcggctcactgcaagctctgcctcctgggttcacgctattctcctgcctcagcctcctaagtagctgggactacaggcgcccactaccacaccctgctaatttttttgtatttttagtagagacagggtttcaccgtgttagccaggatggtctcgatctcctgacctcgtgatctgcccgcctcggcctcctaaagtgctgggattacaggcgtgagccaccgcgcccggaaatcacttctctttaatataatatctagacttgtctttacagcatgaaaattactcacaatatcaggttaatgtgttgatcctcaaacatgttcttaagctatggaaactcttagatatttccagcaggaaagagcaataagaaaattagattttattaagttttattctcaaagctaattatacatttaaaaactaatttctggctctgttattgcaacacacaaaataaactactaaatgtaacatcctgatgtgaaatgtaaaacttatgcagagatgtttagtttcctagatagaactcagcttcgcagatggttttagatctgggaatgcgtgcacattgcacatattcataattgttcttccttcagttcatgacttttccttctgagaacatggtggtgtggttttctagcacctttcatggttgcagaatacttgacttgaacccatggcatgggcatgcaagggcacagaaaactatgctttgtggattgggctcagtgttaattaggattgctttcaactataaaggacagaaactccaaactgacattgacccacttcagaccaattaggatggcaactataaaaaacaaaacaaaacaaaaaacaacagaaaataagtgtttgttaggatgtggagaaattatggactgttgatgggactgtaaaatggtacagccattgtggaaaacagtatggcagttcctcaaaaaattaaaaaatagagttaccatatgatgcaacatttccatttctgtgcatatacccaaaagaattgaaagagggttttgaatagctacttgcatatacgtgttcataacagcactgttcacaatagctaaaatgtagaagcaacccaagtgtccactgacaaaggaatacgtaaacaaaatgtggtcgatacatagaatattatacacccttaaaaaggaaggtaattctgacatatgctacaatatggttgaaacttgaagacattatgctaagtgaaacaagccagtcacagaaagaaaaatattgtatgattccacttacataaggtagttgggcgtgtcaaattcatagagacagaaagtacaatggtggttgtcagggctggggatggggagaatggggagttagtatttaatgggtacggagtttctgctttgcaagatgaggagttacagagatggatgttggtggtgatttcacaacattatgaatatatttactatcacaaactatatacttaaaatggttaagttggtaaattttatgttatgcatattttaccagccccccccccccccccccgccatacagaaaaaaacagaaaaagtgatactggcttacccaaaatgtcattggcttatccaaaatgtttctcacttgtgtaaggtctggttaagcagtttagtatgatactgtacagtatttgggacacagaaggttctgtgtggccttcaggaaggcagcattcatgtttctggctgcaggatggagggagggatggaaaatgagaagcaaagggcacacatacaccattacttaactaaaggtatctggaagctgccatgcagacttatgcttccatcccattggtcaggacttagtcacatggccacacctggctgcaaggaatgctggaaaatgtagtctcccttctaggcagtcctgtgcttgccaagcatcaagggctctaactcctgaagacagcaagaatgggcatttgggggtcaccttatagggaacaaggggaggggtcatttaggaaggaatcttctctctttagggttaaaattcccccagagggacgtgcctcagttgtcccagccgagcagaaaaggagctggggtacttatgctccaatttgcctcattcagagtttgtgggctgctcccagaggccctgactccctggcacgtccagcctgccccacccatttgcccagaggaggccatcgctgtgtggggagtgatgctgctgggaggagggaaaagtgtgcggagcatctgcctgagtttcctcatctttaatgcagcactaacaataactgctttcttctggggtgatgtaaggattaaatgacataatccagaaaaactgacaaattacatgtgtcagcaaataaaatactataggaaatccaagtacggtcaggttaatggtggtgtagattgtgcagggcagtctcccatctctgccactgctgcacttgggttatagataggctaggatataattccctcatccttggggtggctgggaataaggctgtaggggctggggttggtgccttcgggctgggagactcctattccgctaactgcccctggttaccccacgcggtgtgcaaatggtaccactttctgattgggaggcagtcagctaggaaatgcagcattcgttagctactactttaaaattaagaccctctccttaaaggagagggcatcgtacccaggttgaatttaatgctgattatgtgatccatacatgtgaaagcatggtagttacccaactctcacttatgtgtccaatttgcaggtatgaaaatgagtgcgaatgtcaactcctgctaaaagaaatgcttgaacggcttaacaaggtgagcggaacacatccttgggtttacgtagcttaattacagtgttgaatggaatggtggaagtgcaggttttacaggcttcctctttgtgttactttggcggtcactacttcttttgcagtcactctgtctcttgacttgttaatttcaattgagtctttatgagtgaactcacacacccatacacacacccctctctcacgagagaaacacagactatgaagcttgttggttatgctaggctagcaaaacctgccggcgttacagtgacaagctgctgttttacttgtcagacatactgatgcccaacaccaaatttaggaaggaccttgctttgggcagtggttatttggacacagtgatacctctgtcctattggctaagagttttgagattgcggctccacagaagtctcaagataacagaggaagaaatttctatttcctctagagttccctcttatagcgtgaccaatagccccaggggagatgccaggggttcttagccacttgactttcctgcagggttatgtggagttgctctttacagaacagtggtgatttccttcttgggattcttcatcatgattctaactaactgattggattttctgcttttgctgggagaatcccaccaccaaaaagcagaatgattctggaccaccagggttgtacagaaccagggatggcacatagctttaagcatggcccttttctgatcgtttttgagctccaatgtcagagcagaacgacccatggagactatttagtggaaaggctgcttgattagggcacatgggctgcccttccccgccccttccatgcctacaactcatcaaaattgctgacaaaaccgcagactcttccctgccatgcccaggtatgctttaggcttctttgccacatggaactccaagcagcctctttggacagtcagggttagcgccggatgtttgccatcccttcactttgtccagcctttgctgtctaggattactctgctggttgaggggaaaatcagaactagaatctaggggaaacccaattttgctttgtctatgttacctgcccctctgcgcgtgagcacgtatgatatgttcaaaccaggacagtgtgcaaaagagggtgcagtttgtaataacacaggtcagtcaatgcaggctgggactctcaggacagctagtaggacacttgggcaccctagatagaaacacagagatggcagtgagaatgcacttcaggaaggccctgaggacacacgctcaatagttggcttggaaaacgatggcctcgagcctgttggacatctgagctgggagttgggccttattagtgtctgacatcactctgctattctgctgacacctgtagctcatccccattcttctgttttgtgcaacctcagactgccagaacatggccttcagacacggggacccagcacccttcacagcacccctcaggccctccgaggccctctccccaacacttccacatgttgctttgtgagcatctgtcctcacttgtcactcacgcagtgccatcctgggtactcttcaaataaaggggagaaagaatggggttcctcttttacccttgatggaaaatgacagtgaatttaaaaaacaagcttaaactttctgttgtttttctctttttacaaaagcaatccatattctcagtagaaaaaataaggcaacatagataacgaaaaataaggaaaaggcatcgcataatacaccttcatgtatattgtgacatagagtgtggacatttgaagtatcagccctgtaagaatattatgaaggttctggggaaagatgctaccaagaatgtgggtgagaccagcacaggcaattagcatgactggcccctgggtccaagtaagacagtactgcccgcaggtgagctgcagagccccagcgaggagtgtagcctgtgactaggaacctcctgctacagctgagcatctgtgagactgtgggccaattgccttgtccctctgagcctcggttttttcatctgtgaaatggaatcacaatactccccacccaccataggagtgaaagtgcctagtgagaactaaatgatgtaataatgtatatgacttgcccatcacctggtggtgctgaatccctgatcactgttattactacagagcacttgatgtgacagacaccagcttggttttctccacagtgtgggtgcagaaccctgttgaaatgggaggtgactttagaaagtgcatggaggagtgatatttaatagttgtgaattttttatgattacctgttatttacagcggatgacataaaatattcctttccaaataaacctacgtaagaatgagtacctttaaagacaaatacagagtgaataagatgcaggtggtccttggataatagtagaaatcataaacacagcaggcagatgcaggacgctggggagggccttgtgcaagcctgtgggagcctcagaacagcccgtggttattgggggggcaggttttattctcagaaatgacctattccaaatccttctctgggccagtgaggaaactcacccttgatgaggttaaatgacttcagagcctcgcagctcagccgtggtaagtgtagacaggagttggggtcttttgtatttgtggttcattctctacctccaaagaatagtcagggaaccggtattactcagaggccagacacgaagccagagagttctcggctataggtggccccatggaccttgatgttggtgtcctgtccacacaccttgggccatgccagtggtcactcagacacgctgaacaccctgatcactgcctgcatctcgggctctgggaacatgcatggcccacatcagtatagtccagaagcgctgggtgttaacaccccaggaacaaccctcagttgctgtggactgggataggtggataagttccccacccctcatagtgatggttcagagccacattccacatggtccctcagagggaccccagccgtactgagctgtctacaatggcaacctgctcgtcacattccttcattggttttgtttccttctctggctcactagcctcccttacctgtgcttcctgggatcacctcccagataagccacaggtacccagtctttgccttggggtccacttctggagaacccaaatagtccctcaagggcagggccaggtgaacactggacctttttgttctctgctgagatcatcagatgacatgaaagaggctaaaattcacatcgcatcagctggtcgtgtgagtgattttggcctgcaggttttgggtattttcttacatcagatcaacgaggttttagctcagtctcagtggccatttcctttggtctgacttgtggaagggattcatccctgggtgtggccgtgggacatcactgatccagtctttgcatcctacttggaggatattgcagtgtatgtgaaaggactgatggcccctgccttcacaaaaccaccatgcatttcttcatgctgcccgtgtaatcaagcctacggaaagagctcctgtagttttatcagccagataaattatagtaggccactctttgctgtgcacttagaagtgaagtaaactcctcaacacgttacctacaacctatggccaaagttattcaacttctcagccttttgatgtagtaggaattccaggtgactttaaaatatttgggtttgctaacttctagatctcatggtcaccaaatatatacgtatgaagttactggtctgctatgatgcctgatttgcttatcttgaggaaactgtaagcagcagactttaaaatctccctctccttttctctttaaaattcccagaattttaaaatgatgtggtttctagtcaaatgctttcacttaaaaacaattttaaaaatatttaaaggctgacatatatactttttcatgtaattcatgtgtctcttaaacgtgcctgtggaaagcagcaagaggccagggagtttaggggataaaatggtgcaggcatgaagccctaccttcagggctatgcctttgtatgccaagaattcctctgagcccggaaatgaacttccggagaagagaaggagaggaaactgggaaggaagaggaggagtctgggggtggagaggcaagaggagtggaggaagagtcaggatgaatgcaaagggagagacagcaaagttgaggagactgaggcagaggcaagagagagggtggagagatgtagaatttgtccagtgccctccaggccaacattagcacctggaagaacagccataacatttttggaaaggtttttgacatccagagttgaaggaaaagtgttttttaattaaattccagctaactagaactcttaatgaacttaaatacccattctttagcagttgggttttaaatggagtttctgggatccctgtgaataggtcagcaaggctgttttttttcctttttaatccccaccatttgagttaaaaaagggctgattttcaataatgctccaaattctagttatttctccagctcctttctaaaaacatggctgtaaatagtctagattagtggttctaaaacttcagtgtgcatcagtgttacctggggtgaaaggtgggcggggtgggggggcacgttaaaacccagactcctgggccccagccccagaaattctaagccagtaggtctggcatctgctggagtatttgcatttctgatccgttcccaggtgttgtgatccagggaccacactttgaggaccactggtctagatctaggacataggcaattatcagagttggaatgttttgtaaaattagactattgacccataatctcaattcagaaaaatctagatgattctgctggtgaagcttttgaaaattcagctgacaacatccacagcataataaaaacacaagcgtctacacatttctgagttctggcgcaaacaaaagaaaacacttccaaaacaaattttcctcagcgtatcagcagctgtacattccagtgggccctactcacctttgggggttttggggtcagcttatcgggtgattatcttcaaagcaggacagtgtgcttgcagaaacatctgcttaatccctattttaagaatacatattgactggccttttactatcactatgagcagttataaagatttaactgatgggacccagtgctggtggttttgacacaatcctaggagggaggtggggaagaatgacaggcacctcgaaggatggagtcagggcttagcactcagctcttggctaggagagagaagcccatggtaggttccaggcctgttatcttccactaacttccattcacgagttcaatgatgcactgcatcagtctggcctcagccctgcatacatggagggaggctctggacttcaaggtgcatttggcagagccctcatgttgcatcgagttgcttgaagggtctctgagggaagagggcagctgagcatgggagatgcctgtggccccttggctttgcttcagtacagtggcttccatggactgctttgttcaaaggatggcacatgtggcttaacaaaagtttgaggaccagtgaccccagggttccttctatttctaaaatttgtaatgtttgattccttataaataataacacaaagggtccttgaagccctgtttccagtcattcagctttgtggctcaatcttggatgcattttgttaagagtgattgagaattctgtgccccaccccatcctcagcagtcttaagaggggcagagggaagatagaacaacatccacccaatactcctgcacctctggcccagatttagccaagcctctctgagggtgtggtcccatccccggggctgagaatcactccacagggaaccactgcctttgaagggagtgggatgcgtccgggaacactgtgattttccttcacatcgtgtggtccagctgtcaggcaagatggtggtcatgtgacccatgctggccaatcacagctctcctgagggagggatgcagggatgaactgattcagagctgggtcactctgaggacaggtccttgactcctgctacttagattcctggaactgccttggtttccgtctttcctgaggtctggctggtattttacaaatgaaccagggtttttctgaatcctccacccttttctgttgctggaaagattcaggcttccctttccaccatttctcttatgaaagggcttcccaggcttgtgaaatacttctgggtatttcagaagaccagacaccaggatctccaaggggcctgcccacttcccctgcggtaggaaggccttgatttgcatgagtgcatcagtctgggtctgatcgccccgggccgggtagcgcacgccttctggaagaagaaacgctatagctgagttttcattagaccctccctcactgtccctgggtcgcaggatgtgaggacccatcattaagggctcagaatggtaaccccctgaaggcagagctcgttaaaggtcaatggctaattaattaaacacatgaatgagctcagaagctaagtcccatagttagatttcatattcttgtagtttggacagttcagtgtcctggatctggaaaaatgtgtccctttttgtaatttggttcattcttttatttctgatttaaaacaaaaacccccaaaaacttcagaccacgtgtagatttgttgaagggagtggttttcccaggagctcttgcttctcccagtgggcagtggtgctggtggcagcaggagcccggtgccagggccaggaatcaggaggagccttggagagagtaggcaggagagtccaggggccggggtgaggaatgactctggacactggtgtccttccttcttctgtcgagagttccttacctggggattcaccctgcagcagaaacctggaggagcactgaggaggaacaagatgttccgttgccgaaaattgctcccatagagccgtgccatgcagtatggcagccaccagccgcatgtggctgtggagcacctgcaatgtggggagttcgaattgagatgtgttatgagtgtaaaatacacagcagtttcaaagacctcatctgaaaacaagaatggaagatatctcactactaacttattgattacatgatgacatgataatattttgggtatactgggtaaaataaaatatattattaaaattaatttcacctgtttctttttattttatttaaagtggctacttctagaaagtttaaagttggccaggcacggtggctcacacctgtaatcccagcactttgggaggccacggtgggtggatcacctgaggtcaggagttcaagaccagcctgaccaacatggtgagaccccgtttctaccaaaaatagaaaaattagctgggcgtggtggtgtgcacctgtagtcccagctacttgggaggctgaggcaggaggaaacgcaaaaggaaatgattttgtttgtttgtttgttttgttttgtttgttagttcatgtcttttattaactcatacagttccttgtcttctggtttgttgaagcagtaagtcagacaacatttgccacaataatgtctgtcatagtggcttgccataaacactccagcaccacattcatcagaagggcactctcgatgaaggtgactaattttgccattctcgtctaccttatagtatttcaggacagccagcttaatcttcttcctcttgtgcttattcttcttgggagtggtgtaagacttcttccttttcttagcaccaccacgaagtctcaacacaagatgaagagtagactccttttgaatgttgtagtcagacaaagcacatccatcctccagttgcttgctagcaaagatcagtctttactgatcaggaggaattctttccttatcctgggtcttggcctttatattttctatcgtatctgagggttcaaccttgagggtgatggtcttccctgtgagggttttcacaaaaatctgcattttggtggcagctccactgcaggtggctaatggaaaaggaaggaaatgttttaagatacattcctaagggttgcacattgactaatttgatcttgtacaactctcaagttctgtaagataaaatcttcagttctcttgggtagataaaagagcttcagaagtttgagttgggtgagggttggccactcccttaccatcttgctaatgctttagaccaaattcacacagaaagagatttgttaaatattaacatttattgtgatgcaggcccccaaggtccatacaaccttctctgtaggctccatgaagtctcagctctggtgtcttaggtgctaagagaacactttgcatggaaagctcattgaaggcagaggctacaatagagtcagaatttcaggatccttcttgtcagcatcagacaatcagaaatcttactacaccagtggtctttcacaagagcaattaaggaaccaagtgccttttatttttattgaattaattaattaattttttttgagatggagttttgctctttttgcccagactggagtgcaatggcatgatcttggctcactgcaacctctgcctcccaggttcaagtgattctcctgcctcagcctcctgagtagctgggattacaggcatgtgccaccatgcccagctaattttgtacttttagtagagatggagttctccatgttggtcaggctggtctcgaactcctgacctcaggtgatccacctgcttcagcctcccaaagtgctgggactacaggtgtgagccaccacacccggccccaagtgcctttcttaagagtgcagtctcaaggccttgccagaccgaaaccctagtagcacaagggtggggagtgtccctacatctcatggccagtccacatatcgtgactgtcataactctgttcatgcgagtatggagagtgtctcttacatattttagtcagaccacgtgttccccttgattaatgagagcccattgctaagactcattatgtttattagcaagtcactaataagtcagtaaaaattcacttcccaaggcctcaggtgttggcaggtgtgcatggcagaggtatcttgggagactggggaatcctgatgaacccaagtaatgctcacctgtaatatcacaccgaagatgccaaagtatataagtcacttctggacatcatagcacaatcttattaagagcatgaataattctttcatacctacttggtctatccaaacaagatcaatgaggcaagagccagtgaattatcagaaagtttcctgagaaaattcaaccttttgtgatcaatgtcgtttccaaccttagaggaacaaacaaatgctattcacaaaacagtcattctaaaaatgcatttttgtatgaaagatgcatcttctcaaggtaaatgttaacagtccttgggagaaaactgctagaatacagatttcaggatttaagggaaaacaatttttttctttcagtcttagaaacccaactcactgatgatgagatatagaacaaatatagacgttacttaaatattaactttatttggtatgtaaatatacctagcgctccgatctttctagatcaaggttacttaaccctggctgtattgaccctttaggcaagggaattccttgtgtgcagggttgtggggggatgctgtcctgtgtattgtagggtatttagcagtgtccctggcctctacccactagttgccaatagaaggaccctaccactaaagtggtgacaactaaaaatgtctctagacactgccaaatgtccccttggggggcaaaatcaccctctgttgagaactgctcttctagaacaggtccaatgggctaagccattgccttgctagaatgcataatctcagacccctcccagacctactgaaccagagtctgcatttcagtaagctcccaggtggtctgtgtgctcatatacccggccagctttacccctatgctccatggtgcctgtggccagggatatgtggctctcattgcaggaagctgatgaagccttgctgcataacctacgccttcagctggaagcccaatttctgcaagatgatatcagtgcggcaaaggacaggcacaagaaggtaatcatgaccccttgaagcccttcctctagaaaacccagtttgggtttgatcaggtaagccgagggtactgtggctgaaaacagactgctagagtggcatacctttgtgcgttttccctcgaaccaaataggggtgaattggtcactggacagtgcttactgagctagatgtgctttgaagagtgggcagtagtgggtgtgttttgagggccctggtgttgggaactagtatctatattgtacagtataatttacaaagtgattttatatagatctgtcttcattaagctacagtccatcaactgtttccgctcagaaaatacatgaaaaagtcttgtttttagctctgcctctgagcccgttaattgcaggagcacattattcaggagcttcctctcctgcagtgctcagactcccccagcctccaacagttcctcacaggcctgattctggggggccctggcataattgaaaaatcagattctgcagctgtttgactatgggtgagtggcctaacctctctgagctgctttttcttcttcaaaatgcaaatgcaggctctccttcccagcagtgacgtgggtgaagtagtgtagcagacctgtgggtgcctcagggcttccctctccaggggctctggcctcctcccactgccatccctgcagctttgcctgaggactttctccaagcagctggaggctgctccgcctgtagtggggtgttggggaactcctgtccccaggagcagggagcagcctcaaccagaactgatgggagttggtgtataaacacaccagctccctctcgcctttgtagaccaactctgaggcttttgttctgcattggcacccagagatactcaccaggattgagctccaggtgcccacagtggtgatccattggtaatagccctcgctgactgctctcccttcctgcctcactttcccactccacccgtcatgtttcctggcatcactgcccagtcaactgtttgcactcagatccctctctcagggtctgcttctggggaaacccaaactacgacaatgtgggaacatgggtacaacctggagcttggcaagtgctcagtgaacttccagttcccttcctacctcagtgtgtacctgcatcagtacaccaggcctgtctgctccaatcagggtccctccaactttccatgaggcccagccatttcctcctccccacccacctccttgcttctaccctacttgatggaatcctgggaacagtgcctgggccagttttgaagcagctcaaataattcttccaggccatttaggatgatgatgatgatgatgacggtgatgatgatcgctcacactgtgaggcttccctgtagtatctcactggatcccaagagcagccttgtgaaatactgctcaggtcaggcttcctctaagcagagctctaggtagtgattttttgtcactgatgtcttagtggagggctctgagaaggggaggaaaagggcaggacagggcagggagcagagcaaggacttgtcctcagccggagtccagctgtggccttctcatgatcccacaggaagctctggagtgtgaatgtgaattacaccacagctgggtccctcaaggagttgagagagttggtcttttgtactcctgtgctgtcagtcgttggcctgggttggggatgaggcagggcctggtagcttcctggacaagatgaccatttgttggccaagggctgctttctggagagggctgtgtcatctgttattacagagctggggacaggggcactggcgggtaaaggggatcagcatccctacagatagttatccctgttttacagaagaacttgcattttaggaggtttaaatagcttgcctgaggtcacacatagccagtaagtcttttagtccaggcctgattgaccaaagcccattctttgaaacactgctggtgttggaaagggtcctttgtgccctccagggccttttaacttatttatttttgacacggtgtctcattctatcactcaggctggagtacagtggggtgatcacaactcactgcagcctccacccacccccaggttcaagtgatccttctacctcagcctcctaagtagctgggaccacaggtgcacaccacaacacatagctaattttaacattttttgtagaaatgggatcttactatgttgcccaggctggtctccaactcctgggctcaagcaatccacctgccttggcctcccaaagtgctgggagtacaggtgtgagccaccatgtctggtgagggctggtttttttctctttttttttttgtgcctccgccacccagggctttgtgaagaccaatgcaccaatgtaactgaagagaaacagtgaaataaggcaagtcttagtttattcatcggccccgttgttcttgtgaagattaaaggagactgaggtgccaggaatgagcatggtgcacatgtgggcaggcccacccatggcagcaaatgcatcagtctcttcttcctcctgaacctggtcatggtctgtcctgtctgtgatgagggagcgtgcggaagtgtccattcctgttctcatctagtactagaaggaaaaaccagcgcagctcaacttataatgagaatgttttccctcccccaacagaatcttctggaagttcagacctatatcagcatcctgcagcagatcatccacaccactcctccagcatccattgtgacgagtgggatgagggaggtaagaattgaagcaggaaaaggcaaaccagccctggagggaagctgtacctggagactcccagggaagggctcacaggttggactgtgagggcggccaccagggtccactccccactcctgccttgtattctcatctgaagtttcttcttctgatattttacttgtactgtaaatgccaatatttagacatgtgaggatgtaaaccgcatccttgaccattttcttcggtattttctcttgagaattatgagctgttcttccttgcatactttataagaaatgaccaagctgctttccaaagcgatgtgccattgttgcatctccacccacaatgcgtgagggtttctgtggcttcctgtccttgccagcacttggtatgtcagctttgtagtgtgtctttgctcttctaatggtggtggttttaatttgcatcccctaatgactaaggaagccgagcatccttttgtgcactcatctgccatccggatagcttctttgtggaagtatctgctcaagcctcttgcccatttaaaaaattggtttgtttccttattctccctatcaatctgataatgaatttcaaatacagataatctcagataattagtgaatatatttccaagacggagctctgctaatgattatgtgagcctgtggcattgaaactagtgggaaaggatagagattgttgaagccaatttgtaaaaattaagatttggatatgaaaaattacttctgatattatgttccaaattccttcttcatttgactctctagctgctcaacgggatagtaacgcttttcctaatatggtttatggaattttgtgatgcatagcatgatatatatatatatagactggtgctgagtgaggtggctcatgcttgtaatcccaactactcaggaggctgaggtgggaggatcatttgaggctaggagttcaataccagcctgaacaacatagcaagaccccatctctaaacaaacaaacaaacaagaagcaaaaaaaccccacaaacactggaaatgatgcaaattaaataaaaatgttacagtgtcccttcttcagaggttgtggtaggctactacagggtttggtggattggtcaagagataaggttctgggtctttttgcaaggatgacctaggatggtggctctcaaccctggtgacacttgaaattgcctagatgtgtgctcaggccatgctccgagtcaatgaatgggcttcccaggaggtggggcctgcccaggaccagcatgcagacaaactgctgcagaacccatgggctggggtcaccggctgcctgaactttttcgtcttaattattttatacaaagctaaagaaatccccaaatttgctttagaagacacttttgaaccctgcaaagtatcatctaagcgacaggaaagttactttttttggcattcatgaggatagtcttgtctgaattgcccaccagttaccatttcaggatcctgttctccttagtggatgtaactgatgttgctacaaaggcctaaaaaaacttttcctgaagccttaattttctttcccagagattcctttccagagatgttacttttatttttcaaacccaactctaactcaaaggtgttttacatccgagcataccttttgaattgtatcatctattcccatgtaataagacccttctaagtcataagtatacagacactaaactgactttgatgtcatcgatcagcatcgtctgggcttgtgagacgtgcagagtgtccagtccagcctcagacccactgaggcagaatctgcatcttagccagatccgcagggactcgtgtgcatgctcaggatagagaagcaccgattgagaaagtgtcacatctttatgagtcttagcttagcaattctacaatcaagttagacggtcactttcctgtatgtctatgtcattgctgcagccactttgtaaggtgtttgaagcagaggctgtcttccatgcagcctctggacacagaaaccctcattgtagacttggtgtttgattttgcatggcttcgagtcaatgtgctctgtgtcagaatgcatggctcttgagcagtcaggcctttgtgaaacaatttgaatatttttgaatagacgtggaaaggcaggtcaggagagagggacctgcttggcagagtgtggagaggtcagaggatttccttctagccattccctggagcgtcacttccctttcacccactggggctgatggctcctgctttgtgctgcgctgacatccgagcacagcgtatggctcgcggctccaaccagccttcattttcttcgagagtgtgcattccaggttttccctttcacagaagggaaaacagaggctttgagagtcaaatccttttctagagtctcttagtaggttcatggcacagccaggtctaagctctggtctcctggtacttggtcccggcatgtcacactcccaaggaggttcagactttgaagacaaagcaaaaggcattgatggctgtgctgtgggcctggcttagtcttctcaggctactataacaggacactacagatgggagggccgacaggcagacatttacttctcactgtcctgggtgctggaagtccaagatcaagatgccagcagaattggtgtctggtgagggctctctttctggcttgaagacggctgccttcttgctgtgtctcacgtgacagacagacagggggtgggggtgggggctctggtgtctcttcttgttcttacaaagaccctaatcacatgatggggccccccatcctcatgacctcatctaaccctaacaccttccaaaggtctcctaaaaccttcatcttgggagttagttagggcttcaacacagaattcagggggacacggatattccgtccataccagggccccgcaccttctctgcccttttcctctctgcatgtcccatgagtctgactctggccttctctgtgcaggagaagctcctgacggagcgggaggtggccgccctgcggagtcagctggaggagggccgggaggtgctctcccacctgcaggcgcagagagtggagctgcaggcacaggtacgctcgagtctgccgcgtgtgcattggggcttcccacatgtttcatggaggtgttacgcgcaggcacacgcatgcagcttgaggagctgtcacacgctgaacatatcctatgttcctggcagaaacggggttttctgagtgggtggccaagcgctctgctctggcctggactgaggagttttccaggacacagggagagtcctgagctgggggacacaggtgccacgctcattcctggcccctcagaggtgccccttgggactccttcgagtcatgccctccccaccgagtcttaggcttaggctgccccagtgtctacatcatgcattcattttgcccaggtcaagcttcgtaagaataagaagaaacggacaccatagggatttttatcctccacttgttcaaatctgtgcttctgttttccttctcatggtaacagttctccttcggaatttgattacaacccggcaagagtggttgtatcagtgtttgcttctagttagaaacgtgttggtggaaagctcacatttctacccccaccccttttgggtgaagcttaatttgaaaacaaaacagaaaagccccaaactgtcctgtggcctgtgccttcttggctacttgccggctcatcttctttgttccttccggttctctctctttctcattaccctacagcaggtcattccacagggacgcttgggttaaaatactgcacctttgtatggctctctaaccacatttcccaaaccaaaaagtaagttgacatttggtttgacaagtacacatggggacaagagagcaaaacgtgtaaaaatcggacacttcagaaagcctggaccatttggatgttatgtgttactctgtctaaaaatgtgaagccacaactagatgtagcgctttttattgatttccagtgcccccatgtctgctcaggatttcattttgggaccttggagttcacatcctaattcccatcccagcacgcaccacacaaaactcacagtgcagcagctctcaggggctgctggaaagcaaacccgggtctgtggtggtcccctgaactgacgatcgcagcaggaggaaccaagtaaggcacttaaaactcctccttcttgtgagacaaaccctggctcagggaccatgtgcctcatcctggtgactggggcctgtgtggtttcttctgaggctctgacaggatagaataagggttgtatgtgtttgtgtacatggggtgtgtgtgtgtgatatacatggtatgtgtgatatatgtgggatgtgtatgtgaagtgtgtgtggtgtgtgtgtgtcatgtgtatgtgtgtgtgctgtgtatgtgaatagggacgtggatacaagcccagtcgtggtcctagagaccagtgttttccaaatggctagtgacaactcatttttggatgtaaaatgaactcagtagaattgactggcatgtaaaaggaagtcaacaaaatgctagactaaaatataataagaaaaacagagtgtacagcaagtgaaagggaggatttgttttgtgaagcccttgttttatctctctatatccatatggatatgttgaaatacacacacacacacacacacacacacacacacacctacctatctgatgtgtatggctcgcaatgagaaatgtggtttttcctggggcggtggtgataaagttgaaaaccactgccctagagatactgagaaagatgaaggagcccagcctagatggcaaattccagttccaggacaaaaagaatgttcctctctttatgtacaggtatttgttgaatatcaaaataagaaatttcacaacagattaacctggtttctgagaacatgaaatgaaaccgctggttggccgcctgtttctgtcctgagtggctgcaggaggacttcctggcttttccctgctgccctcgtctctaaagcagggtctcaaacatctcttctgtgctgcctcctccactcccacccttggcattctgatggagaccgcttctcagaaaaatgatggtaaaggcataaaataaaatacagataatttaaaggaaaccaggctgggtgtggtggctcacgcctgtaatgccagcactttgggagggcaaggtgagtggactgctcgagtccaggaatttgagaccagcctgggccacatgacgaaaccccacctctacaaaaaatacaaaaattagctgggcgtggtggtgcgtgcctgtggttccagctacttaggaagctgacatgggaggactgcctgagcctggagaggttgaggctgcagtgagctgagactgagccactgcactccagcctgggcaacagaatgagaccccgtttccaaaaaaaaaaaaaaagaaactaattatattaaaacagttatcaaaatattactgaatcattttaaataaaatgacagatgtgcttatactcactcagtaacaagctatagcatgtagctgatgaaacacggctgtgtccattttctgttgctgccttgatgagtcaccaccagcacccgtgtcatcgcagttgtgtaggtgggaagtctgggtgggtcctatcggtttctctgctctgggtctcaaaaggtagaaagaaagatgttggccagcctgggcccttgtccagaggctgttaggggagaatttgcttccagtctcattcaagttcttggcaggagtgaggaccctgtttctttgccggctgctggccaggagtggctgtcagggctgcccaggctccttggcttcaggcccctccacgttcggagccggcagcgaactctgaaccctcttcctgcgtctcatctcaatgacttggacttacacgtttctctgacttctgtttttaggggataatcttgaataaactcctttccttaaaaaagggtaactgattaagaactttaattatatctgcaaagtccctttttgccatgtaacatattcgagggtgtagcaccaaggggaaaaggtcacgggggccaaaattctgcctccttagctctgatgaaaacccagacgtggctgggtgcgcccgggagctcctgactcagtgggtctggggtgtggcccgggatgctgcatgtctaggtgtccctgtgatggtgctgcggctggtccaggagccacactgagaaccacagggtaagggcgggtcccagggagtgggcgaatgttccacctggtccccctgtgtcccaggcttgggcctcatttcaaatgtttgtggctgggtttttgctggttttaaaggttttagtggcttcccaatgtagcagctaagctagagctgaaggaagatgtggccgcacaccgccgggcagggcccgctctgtggccggaactcggtggagggcgggccgagagagagcgtctgctagcaccagggccgtggcagcgggttccgcctatggttagggcgtccgaagcttcccgaactctccacagcaggggtcgtcagggtgaggtccccgtcccagcagcgggggcaccacctgggaacttgtcagaaatgcaaattcacaggcaccccagaccactgacccaggagctctggggcgggccggtgcgccttgtttaagccctccacgtggctctgcgggctcagtctgggagacgctgggcggacgatgggagaatagtgcctgggcttggagctggaagctggaagcctctccttcaaataagtgcacatatacccgtaagagccccggaggaagcacttcggacaggtggagaggaaaggacaggtaattctagttccctaaattgcatggactgagagtttctgtgacagggaagtaaagaaagtcactttttaaaattgcaaagtgggaaccgcccatgtctcatttctcattaaagtcacttagcaccatctagtggtttagtttgtgtaagacagtatgtaatgagtttccttttttttttttttaagacaaaacaaaaacaaaaacaaaaacaaaaaaaaaaccttacacctaaaggtgtctggggtcctaaggactgaggtgagagctcacccctccagatggggctcgcgtcaggctcctgcctgtgtcgtgccctcagcggctcacagcccagtggggagacagatataaaccaggcaatctaacggtccaggcagaaacagcagtcacctggctccggataaagttcaggttgccacatggccccaccgttggaggaaccctgggccaacctctcttctcttcgtctcctgacccctcctgcagtttctgggacctcccctttgctcattccttctctcctttctggaagtccctttccttcctcggttcccaggaccggtcctgcctcctcctggaagcccctttcttcctctgagatgccctgggcgtgcctcccctgctggactgcggccttctagaggagggtccgtgtctcattctcctcggccaggctggtgctgggtggcagtggacgccgtgccacagtggctctcgtcacaggcatctccattcctgttgagctcctgagacaggagctcttactggttttcctgaacactcttccttctgatgaaaggtttaaattatggagctgtaaaaaccacatcggtatagacatcagtccacttttataaaccaagtcatcacttcactggactcagcagaatcccgtagagcatctgcgaccagtacggagttggagggctctgggcctcatggtcatgtgggggatgggggctgtgggggcgcccaggacaggagctcctcccgcagtgttccagcagaggatctccagcctttaaaacatgcagccttcttcaaacaaacacaaatgcacacccaagaaaacaccccatccctccaccccctaccactaccacaaaaacaacaatcaccacttcctgagacataaaaagattgcactccacttgtagggtagaaagatcacaggtgactttcctgggctctcatttcccattctgtgatgctttgtggttctatttacagtttaaaactttgctaagtgaaaacctgcaaggagaggtctctgcatggctcacactgactttcccatgtcttcagagagaacaggctggtgttggcctgttgctgtgtgggaatggggagtttgcaggggccctggagacagagtgtgtgtgtgtgcacgcacgtgtgtgcttgcatattgttgcctgcagcagggaggaggctgaggtgcagggcaagggtggcctggttctgggaggtgtttcagaccttgttcaggtagattcgaatcctgctgtggtatttatgggcaagccactttgccagtgtgccccagtttcctcatctgtaaagtggaaataatgacagcccttccctgataaggttgttgtgaggttgatgagttgacccagcttaggacttatcagcatgagccactacccccgctctgggctggggaacccacacccaaaaggaacggccaccccagagctcttgggtcagtgatctggggtacattctcttcatatgtaattttttcttttactctttattatggaagatttcaaacatagaaaagtgagagattataggtgctatggctcacgcctgtaatcctagtactttgggaggccaaggtgggaggatcacttcagcccagaagttcaagaccagcctaggcaacataattagaccttgtctctacaaaaaaaaatttttttttaattggctgggcatggtggcattcacctgtggtctcagctactgaggagacaaaggtgtggggaccacttgagcccaggatgtggaggcttcagggagtcctgatggcagcactgcactccagcctgggcaatagagtgagaccctgcctgtctcaaaaattaaaagtgagaatagtctgtctcatgagccctcccgccccatccctcaacacatggcccctctatgttctctacagccccacacacttccctcaccatgtaattccaacacttctttgagatttggggctcaaaggggtcttttcaatccccatattccttgaaagtgtttcctggagtgtctgaacactctggtgtgggtgagatgtggctgcaccaggcgttagtgtgtctgacttgtatttgctattacaggcgactgtttgaatccagatttcttgggagaaacagaaactggatcacactagctgaaacaggaaggggactcttgttttattcagaagtaattttagatttttgaaaagttgcaaaaacagcacagtagcttccaatatatacccctcacccaacttccacaaaaccacgggccgatgataaaaacctggaaattaacagtgatcctgtcgcattaatagactgcactaaaatctcaccagttgctccacgcgtgttttttcctggtcgagatcctactcacatttaggtgtcatgtcttgattgtctcccccatactgggatggtccccagtctttctctgtcttccatgaccgtgatgctttggaagaacccagaccagtggctttgtggcatgtctctccttttgggtttccctgatgttttctcaggattagatggaggttctgcattcttggcaagacccccatggagtgacgctgtgtcctgagtatttcgttatgtggctgtgtcctcatacaggtgacaataactctgatcacttggttaaggtgctgtctgccagttttctccaccggaaaggtactatttttttttttttccaaaggagcagggtataaaaggcagggcatgaaatctgagagcaggtgtgcatcaggaatcaggaaccaggaactgggagctgaggcagccgctctccgtctccttttccatctcttccttctcttgccatggctccctaatttctgtttgtctttgcctttcggcttcatttcttttcctctccaaataattacctttctcaactttgccatgcacatgaaagctcgccactccagagcggcagcctcagacccgttcatgtgtccctgttgtctagaacctcccaccaactctgcgatttctgagacccctttccagattcccaggagagaaggcatgtgacaggccagcctaggtcaggcccacccctggtcctataactctgcacaggagagtggggtcatcttgttgctgggaccgtgcctttggatgggtggggctgacatcagacacagggacaacgtggactggacagacatctccccaaagtgcttagcacacgtaccttttcttcccttcctcctcccttctaatgcaacagatctatggctgaacacctgcttttttttttttttttgacagagtctcgctctgtcacccagtctggggtgctctgtcacccagtctggggtgctctgtcacccagtctggggtgcagtggcatgatctcggctcactgcaaactccacctcccgggttcaggtgcctcagcctccagagtagctgggattacaggcaccagccaccacgcccagctaatttttgtatttttagtagagatggtgtttcaccatgttggccaggctggtcttgaactcctgacctcaagtgatctgcccgccttggcctccttaagtgctgggattacaggtgtgagccaccacacccggccatttgccgaacacctttgaaagctacattttcacttaaggaatttcatgatccaagggcataaagtgtataagtgaagaattgggttttgatggcaatgatcatcttccagggtgtccagtaggtacatttaggtctggatgtaggaaatgcctgcagtggacatacatgaagttgaatatagatgtgtgtcttgccccttgtgactcgaagtgtggcccatggaccggcagcatcaacatcacgtgggaactggtgagcaaggcggagtctccggccccccatccctgctgagtcagactcttaacaccctcaggtggttccagtgcaccctggcttccagaagggctgcgctaggtagaagtgaggttttgtttgttttgttttgtttttgaggaccatgcgtgtcaaattctttcctactcaagaatgagattggaaaagaatcatgatatctcggcctctactttataaagtttaaattttttttaagcttcttgactcttttttaataacacttgatcaagcacaagagaaaatattgcaatcaagagctgtgggaaacgtgagctgtaggaggctgcggctggggtaatgcggcgtcactgtcttaccagaaacatctcgttaaaagtgggactacacgccaaaataatgagaaaaagtgtagtatcgtaaatacataaaccagtaacatagttgtttattatcatcgtcaagtattatgtgttgtacataattgcatgtgctagacttttttttatgcaactggcagcacagtctgtttacgccggcgtcctcacagacatgtgagtgaacatatggctccacggccctaggatggctgcggttgtcacaaggcgacaggaattgtccagctccattgtactcttatgggaccaccatcctatatgcagtccattgttgactgcagtactgttatgtggcccatgactgagcatttgtgggtctttgtgtatcatcacaacctcttacactgaatataaaactatctctttctgttttcctcccttaatttttacttgctctgattaatgtactgtatttctctgacattattttatgtgtacacaagggcacacacatacaccttagctaccaaaacataaatgtaactctgccgatccaaactcgggagaaaatcaaagctgaatgagaacaaggaaacttttctcccactcagtatttcaataaaggtagcatcttatctatttagtatgtgcttctttttacttatttttttgctatcagatttatgcttgttcattaaagtctgaagaatgtactttatttgaattatacatattattccaccgatagcaagttttttttctttttcttttagacagagtcttgctctgttgcccaggctggagtgcaatggtgtggtcttggctcactgcagcctctgcctcccaggttcaagtgattctcctgcctcagcctcccaagtatctgggattatggcgtgtgccaccactcccagctaatttttgtatttttagtagagatggggtttcactatgttggccaggctggtctcaaactcctgacctcaagtgatctgctagcctcggcctcccaaagttctgggattacaagtgtgagccacctggcctaggtttcgttttattttctaggtttgtcttcagactgcctttggggtgggcctccttatggactaattgcagagggtgctgatattagtgcaagaagggctgggtgcggtgactcgcacctgtaattccagcactttgggaggctgaggtgggaggatcacttgaagccaggagtttgaaaccagcctgggcaacgaagtgggaccctatcactaccaaaaaaaaaaaaaaaaaaaaaaagcccagcatgttggtgcttgcctgtagtcacagctactcaggaggctgaggtggaagcctttagcctgggaggtcgaggatgcagtgagccgagattgcactcctgcattccagcctggtgacaaagtgagatcctctatcaaaaaaaaaaaaaaaaaaaattgtgtaaggacacaggagctcagttttcacattgctttttagcttaaggattccaaagtgattcattgctaatctcgaatggacagagaaacacacaaacaacataaaacattcaccgagtccgggttccttttcctggtgaggtctgtctcttagagaagaagggggatggattttcttacagcgtgtccttgcccacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggtgagcgtgtgccctccccatccaggccacttattccttccacaactctttattgagtgcctattgtgtgccaggcacagttataggcagtgggcatgtgtcagggaaggaaacagaacaattcctgaccccatgggtgttggataactagtaggggagacagaggatgaaggtacgaccagtgctgaggaggaagttcccgcagggaggagggtggtggcaataggggtgatgggggaatgcttgcagttttaagtagggtggtcagaaaaggcctcactgagaagcctgtgttttgctcataggcctctggggacataagtgtcccagcaggtgggatgcccaggagtatttaatgaggtgctgcaggtgagctacgtggcacggagcctggcacttgagggcactcagaggtgttggtgatgctcctgctgccatcctcacaattcttagcaccttgctgagtcagtctgtggctgtgactatgtggctgtctggtcttctccataatggagctgtgagtcgatccctactcactttaagaaagctgggaaattctctctttctctccagctatgctggtattcatagctacggtgatttccagagaacgggttgggaattaatttgtgattcttcacttcagtcttgctaaattcctgggtttcgactgaatgaaaagagaagccccccacaactgaggtccccaccaggagcagctcttcccttcgcgctgggtgctctctcttggctgtgagcactcgaatgcttggcaggagaagcaggattttatttttctttctccagtgctggtcggtgtatctggcatgattccacattatatttatgtcacagtgaacactatgcacacatctgcaagaataagtctggagctggcatttcggtgactttgtaaacatttttgttttgggacagggcttcacagaaaggtgactggatacctcttttatttatctataagttctgattttggtctaattttaaattgatagaaatgttgcaagaatagaacaaggaactcctgaatactccagattcaccagttgtttatattttatctcaattgctttatcattttttctctatttatatatgatgtgtgtgtgtacatgtatatgtatatatgtatatacgtatatatgagtagatatatgtatatatgtatatatgtgtgtgtatatgtatatatacgtatatatatacacgtatatatatacgtatatatacatatacacacacatatacatatatacacacatatatacatacgtgtgtgtatatatatacgtatatatacgtgtatatatatatacacacgtatatatacgtgtgtgtgtgtgtgtgtgtgtatatatatacatacacgtatatatacatatatcttaagttggagatatcatactctgtttgccctaaatacttcagcctgggttgactactctaactaaaaaaatcaaaaaggcaaaaaaacaaaaggcaaaaaaataaaaaaggcactgtctcatggagaagtggcatttttaggttataagcaatccccactttacaattttttataggtatgtttcacagtttatgactcttgagctcaaagaaatgatcacttcctttatgtcctcatccagtatgtaaatgtgtgtatggctgtctgtttaaaatgatatctaattcgtgagcaatttggtctagagaaagcttttttttcatttttgctcaacattaacgagagtcgctcttgcccctgacctctgtttggcttgttctttctggttctttctgccaggctgacctctgccttcattgaaactcccattcccctgttcacccagagccatggagtctctctcagcactggatccggtgggaaaggtaacgctccccaacactggacttctgtttttttctgtcttgaaaaaaaccaagcggctctcttcctgactttaacattcatgcttgcttcagatccatctggaaattaaatgcttttatgtgaaggaggactccttcccaccctctgccctctctggcttgctaagtgactgagctgagaagtttataaggagaaaaatcgactagggggctaggctaccttgggcatgccatccctaatgtgaggcatttattttgtatttttatatttgttttatggtttgacagcaataacttttgcaacacaaggcatttaattgggcaaaaagtacaactcaatattcacttcttgctccctccgctcggcagtaagtgaacactggatcacatcccaccgcctccccacattgaatcaaagggtttgtgccaacgcgtgtaacatggtgtccagtgcagagtggctgctcagtcatctctcattctcccctccctcaaaccaggcagaaacagcttggctggtaaatgtggcatctgccttcaacatttggtctgtaagacctcacctcacatcgaaatctcccagttctgaacaagcgcagcatttggggagaaaagagaaggtggtaatatggatgctcatgcatatagggccttgaaatccttatttccagatagctcagagggctttgtggaaatggtgttccagagtcaacatggttggaaagggaacagccttgcagctggacgcccagggccaggtctgcagacgagcggccctgcaggggcttgctctcagaacggtcccagcttggctgaatgctctgctaatgctgttctgaagttcttaataatttggaacaaggggtcttgtgggtttttttggcactgggccctgagattctgtgcagtcctgtaagcacctcctcctcgcataccagttcccagcagttttcctgtgccctgtccctctctgcatcccttgcacctgtggctttgtgacccatgtctgctgttgccggctcacctggctctctttttattgtgaatcagccgtgcttgatgccggtgcttgatcggtcttgccctgtggttaccagtgggaagggatgcaggggatgacttttgggctgaaaaagttcaaaattcactatgtgggtggagccgggaagcctcatagattataccaggtgagaattttatgtgttttcttcaacttttagtttttcctttcagctagtctggaagcaggagggtggacttggggcaggggattcctgtcatttctgaatttcatagcatcgcttcttctcttggcctgggaggaaggggaggctgatcacagccgggtggcatttatctagcttgagctaattatggaatgaggtagatccaccgtgaacgggttccatctccaggcccaaggccatctgagcatgtcagaagcccccaggtagctctgtcgtctctcctttgaggaagtcagaggagagaataactttgaggaatgggcttctgtggatccaagtgtctgctgtgagctcagtggggctgcagtgggaacaggggctagggctcccattgagtgtcaggacaatggccttgcataccttggtaggttctgcctggtgtggtggtgaactgtgggtgtcagaacagggagcaccttccctctggaagcccaaaggcatccagtgacttgtccagagtcgcccagctggacctcagcctgggccatggagcaacaaagccagggcctttcttccattgcttctgctccagatgaaggaagccccaccctagtactataggcgtttgtttccgagagagttagcctattttccaaccagcgtattttctttctctctcagtgacaattatacttgaatttctgcctgtgtgtttttccagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgcacatcctttgtctaattaatagggaccttgggaatgtaggtgggtcagcttcatgaggacagggatgctctgttaaatggccaccataccgtcctcatttaggaaagagacatgctcttcatcctggttcataagtctcgttagagactcagatagcatctggatttcacacagaaacatgctggttgatgacatcggctcatcttcattccatttcaagcacaagtgtgtgcttatgtggatgagtgttttgctagagatgaaattattaaaggcatctctcttaatgtggattcccccagaagctgatcccaaagcagagaatgcgaagtttcattggaagatgaatttaggatgcacaagtaggagagtggagaaggcagggaagagaagggaaccaataaggaggacgttaccaccaaatcagctcacaccaggggccactgaggagctctggcagacagcatagatcacgtgcctcagagtcagcctccctgaggggtgagggagctggggtattaatcctccagctcctggcagtcagtgggaggtgtgctctctgggggccaagaaagctctcaggcaaagatgtctaggtgctggcatttggaagtcaggcctggaaatacaaggaagtactaagggtcaaggggtcataggcagtgcaccagtgtcatctgccaccatatgggtaccaaatgtacttagtatgagatacttaaaattttctcactcagagattgcaacctaggtcaggtttcaagaagcaaggtgaagtgtcactgtgtaagttccttgtttagaagtgagttaattagtccagcaagcatttattgaacatgtactatgtgcctgacagtgtgctgtgccattaaggggcgatttttcagacttctcaatgctctcaattaccataatatagcagtggccatgtgagtgtgcatgatcttgcgtgtgcacacacacacatgcacacaggtacttactgtgtcacatcctaaaacacagaaattactcaaaaccagaatctttacacaaatgtctatgttgccctccagtatctatctttgtactcacagtccaaaaataagttatgccaattaaaaaaagtctccttccctgtgtagcttcaccaaagtacattaagggagctgagtaaatgtgtttaaatgggttatagtatcggcctacaaaaagcatctggtgagacaactacacattattagaggaaattgacagagtcacaaattacattctgttatttcttggttacaaataatataatactaaatggagtcacctttcctttctatttagagcttgaaacaatcttgttccaaattcatttgaggtttggatttcaagaaagaattaggcttttgttgttttttctaaaagatgaatggggaacccattccactgagttttgaaatatttataacttaaaagcttaagggagaatgatagaaaccattagctggagcccaggatgtactaggctttgggcctgtgtgtctattatcttcagcttcaacagccactgcaaagcctttcttttcctccttgggtctttttattttctgaactatgtgttcagtttatattattttaaaaggcagggggtattgctttagaaagaaaggtcatttttatattatattcaatcagtcaagaaaaatggattgggatctgttctgtgccaggcatggtcctggtcactgggagacagcaaggaacagtgggacgtggtcctgctctcacagatgtgatgttctagtgggggaggaaggaaacgccatgcaagcgggtagcgaagagaaagtcagagactctaccatgaagggactcaactagcgtgacctgctagaatgactgggggtctagtttggattgggtggtaagggaagaccctgtgaaggggtgatgtgggacctgaatgacaacatggggtatatcacatacagagctgagggtagagcatttcaggcagagagagctgc

SEQ ID NO: 11909 - DNA, 43255 bp, Human
aaaactcaccattcttcgtgcagagttctcacaaaagtgtacaattgtgtggcatccaccacaatccctgtatagaagaatcccatcatccccggaatttccctggacccttccatagccccccagtccgtcaccccctgaattgttttctggcaccccgcccccctttctttttgaagtggttgttttgcaggaaacatcaccctctctcattttacaaatactgcagacagattttgaagcccaaagcatcatagaggcagcagatcaggacagggaggattgaggcggggaggctctaccctgactgtaagaagcacttgagagacctgcaaaaagccaacaggagaggcagagactgtgggggccaattggtacaggtcctgccctgcatgacagggccagtggcccccacagtgctgaggataaaatccaactgctcatccaggctgctggagcctcctgccttcaggccaccccactggcctcttgcccactgtgccccactgtccaagctctcgcctgccctgggaggggcccctgcagcttcttgtgcccaggtgcacgtccctctcttttcccatctgggcgcctgctgacattgtaccatgaatttgaacaccaccctgcagatgacctggcctcagtccatgaagtttccctttcgtcttctgcagggcaccggcccctaatgccatctgacggtttccctgctcacaggatcttccatttgttagccccccagagtgcccagcccgagtgaagagcatgcaggaaacaagcccctgtcctcgtggaggctacattccgagaggggaggtaggcaacacacacacaaacgactccgtggtatgtcatgctgcgatgctggctgtggaggaaaatgaagtgaggcctggtgaaagccagaggccatggggctgccgaggaggaacagggacagggtaggatttgcttagagcagggcaggtcgcgtgggactctgcgggccactgaaaggaacttggcttttattcagaggatgttaaagcgtgagtgacatcctctgaccttttataaaagaggcaagagtctagggagcccgggtagaagtgagggcgtctggaggagccacagtgggctcagggagtgagcccacgcgagggcgcagagcaactggacgctccaacagggctggtggaagtgccgaacggtgtgcatcaccttggaaagcaggcagtttttaataccatgaagctcgtccagccctatgattcgcatttccactcctaggtatcacactcaagagaagtgaagacgcccacaaagggctctgcagcagcactgccggtgagagctgcatccggggatgcatggactggcctgtcattccagcaccttgggaggccgaggtgggaagcatcgctggagcccaggagttcgagaccagcctgagacctccagaggtggagaccccccccccaccacctccactaaaaactgaaaaagaaattagctgggtgtggtgtgcgcctgtagtcccagcattatctatatgttaaactgatgttttaaatcagagttgatatccaaataattaaagaataaacaacaagcacagggactggtgaggggctgggccagattctctgcaacccacatggcttcacccactttccaaacccctggttccgtgaggacctagaatgaccaccccagactgttccagaaacagcctggggattctgaatgtttcccagagaatcattaggaattatcccagcggcgctggagtaagtggccaacttaaagttggacgacactgtctgaaacagtcgcgtaaggggtaagggtggaaagcctggttctcactgcgctgccggctccccgccccgctccacagccccgcgccggcgcgggctccccgggtccccgcaagccgccgggggcgggccggggcgggccggggcgggcccgggcgtggggggccgaaggaggaagcgcgcggggcgccataaggaggaagcgggtagtcgaccgtgtccgcgcgcctgggagacgctgcctcggcccggacgcgcccgcgcccccgcggctggagggtggtgagtgcacccgcgcccctcccggggtacgcgccgagccccagcccgtgacccctgcctgccgcctgccccggcgtggagctcagggcccgccgcccgccctgggcccgaccgcggtgggagccagaggaggggaggcggggggtcagagccccaggcctcagcagcgacctgagggccgggtctctcccgcctcccctccgcccgggcgccctcctcggcgcggccggcaggtcggtgctgagggtcgggtccgcctcggaggcggggaaggctttgttgtgtcctctccacgtggcctggggattcaggggaggggtgcggggcgcggggagggggaggggccgaggccagccccggagaggagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtaagtgggctgggggctgggccttctgcggctggaccggccttcacctgcaggcagggttggggcaggtgaggagcagatggacccacccagagctcttccaccttctcaggcttgcacccccttcctggagccttatccacaccctcagtcctcgctctcactgtgggggagctgcagaggatgcggtttttccacattccatctccacccacaggaggctttgagatggggggagctctcctgggcctgaatgtgtgccgtcctggggccctgcagtcccctgggagtgatgaccgagaccagattccctgagctggggtcttaagggtgtggggagcgcagagggatcctctggcatcaggagttgaggtagacagagctccagggaggcactgccgggaggacgaccctggccaagcctctgcctgcggcccagggtgtgcgtccctgccccttctgcccctcttgcccagggagggaagaggaaatgcggggtcagcagttcgtggctggggtttaaaggcagggatctcccaggacgggcacagggagcatgaggaagcagctcgtgtctctgttcatgagatgtgagagtggtgactgagacgaggggtgcagagacctgccgtggctggggcgaggtgctgttagtgcttctgaggaggttgggcaggatagacggtggctgtcaggtggtctcaaggttgtgcaggagcttgccagagagggaagcggggcatggccccagggtggtatgggggattctagggggagggtgcctgggtgggaaggggtgtcgcatgcccagctcagaggccttgcttaggggtgctcacaggctcggctgacgtgaggatgctgatcgaaggagctgagggtcccactcatttgcaagggggaactgtctgcccaggagccccagcagtgcccaggcccctggactgacaaggatggatgagggtgatggaggcggatggacatttgacactggagcctgccttccaggcagaagggccgtgagtcatcctctctccggtgccaagtggaggggctgagcaggtcctcgacgtgaccgaggactgtgcccgttttttcaggggacccggagcgctggctctggctgtcagcccatgagagacctccctgcagagctgtggcctctggaaatgcttcctgtcgttgacatctggtcaccattctccagctggggctgtggagggcagcacaggcctggagtgtccccgagagcagctgggcgtctgcccctgcccaccccacagggcctcccactcacagggcctaattagcagctccatggctgccatacctggcggaccgccctcagcggccacatatatccttgccccaagccaatgacaggtctgaagaagacactgatggagctgaagcacaggacagagacaagcacctgtgtgccggacgctcacggagcacttgatgtgtgctgactggctcacatcacggtggtcagacgagggtagcatccccattctccagatggtgtaactgaggcaaggagaggctaagtaacttgtccaaggtcacacccgagggagttggacttcagggtctcagctctgagcatcaggcacactgcccagattccccctccacatgtcacacctgttaggccactgggggtaaggagcctttctgtggcctcgctcccctgtgagcccctgggagggaggcagcccagattccaaggcagcgagtgacgtgtgtgggaaaggggaagcttccggggcaggggttcagaaacctcgcagtggggttttccccaagagccactgctggcaggttcctacagccccatccagccccaacacagcctgcctcttttccttcctcttcctccttttctctttctgcctgcgttggtccaaaatggggaagtttcacataaatggcaaacaggccacaaagcagctatttctggaggtgctgctgccttgcagattgaattcttggttggcattttaggtgtttgttttcaggatccttttctgtagaagaagccaacaactaagaaaaggaggaagtggctttgggaggctgagacgggaggattgctcgagcccgggaggtcaaggctatagtgagctgtgattgcaccgccgcactccttgaatcctatcagcttggccagggtgggggtgggaagtggggtcttaaaggggaaagaccagccgggcgcggtggctcacgcctgtaatcccagcactttgggaggccgagttgggcggatcatgaggtcaggagatcaagaccgtcctgactaagacgttgaaaccccgtctctactaaaaatacagaaaattagctgtgcgtggtggggggcgcccatagtcccagctacctgggaggctgaggcaggagaatggtgtgaacccgggaggtggagcttgcagtgagccgagatcgcgccactgcactccagcctgggggacagagcgagactccgtctcaaaaaaaaagtgggggaaagatcaccatctggatcatagaccagacctgaaagggggctggtcacttttaggtacgtagagtaactggaaagacacactgtcctagtggaagccgtgggtggcctctgtggctgctgtggccccaggggaggagatacctgtcttctggggctgcggctcagtctggctccgggtccggatcaccagggaactttctgcagagcatcctgcctgggctttgcctggtctgcatgggatcccccagcctgtggctcagcccgcttctatgctcatagccatgctggcgccgggggcagtccttggcttccctcctcgttggcttaacaaaccccctttcttcagaggaaggaaagtgtgccgtggcctggtgggacaggctgggcttggaggtgccaaatgtcctgtgtgcttggggacagctgctgaacctccccgccgccgtcacggcccttggccaagagctttcatccaaggctggcagtagttgctctatttctgttatggggcacctctgcatctgggtttggtttaatttgtgtaactgaatgtctcattttattcctcacattcattctgtgaagtttcccttgtctgggtgagtgttcaggtgactacaaccctgggtccgggatgggcggtgttccaggagcttctgcttgggcctctcccattctcccccaaaaccaaagagaagggaaaaccctttgtaagtggatgtcacatgtcaggtgctttttctgatactgcatgtgatcccacaaggcagggagtgtccccttttacagacggggaaggtgagatcacattgcaggttcaaagcccgacatgacctgtccacctttacagcttccctctctgggctgggagtgcgtgagggcttcttaaaatgcagatggacttgggggattgagcttctctggggttctggtgtttttgtagggagagccatctggggtcagggctggggtggggacagcaggagaacaggacaggagtggcaacccagggccagggaagggagtaggcaggggtagcatatgggggtggaaagaaaggggccagtggcacgaagggccctgggaggcagcagcgtgtccctcctgggggtaagtccaggaaggtggccatccccgaggagctccgttcctgtgacaatgaggctaggcctgagggcaccggaggccagcgggcaagtgcacacccccaagcctggcggggcaccacgtgaccaggcctggtattgggactgggagtggctcctgcaccagctggcatctgcctagagacaggaaggtgggtgcctcctgggttcagctgggaactctgagctttgggtgctggaggtcactgcgtttgggatggctgcctcctggacccagctgcctctgtgtgtggagtcagtaaggcaccgtcctggctgcggaactgaggcaggcatgctatgagaagataaaattgccttaacaactgtccccaggatccttccagcaggcacttccttgctgtgccctggaaaagcggggtggcactctggatgacagcacagcctcagggtgcttctctgtggcccacacacccttccggcctgatggccacgtccgttcctgtttacccaagccccacttcccctgaaatccaggcagggagagatggggcctggctgtgagaaacctggccccaggtgtcaccatttccccaaaagccttgtttctccctctgggtatccctgaggacccctgcagacatccagccccaaacccggccaactgagcagggagcccagctaggggcctttgtggaagggtcacccgtgtactcacaccagcagccagccgctcctgggtcatcagcccctccataggagaggggaggcgtttctgccaggggctgggtggcatttctgccaggcaggggcatggcgttggcacggcacaggccctgctgtgctctgtgaggctctgccctgacttggactctgcctgggatgtggtgaaagccttgttctttatttatttagttattatttatttatttatttatttatttatttatttttgagacgagtctcactctgtcgcccaggctggagtgcagtggcacgatctctgctccctgcaagctccgcctcccaggttcacgccattctcctgtctcagcctcctgagtagctgggactacaggcgcccaccaccacgcccggctaattttttttttttttttttttgagacggagtctcgctctgtcgcccaggctagagtgcagtggcgcgatctcggctcactgcaagctctgcctcccgagtttcacgccattctcctgcctcagcttcccgagtagctgggactacaggtgcccaccaccatgccggctaattttttctatttttagtagagaaggggtttcaccgtgttagccaggatggtctcgatctcctgacctcgtgatccacccgcctcggcctcccaaagtgctgggattacaggcgtgagccaccttgcggcccagccttgttctttatgacagagtctacagagagttcagggaggggcggaccaggaggctcaccagaggctcaccagggattctggagtagctgagggacacctgccttcccctgccatccaccatgccccacccagaagcccagggcctgggcaggggagggaggcaggactcccgggtcacaaagacctggagcataggggtccactgacttctggggcctgtggtggagcctccgacctctgggagggggccccagtcacctgaagaggctcttgcctcctcatgtctcctcctgctggctgccttttcaaaaaccgtttgattgagacatactgcacatgccataaaattcacccatcaaagggcacagttcagtggcttagtatatacacggtgtgcgaccgtcaccaccgcctacaggcagaacatttcagtaacccaaagagaagctccagacacactggtggctgctccgcagccctggcagccctaatctttctgtctatggagttgcacatttaggacatttcatactaatggaatcacacactacgtggtcttttgtgactgacttctttcatgtagcatattttcaactcatgttaactgctgtaactcatgttacagtaggtgtcaatgtttccttcattttttattttgtattttttgtagagacagggtctcactgtgttgcccaggtttgcctcaaactcctgggctcaagtgatcctcctgccttggcctcccacagtgctggccttttcttggctaccagaggcaaattcaagcagcaatggaacttttcacttcgcggacgctgtttctccgttttctctccgtgtctctgtttcccctgcccctgactctgtgttctgttggtttcgggcttacccatggcttggtggcatcagtgattgagcattggtttgtggtcatattgttttgctcatctttgtaggcggatgacagagatcagttctctgtggtcagatacggagaatctggatgatcagacttcgttctctgtgtccttagcctcttttgagctcaattcaattcagaattttgtgtccaccgggaaggatacctctttgacacctggtccagggacttttccagtttctgtgtttactcttgccctggggctgaagttgtaattcagaaaggcctttgcctctcactaagtgaatgtggaaaactttttttgagtcattgggtaaggtcatgaagtgtcttgaattggaggaactctattctgattggttcgtgattagcttatgtaagtaaatatttctaagatttccagaacgtaggaaaatcgtacttctaataatttatttctttatttattataatttttttttttttgagatggaatctcactctgtcacacaggctagagtgcagtggcgcgatctcggctcactgcaacctctgcctcctgggttcaagagattctcctgcctcagcctcccaagtagctgggattacaggtgtgtgccaccatgcccagctaatttttgtatttttagtagagatggggtttcaccatgttggccaggctggtctcgaactcctgatctcaggtgatcctcctgccttggcctcccagagtgctgggattacaggcgtgagccaccacgcctggctgtacttctaataattttaatgcactagactttaaatttaaaaagaaattcttggccgggcatggtggctcaggcctgtaatcccagcactttgggaggctgaggcaggcagatcacgaggtcaggagatccagaccatcctggttaacacagtgaaaccccgtgtccactaaaaaatacaaacaattagccgggcgtggtggcagacgcctatactcccaactacttgggaggctgaggcaggagaatggcgtgaacccaggctgcggaggttgcagtgagcagagatcacaccattgcactccagcctgggcaacagagtgagactctgtctcaaaaaacaaacagacaaacaaaaaaggctgggcgcgaagtggctcacgcctgtaatcccagcactttgggaggccgaggcgggtcgatcacctgaggtcgggagtttgagaccagccaggccaacatggagaaaccccctctctactaaaaatacaaaattagcccggcatagtggtgcatgcctgtaattccagctactcgggaggctgaggcaggagaatcgcttgagcttgggaggcggagcttgcagtgagctgagatcgcgccactgcactccagcctgggcgacaaagtgagactccatctcaaaaaaaaaaaaaaaaagaaagaaagaaattcttcttacagaaacaaactggaatattttaagaatcttaagttcaggccaggtgcagtggctcacacctgtaatcctagcaatttgggaggctgaggcaggaggatgtcttgagtccaggagctcgataccagcctgggcaacatggcaagaccttgactctacaaaaaataaaagattagccgggcatggtggttgtgcctgtagtcccggctctggaggctgaggggggaggatcgcctgagcccgggaggttgaggctgtagtgagctgtgactgcaccactgcagtccggcctgcggaacagagccagaccctgtctccaataataataataacaataatcatctaagttcacgtaattgatgtaaatctttggcaaatgagactaataatttgggttttaaaaagctatgtcttttcttcagtttctttttattattatactttaagttttagggtacatgtgcacaacgtgcaggtttgttacatatatatacatgtgccatgttggtgtgctgcacccattaactcgtcattaggtatatctcctaatgctatccttccccccttttcttcagtttatcagcattagctataatacaggtgtaccttttgttctacttggcttcctcccctaaacttctacgggtttacttatcaaatcagctaatattactgttacataatgtttaagattatgaaaaatataagtttgtgttcaaataaatgtgttcattattctgaaagtgtactgtaccaaaataaagcttaggtaacttaaaaccttggactgatactaaatggagttgagtaggtattctttggatatcgacatacttactcggtaagacagaatagtaaaacattggttactaggtatacctgggtttttttcagctctaaaaagaggccgtatcttggcctgcagtcatgaccttggcaagtcacttctttcaatgcctcagttccccatctgtcaaatgggggtgatcatactgacctacctcacaggggcgttgttgtgaggcattgtaagtcaaagttaatagaataccgcagggtcctctgtggaggatgtcttgggtcctctgtggaggatgtcttgggtcctctgtggaggatgtcttgagccggacacacaggctttggtcctcactgagctgtctccaagactggaactacttactgactcggcaaattctctacccccacccctcatcagatctgctagttcagatgttgacagtgttttcatgaatgttggaatcttactagtccagacttacttaggatgttgttggggaaggcacttgggattttctgtgtcttgcattcacagagggaggtcatttcagatgcaggagcattggattagggaatcgtgaggcagagatgctaccgcttatttctctctgcaggttggggatgaaagttccattccccatgggtttgaagcagactcagactgtctcaggatcaaagcaaccctcaatggttttgatttatgtcattgcttaccactccccaaccgatcccaggacagctgggtcactgtacccctttgtggtatctgtacccgggcctctccttcctcatagggacagctgattcaataaatgtgaccaccttatttccaccccccaacaaaaagctacattggaattatttttcctagaaatgtgtgtaacactcagaattgggcattgatccttaaagcttcatccgattcactgtattcagcatctgtgatctcttagtgtctgcagtcttaacctaaccttgaccttttttccctctggtttgagaaaagtttggacactatttctacttgcccaggtgtgggctcaagagccttactctttccatctcagtgtaggggcacagccaacgcctcttcccaatagggctctttctcctttccctctccttggccctagatttgtaatccatgaaaaagcacaaggtcctggctgcttgcagtcacattctggttctctgtgttttgtggactgtgctctcactgttcacccagcactagcagtaccagacggttctgtggagtcctggggaatggagagagcacagtctgacgccctgccaagtagccaggagttgacttgcccatggtccgctggctttcccaccacttcctacaggatgggatctaagagactcagtagctgggtttctttcagcacgctgtactgtcccaagtagcaaacaaatcactctgtagccagatttctgaatggaaatgagaaattgaattctccatggacttttaggtttatgggggagttttggttgtgtttcctggttttatttcagccaaacatgtctgcttttgattttttttttttttaaattataagtggtctatatatatgttcaccttgtaaatgtcagtgtttaaaaagagtaagcatttatgtgtttccataactgacatctgatacagacctcattctctccccctcttctaccctcctcttttccctcttttcatactcttgtattggttctaataaatggttgcttttcaaaaaaaaaaaaaaagtatgttttcatgttgaggaagcatagaagggcgcgagtggctgtgaaggctatggtgtgtgtgcccacaggcgtctgctaaacatgtgtctggagacagctctcaactgtcagcctgcggttctctgtaaaatggaagtcagttactttgttaaaagttataataaggccaggcacggtggttcacgcctgtaatcccagcactttgggagaccaaggcgggcggatcacctgaggtcagaagttcgagaccagcttgaccagcacggaggaacccggtctctactaaaaatacaaaaattagccaggtgtggtggcggtcacctgtaatcccagctacttgggaggctgaggcaggagaatcacttgaacccaggagacgaaggttgcagtgagccaagattgtgccactgcactccagcctggatgacagagccagactatgtctcaaaaaaaaaaaagttataattaatacacatgatggagacaaacagctatgtaaacgcttttatttttcaaagaaaaaatacaggtggccaggcgaagtttctcacgcctgtaatgccagcactttgggaggctgaggcgggtggatcgcctaaggtcaggagtttgagaccagccaggctaacatggtgaaacctcatctctactaaaaatacaaaaattagccggatgaggtggtgcatgcctgtagtcccagctactcgggaggctgaggcaggagaatcgcttgagcctgggaggcggaggatgtaatgaggcaagatcacgccattgcactccagcctgggtgacagagtgagactccgtcttaaaaaaacaaacaaacaaacaaacaggttttgttttttttcctcaaagcagcacttctcaaactttttggtctctagatccctttatatataaaaattattgaggaaccaaaaagcgtttgattaagtaggcttttatccctatattctgtgttagaattaaaactgagaaattttaaaaataggccagtcacagtggtccttacctgtaatcccagcactttgggaagctgaggcaggaggatcacttgagcccaggagtttgaggctgtagtgggccatgatcgtgctactgcactctagcctgcttgacagagtgagaccctgtctccaaaaaaaaaaaagtgttcattcatttgaaatttgtgaaattgtttaattaaattaattaattaattaattttgagacagagtcttgctctgttgaccaggctggagtgcagtggcctgatcttggctcactgcaacctctgccttctgggttcaagcaattcttctgcctcagcctcccgagtagctgggttacaggtgcacgccatcatgcccggctaatttttgtatttttagtagagacgggatttcaccatattggtcaggctggtctcaaactcctgacctcaggtgatccacccgcctcggcctcccaaagttctgggattacgagcgtgagccacctcgcctggccaacgtaactattttataaaacaaaacatttctattgagaagaacagcattgcgtcagtgtttctgcagatctcctgggtgtctgactgaatagaggatacctggattctcggttgttgcagtatctctttcgctcagcccctgggaaagtccactgtaccctcatgagagaatgacagaagaaactgtgttatggaagcttttcaacctcacagattctctgaaaagggcctcaggcaccctaggatatcctggtccacactctctcctaaagcgatttaccagtgttttccagaatatggtaaaaatgacaaaaaacatagtgaagggcaaaactaggtatgtgccttttatcatcatggtacctgagtctgaaaagcagcaatgaattatgtcacaattttagcaaagtttgctggccttgatggtcttgccttctttgtttactcattaatgcctttgccttcaaagtgaaagattatggccgggtgcggtggcttatgcctgtaatcccagcactttgggaggccgaggcgggtggatcacgacgatgtcaggagatcgagaccatcctggctaacacggtgaaaccccgtctccactaaaaatacaaaaaattagccgggcgtggtggcgggcgcctgtagtcccagctactcgggaggctgaggcaggagaatggcgtgaacccaggaggcagagcttgcagtgagccaagatcacgccactgcactccagcctgggcgacagagcgagacttcatctcaaaaaaaaaaaaaaaaaaaagtgaaagattattctttcctttctgtgtaatgcacctggatggcagaggttctgtatagcagaatcatttttgatgctttatgttgactttattatgtttgtgcttatttaaggggaaaaaacaaagaacaaaggttcatcacttgtgaaacatcaggtttgttttgttaatggataatcaagtctctctcagacacccgcgagcctgccttaaacaactgtccagattgcctctaaaactgtccctgagactctgagtgcccctggaaaatcacaaagatttgatcattcaccttataaaaagaaaaataccatagacataatgaggtttgttttaagcgttatcttgtaagacctgcacgggaagagtggttgtcaaatcacaagagacgctggccacagctccttggttcggtgtgtatgtgtaaatgttattcatggaaataattcagaagttctgggcttggcgggaggccccgtgcttgtcagtgccctcccttgctctgtgtaggatattttcattcagaaaatatctgaatgaaatattcagaaatatctgaataacgcatctggccagatgcattagaaaatcgttatgaaaagagactttgagtcttcccatgctgatgttccccatgtgggaaaggattgcctggtgctttcaccagtgactaatagagcctctgggcccaggcttctgcatggacattacctcaatggctctcagaccaccccagcgcgccgggccagggcttcgtgaggctggaagctggctccgagtcctgcagagtgcgacgggctgctgagggaactgaattgtggtggtttgcttggaatatagctgatgtgttcatttctgttttctagatgtaagaggaaatgctttctcattcttagtgtctgtaatccgtgatgatttagtaggctctgctctggtagatggatatgaaacttttttttttttttttttttttttttgagacagagtcttgctctgttacccaggctggagtgcagtggcgcgatctcacctcactgcaacccccgcctcctgggttcaagcgattcttctgcctcagcctctcgagtagctgggactacagttgcccatcacctcacctggctaagtttttgtatttttagtagagctgggatgtagagtagagatgttggccaggctggtcttgaacgcttgacctcaagtgatctgccctcatcagcctcccaaagtgctgggagtataggcatgagtcattgtgcccggccagatatgaaactttttttttttttttttttgagatggagtctcactctgtcgcccaggctggagtgcagtggcgcaatctcggctcactgcaagctctgcctcccgagttcacgccattctcctgcctcagcctcctgagtagctgggactacaggtgcccaccaccacgcccggctaattttttgtatttttagtagagacttagggttagccaggatggtctcgatctcctgacatcgtgatccacccgcttcggcctcccaaagtgctgggattacaggcgtgagccacctcgcccggccgaaacatttttaaatgatattgctttctcagtgaacccccattctcactgtctccttattttttgtggtgatatagttatttgcataggttcagtaagaatctgtcctttttaaaattgaaatttgaaatttaaaaaattttaaactttaataataataataatttttagagttggggcctcactatgttgcccaggctggccttgagctcctgggctttcaagcagtcctcccactgcagccttctgaggagctgagattacaggtgcacaccactacacctggctctgttttttgtttgtttgttttgagacggggtctcactctgtcacccaggctggagtgcagtggcatgatctcggctcactgcaacctccgcctcctgggtttaagcgattctcctgcctcagcctcccgagtagctgggattacaggtgcacgcccggctaatttttgtatttttagtagagatggggttttctccatgttggccaggctggtcttgaacacctgacctcaagtgatccacctgctttggcctcccaaaatgctaggattacaggtgtgagccaccgcacccagcccacacctggttcttttgttttttttttttttgttttgttttttgttttgagacggagtctttttctgtcgccaggctggagtgtagtggcgtgatctcggctcactgcaacctctgcctcccgggttcaagtgattctcctgcctcaacctcctgagtagctgggactacaggcgtgcgccaccacgcccagctaatttttgtatttttagtagagacggggtttcaccatgttggccaggatggtctcgatctcttgaccttgtgatccgcccacctcgtcctcccaaagtgctgcgattacaggcatgagccaccacacctggcccacctggctcttttttaagtgtatattttttatcgtggtaaaatagatatagcataagatttcccattttaagcatttttaagcgtacagttcagtggcattcagtacagtctcattgtcgtgcaaccattaccaccaaccatctccagaactttttcacctttcaaaacagaaatggtaccattaaacgctaacttgccacccccagcccttggcaggtgcctttgtactttctgatccttgtgaagttgactactctgggcaccccttggagatagaaccacatgtatttgtcctttcatgactggcctagttcgcccagcgtagtgtcttcaagttcatctgtgttgtagcgtgtgtcaattgtatgtcaccccatgttttatttttccactcatctgttagacatctggactattttggccttttgtttgctgttagcatgggtgtgcaaatgtgtgttccaggctctacttttcagttcttcagcgtaatacccaaaagctgaattctaggtcaaatggtagttctaggtttaattttttgagggactggcgtctgtgccttttctcaaactaaaatataactggataagttcctagtgcggccagggccttccctggaatgccgtatttgtgaaggatgctgaccagccacttctagaggaactgaggcgaccgtggagtcagtgcctgcgaggtctcggcctcctgggaagagtagctcggccccagctcacagcgtggcaggaaggtcacttgccagcagctggggaacttaagctctttgagggacctgaataaaagagatatgagactgaatgtacaaacagacatgactggaccccgttaccttcaaggaccccccaggaggccacaggccagcttgtggagccgggtgctgtcactagcaaccatccgggaagccatgcagtaactagagtctatgctgtcagccccacatggccagggcttgattgactggcagcttcctgaagttttgtctctgcttccatccaacttgagaccaagtagagaacccataggtgcacgtaacggatcgatgggtagctttccttggagcctctcccaggcaaacgcgagtgacagcggccgagtcccttgctgttgggagctctgagaacacaccctcgcctcacctttgggtgggcttcactcgcacaggcactacaggagaaacctgctggaattgctttctttttttcttttttttttttttttgagacggagtctcgctctgtcgcgcaggctggagtacagtggcgctatcttggctcactgcaagctccgcctcccgggttcactccattctcctgcctcagcctcccgagtagctgggattacaggcgcccgccaccacgcccggctaatttttttgtatttttagtagagacggggtttcaccgtgttagccaggatggtctggatctcctgaccttgtgatccgcccgcctcggcctcccaaagtgctgagattacaggcatgagcgactgcgcctggcatttttttttttttttttttttttttgggacagggtcaggctctgttgcccaggctggagtgcagtggcgtgatctcggctcgctgtaacctccacctcccgggctcaagcaatccttccccagtagctgggactacaggcacacgccaccatgcctggctagtttttgtatatattatagagactgggtttcaccagattgcctaggctggtcttgaactcctgggctcaggtgatcagcctgccctggcctcccaaagtgctgggattacaggcatgagccagcgtgcccggccgaagcctggtggtttcttaggcttagtttccagccctccaaatagcagattgttgatggtgttcaagggcaatctaagattccttctgaagatagccagggagaagctgcttttgtgccctcattgctgtttgacactgcatggccctaaattagtcaaagaagcataaggaggcttagttaaattgaactctcactgcaccatgtaatggtcaggtcagtctcatgagtcctgcccttttgtgttaaagaatcctttgcggccggcatagtggctcacgcctgtaatcccagcactttgagaggctgaggggggcggatcgcaaggtcaggagtttgagacccgcctggccaacatagtgaaaccccatctctgctaaaaatacaaaaattagctgggcatgatggtgcatgcctatagccccatctgcttggggggctgaagcaggagaatcacttgaacccaggaggtggaggttgcagtgagccgagattgtgccattgcactccggcctgggtaacagagcgagactccatctcaaaaaagaaaaaaaaaagaaagaaaggaaaggaaggaaagaaagaaggaaggaaggaaagaaggaaagaaagagagagacagacagaaagagagagagaaagaaaaaagaaagaaagaaagaaagaaagaaagagaaaaaagaaaagaaagaaagaaagagaaagaaagaaatgcgactgaactttgcccagtggaaaacgaccagtgcgtgaacagaaagaaatgcgactgaactttgcccagtggaaaacgaccagtgccttgtggctgttgggcccagttttgcgtcagtttgtcaacgcatttccagtttccccgttgcctgcgcacacagttcttggactcctttgaatggttttaacatcgctgtttcccctgttaaaaaatgagttaataaaacctttcacatgtgttcacgtaagaacaacaacaggccggctgcagtggctcacgcctgtaatcccagcactttgggaggccgaaggagggtggatcatgaggtcaggagttccagaccagcctggctaacatagtgaaaccccatctctgctaaaaatacaaaaattagtcaggtgtggtggtgtgtgcctgtaatcctagctactcaggaggctgaggcaggagacttgcttgaacccagaaggcagaggttgcagtgagccgagatcgtgccattgtactcctgcctgggcgacagagtgagactccgtctcagaaaaacaaacaaacaaacaaaaaaccaaaaaggaaatcaccttctccaaaccctttatttttcttttcttttttttttttttttgagacggagtttgctcttgtcgcccaggctgtagtgcagtagtgcgatctctgctgactgcaacccccgcctcccaggttcaagtgattcttctgccttagcctcctgagtagctggattacaggtacgcgccaccacacccggctaatttttgtatttttagcagagacaaggtttcaccatgttgaccaggatggtctcagtctcttgacctcgtgatccacccgcctcagcctcccaaagtgctgggattacaggcatgagccaccacgcccggcctccaaaccctttatttttctgaagacaccaaggcacaaaaaagtgaagtgtcaggaattcctttccctacccctctccttttctgattaattcttgggcattcttcagccctgacccaaatggcactgccccttctctgggtcaccaatctaggccatggtccatgtgtgttcacatttccgggttggagctttccttggcactgcacggagcatgctgtgaagtttggtgggtggatcgacgttcctagagcagcacgatgttcctaaattagcgggcatggtgctgggcacctgtagtcccatctactcgggaggctgaggcaggagaatggcgtgaacctgggaggcggagcttgcagtgagctgagatcgtgccaccgcactccagcctgggcgacagagcaagactccgactcaaaaaaaaaaaaaaaaagaaaagaaaaaaagaaattcaggccaggcacggtggctcacgcctgtaatcccagcattttgggaggccaaggtgggcgatcatgaagtcaggagttcaagaccagcctgcccaacatagtgaaagtccgtctctactaaaaatacaaaaattagccgggtgtggtggcacacacctgtagtcccagttactcaggaggctaaggcaggagaatcgctagaatctgggaggcggaggttgcagtgagccaagaccatgccattgtactccagcctgggttacacaggtgagactctgtctccaaaaaaaacacaaacaaaaacaaaaacaaaaaaactggaaaagaaattcagtgagtcagctgtttcctgtgagtgggactaggaagacagggatgatgttgaccaaggagtggactgccctgcagatatctggcccttaaaaatcttcttctgggagcacctgtgtgctgtgcttgtccccgtgtgacccatgcctctatctgaccaactgcatggtgttttcaatgagttccaggacatttggcttccagagtgcatgggaggcacataggcctcagaagcaaagctggcatctgagcatactcgtgagggcctggcgccccctggctcagcagcagcgaagctgccccctgccctccctgggcaccctggagcctcagtcgtgtctccgaaaccagggcagaagcgccttcctggcgaggccgtggtgaggattggaggggaggcctgcggaggggcctggcggtgcctgctggggtccttgttgtcagagatggtatttgtcacccccgtctggcaaagtcctggagactgggggaatgtcacccccatccggcagagtcctggagactgggggaatgtcacccccgcccggcagagtcctggagactgggggaatgtcacccccatccggcagagtcctggagactgggggaatgtcacccccatctggcagagtcctggagaatgggggaatgtcacccctgtcctgcagagtcctggagactgggggaatgtcacccccgtccggcagagtcctggagactgggggaatgtcacccctgtccggcagagtcctggagactgggggaatgtcaccccagtcctgcagagtcctggagactaggggaatgtcacccccatctggcagagtcctggagactgggggaatggcacatgcagggctcggcacctcaccctgctcactgcgagggccttggggaacctggctgtgagtgtcctggcatgagggcagcctcactgaggtgaggcagggtatttcccgtttcccatctgcctggccgtcttcccactggcccttggaagagagagggcatgaactcctggctgcgtgagtttccttcttactagcaactttgtttaggagttgggatgggcgtagggccgctattgacgggggagcctctgtggtttccagggcgtctgcatccacgccctcctaggcccactcacagctgcagttgactcattggatttcttcttaagtgacaaatgaagccagaggttacccgatgcagggctggtgctccacctaaagttgaccagccaggcctaggaatgccactccctgctcctaaagccctccaagaccgttgcctaggggaggcggcctcatgtcccaagggatggggcccccagggtctgggccgtgtggcctcaaggcacagctcaggggagctgccctcactctgtcctctcccgagactgccacaacaccttgcccctctgttatcccatatgatcatggatttgatagaaaatgtcccattcgggggctgggcgcggtggttcacgcctgtaatcctagcactttgggaggctgaggcgggcggatcatgaggtcaggagatcaagaccatcctggctaacacggtgaaaccccgtctctactaaaaatacaaaaaattagccaggcgtggtggtgggcgcctgtagtcctagctactcaggaggctgaggcaggagaatggcgtgaacccgggaggcggagcttgcagtgagccgagattgcgccactgcactccagcctgggtgacagagcgagactccatctcaaaaaaaaaaaaaaaaaaaagactgggcgcggtggctcatgcctgtaatcccagcacttcgggaggccaagacgggcggatcacgaggtcaggagatccagaccatcctggctaacacggtgaaaccccgtctgtacgaaaaatacaaaaagttagctgggcgtggtggcgggcacctgtagtcccagctactcgggaggctgaggcagaagaatccctggaacccgggaagtggagcatgcagtgagccaagatcatgccactgcactccagcctgggcgacacagtgagactccgtctcaaaaaaaaaaaatgtcccattggggtactcatcacagccctgtctttagtggtgacaatgctaagctattcacatgcccaacactggggttagtggtattcactgtgtatgtgacacaccagcatgggttagtggtattcctccatgatgtgacaacatcggtatgggtcagtggtattctgctgtgtatgtgacacaccagtttggattagtgggtattctgccatgcatatgacactggtatgggttagtggtatttgctatgtatttgaacacactggtatgggacttcggccctgagcactagtgacactttgagctggatgagttgtgggtttgagctgatgagccgtgcccccactgctacccgctacgtgccaggagcacaccccccataaatgtctccagacagctccagatatttcctgggtatccaagtcgccctggcagagaaacactgcatgagacacggcgttagggtctggtgggagactcaccacagtgccaaggtggctgcagtttgcttgtgacatgggcgtgtatctgagtgtgaaggaagctggtttttgtgagctgcctcccgagctcagaggtgacagtgggcactttccccacagagacccctgaagttgttccttggagaacaaagtggtgaggggcggggattccagaccttgaggcagaagctagggtctggtccactgttctgtggactgggcagtggccctgggaggtgccgtggcctctgtggcctgtttcctggggtggggtctgtcttgcgctttgtctcttgtgggtgcagactccccttcctctgctgtggagccggcagatggccccggagccagatcctggtgcctccctgtccacatgcagctcagtcatttgctcttggtcccttcctatgaaatgcacggccacacacagccagggtttctcctgggctccccagagggagagtagggtgcagcctgcaacagtgcagggtccccaggcctgtgtgagcccccaggtggggaggtgggtgatgcgcatgtcagtgctacctcctgccacctcctctctgcctgggcacaggctttctcctctgtttgctttttatttcctatgtattcaggaaccatgtgaaattgccaatgcttggttttgtcctacaaaatggccatttcatttggttcaacctgatattgtgtctacacacacacacgcacacacacacacacacaggcaaatactttttaaaacaggattattctattcacagtgttctgtagaaatttgtgttcagtctttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcagtctttttaagacagcttactgtactgatgccgcacagatcttttttttttttcgagacagggtttcactctcgcccaggctggagtgcagtggtgcaatctccgctcactgcagcctccacctcctgggtgtaagtgatcctcctgcttcagccccccaagtagctgggcccacagggcttgcatcaccacacctggctaattttgtatttttgtagagatggggtttcaccatgttggccagactggtcattctttttgagatggagtctcgctctgtcgcccaggctggagtgcagtggcgtgatctcggcttactgcaacctctgcctcccaagttcatgccattctcctgcctcagcctcccgagtagctgggactacaggcgcccgccaccacgcccggctaattttttgtatttttagtagagacagggtttcaccgcattagccagggtggtctcgatctcctgacctcatgatccacccgcctcggcctcccaaagtgctgggattacaggcatgagctactgcgtccagccggaagatttaattttttaattgtcaaatccattctctctctctataaacattttacattttatgataataaaataatttgtgagcccacggccccgtttccctgatgcctgaggtcttcctggggcggcatgggagggctgaattcaggtgcggggtcggccccagggcactgagcgcctgggtgagtatctggaatgaggaaaacaaagcttggctcccgccaaggagaaagaaactcaggatgcggggctcaggccaggacctcggctcagccgccatttctggagcacaggccagcttcgtcgtcctcccgaggggtcctgaccagggcttcccaggagcggccgcccactctgtgtgtccctttccaggtcgccactgggacactgtgaaccaggagtgagtcggagctgccgcgctgcccaggccatggactgtgaggtcagaggccagatcccctgcgggtgccttgtggggggcggggtcgaggggtaagggcctgcgtgtcccccaccacgcatccctgagggctgaggctgagcccgcctggcccttaccacagctcggcacagacgaaccccgcccagccccttcactgaagcaggcgggagccgggaagtcctacctttccctgtcctgcgccttcctcgcactccgcttgtggtgcagcccctccacaccgcgcctggggctaactgcaagggcgagggggctttgggtttaagaccatttaacagccataggctgtgggtcccagcactttgggaggccaaggcaggaggattccttgaggccaggaggtcgaggctacagtgagctgtgattgtgccactgcactgcagccctgtccaaacaaacacgaaagagatttaagaagaagaaagggggcattagataagcacttcatataattctctcaactgtaaaagcaagacaatacttaccttgtctaaccaatgccattgctatgaggagcaaataaatcaataaaggtcaaataaaagtactgtaaactgtaaggtgtttcaaaaattttttaacccactggatttaaatttcccttcatagctgggcgaggtggcttaggcacataatcccagtgacttgggaggcagaagcgagaggattgcttgaagccaggagtttgattgagacaaacctgggcaacatagtaagaccccgtctttataaagataaaagcggtggagttctgggaggggagcccggagcccccgccttcagcaggacgctccctggatgcttccttgtctctccttccctttaaatggtctggggagagaaaaatcacagcacacgggtgctctctcccacccgctgcatcacatcctcctcccctccctcctgccgaattctgcagcctctgggcgcctcacgctgtcctggcagcctctgggaaggcatctgcgaagtctaatgccttggcacttagtgactgtgtcgcagttcctgagcatggagagcacccggcacccaggaggttctcaagctgcccctactgggggtcctttccaaaggtggggacggtgtggatttcagcgtggtggctggagggctgaggcagtggctcgagtttgatgttagttacataaacagaggagattgcaggagctcccccggccctgatccaggcttgttgtcagtgtccaaaagaccactctgggtgccactgtcccttcccacctgccgctgctgttccggcttcgcgctctggcggcctccgcaggtagaacaccaccgtcacccgcgcagcgccctgactcgccggaggaggcgcctgccctcccgcccgcctctccccggccccctcagtgagggagggtggacgtcgccactcccctttcttgccttcggagtgaggaagcggaggcagcagtacggcagcccgcccagggccacagagctggggtcacagcgaaacactccgaaactttcttttcaattatagggttcagccttttttcccatcataactttaattctgtgtagatacttctattttttatttttatttttttttttgagattgagtctctgtgtcgcccaggctggagtgcagtggcacgatctccgctcactgcaggctccgcctcccgggttcaggccattctcctgcctcagcctcccgagtagctgggactacaggcgcccgccaccacgcccggctcattttttgtatcttagtaaagacggggtttcaccgtgttagccaggatggtctcgatctcctgacctcgtgatccgcccgtctgggcctcccaaagtgctgggattacagatgtgagccaccgtgcctggccttattattattatttttttgagacgcagtcttgctctgtagcccaggctggagtgcagtgatgtgatctccgctcactgccagctccgcctcccaagttcatgccattctcctgcctcagcctctcgagtagctgggactacaggcgcccaccaccacgcccggctaattttttatattttagtaaagacggggtttcaccgtgttagccaggatggtctcgatctcctgacctcgcgatctgcccgcctcggcctcccatagtgctgggattgcaggcgtgagccaccgcacctggctaatttttgtatttttagtagagatggggtttcaccatgttgcccaggatgttctcgacctcttgacctcatgatccgcccgcctcggcttcccaaagtgctgggattacaggcgtgagccaccgcgcccggccagcaccatcttttcctttccactggaactgatcttattatttttgcctccattagatcatttttgtaacatgtcttgcaggatttactgtcttgatcgtttctcttaacatatttttttcctgtgatctaaaaagataaaaaactatcaattcttttatcaaaagtggatctagaggctgggcatggtggctcacgccagtaatcccagcactttgggaggccaaggtgggcagatcacctgaggtcaagagctccagaccagcctggccaacatggtgaagccccatctttactaaaaatacaaaaattagccaggcgtggtggcacgtgcctgtaaccccagctacttgggaggctgaggcaggagaatccattgaacctgggaggcagaggttgcagtgagctgagatggcaccattgtactccagcctgggcaacagaatgagactctgtctccaaaaacaaagtggatctagaagatcaaaaaagggcatgattccatattggcacagcacaagccctattcttggaattaaatggcatccatcttccgagcccactcctgtcctgcagggccggcccagcctgtccctgaggcactggtccagacaggagcctgtccacacagctgtccactcagtgggcccagtgcttggcttcacggtcacttgcggcacctagacctcctctggcaggtgccattctttcctctccctccctgccgcctcgagtctttattttctgtgggatcttgagtttgataacctgacctgctgtggtggcagcgccgctctgtgtccagattctggatgccaatttaccaagcgcaggtcaaaaagaagtccttgggcagcggctgcctgcgttagcttcttggggctgctgtaggcggttccaagcaggagagtggctttaaacaacagatgcggatcccctcccggttctagaggcccaaaggctggaatcccatgttgcccggctgcttccttctggggcgctctcctggctcctgtggctgcctctgtcttcacatggcgtcctctctgtgtgtctctgcttaaatctccctctcctttctcttacaaagacaccagtcattggatttagggcccaccctaatccaatatgacctcatcttaacttgattacatctgtaaaaaccttattttcaaataaggtcacattgacaggtacttggggttaggacttgcgcttttctttttgggtgacacagcttagcccagcactaactgtgtcaccaggactgtcgcttgaggcaggaatgaagcacatcctgtttgtaagctgtcttgtgccatgcggctgctccgtacaagaattgttaggaattgatgcagtggaattttgcatacagtttttcctctcttcagaaacaactttggagaagtaaaggctgaatagcaatacacaagcaccttattttattttattttagattcaggggcacgtgtacatgtttgtcacatgggaatattgtgcactggtggggactgggcttccggtatcgcatggagagggactctttctgcgctcccccgcccccgcctccctactgtaaagtgcccggtgcctgctctctccatcttcgtgtccatgggcacccattgtttagctcccacttataagtgagaacagtcagtatttgattttctgtttctgagttagttcacttagggtaatggcctctagctccatccgtgttgctgcagaggacatgattttattcttttttatggctgcagcaatacacaagctccttatttttatttatttatttatttatttttgttgtttgtttgtttgttttgagacggagtctggctctcgtcccccaggctggagtgcaatggcgcgatctcggctcattgcaacctccacctcccgggttcaagcgattctcctgcctcagcctcccaagtagctgggactacagacgcccgccaccaggcccggctaatttttgtatttttagtagagacaaggtttcatcatgttggccaggctggtctcaaactcctgacttcgtgatccgcccgcctcggcctcccaaagtgctgggattacaggcgtgagccaccgcgcccggccaagctccttattttaagcattttttttttcttttttgagacagggtttcactttgtcacccaggttggagtgcagtggtgtgatcatggctcattgcagcctcaaacttctgggctcaagtgaccttcccgcctcagtctcatgagtagctgggactgcaggtgcatgccaccttggctaatttttattttttgtagagatggggatcttgttgccaggctggtctcaaattcctgggctcaaacgatcctcctgcctctgcctcccagagtgccgggattacaggcatcacctagcaaagcattaaaacaatttgctgctgggtgcagtaggtcacacctgtaatcccagcactttgagaggccaaggagttggggggagttggggggcgggcggatcacgaggtcaggagttcgagaccagcctgaccaacatggtgaaacctcgtctctactaaaaatacaaaaattagccgggcgtggtgatgcacacctgtaatcccagctactcaggaagctgaggcgggagaatcatttgaacccaggaagcggaggttgtagtgagccgagatcacaccactgcactccagcctgggtgacagagcgagactccatctcaaaacaaaaacaaaaacaaaaaaacaatttgccctgtaagaactgtcctctaaaagtttttggtttttctaatgaaaaatattatggacttagagaatagaaataaatttctgcctacacttccatcttccctcccacccttctctggcagcccaggaggtctttttgtgtgaatctgcgcagatctcagcgtccctgcccttctttgtgttttgttctctcttccaccttaggtctttctctggtctgggcacacccagctgcagggctcacctttgcctgtaagaatacagcccccaaacacagtcagtaccccaagaacagtccctgccatctctggcggcacagatgctggccaagctgcagctgccagtgctgcccagggagctggagagctgccggccaagagcccagcccctctgggtagagcaggagccagtgccaccactccctgtgggattcggattaaggacacacccacccaaagtaaaccaagcttggccaaaggcaggtgcccagctgtggtcaccactccgcagtagttactgaaaatcttccatctgcccaataccctcctgagcccgtgaaggagatgagcggaaagaggctccgcctgttggaagcacagccaggaaaggtgggctcagattgctgaagcctgcaggggaacttgaagaaagcgtgccagcacaggatggcggatgatgcccgcatgacactcgctcgcctccccggaacagcctgtggccttctcacctagtgggaagctccccagccgcgtgtttcaggaggtccagcagattcctctgcagaggaatccctttctgcagagtcggggctcgctccctgccatctacgggcagtgctgcttaaagctgtggctgcagaccttgcctctgcctgttgagacctcctgcagggccctccagcccacagggtccctcagctctctgggacctgtgaggctctttgggccagctgcaactggagctctttgcaggaggggcctctggcctggctgaagtcccggcttcctgactcccctttcccctcaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggtaggcggccggccccacctccttccccaaagctgggcttctctgtcgccagtaacattcagggagcctcagggctggaagggacccccgggatcactctgcctctgcagtttcagctgccacgtacgctggtatcacttaatcacttgactggtctctacttgattccctccagtgctgctgaactcactgcctaccatttttgggtgactctgttagaaagttcttcctttctgttgagacagaatctcatgtactggtcttgagtcccttgtctggaccaacatagaatggtgtttttatccaattttccaaatgtgattctgatacaaagattgcagaccacttgtctggattatataacccaaggggttctcacacttggccttgtatcatttcaaggacctggagctttaaatgctggtgcctgcatctcacctccagagattctgattggttggtctgggcattgctgggtctgggcaaagcccccaggtggcactaccggtgcggcccctgcctccccaagcaggcctggctgactgtcccattgattgaggcccactggtttcacagtgacttttgcactgtctatacctgacatatttcctttcatacattatgctccgtgattacctatacaagaacacagaagtatttggaacctcatttccaggtgaggaaacccaggtccagcaaagggtaaatgactagctccagatcacacagcttgtggccatgttaccactgggacatggggccaggccccttcttgaggtgggcctcagccgccctcccactgtagggcactgactccaggtcaccatggtttccagactgttcacctttcctgttgctgatccctgcactctcctccagcctccagctccactcccctttgccaaggggctgcttctatggacaggggctgtcccgagtggaggctgggggcgagtggaggctcacccacttccagatccagccctgcgacgctggctttcagtagtgtgcacattggaattacacgagaaaccttttccaaatgcaggccttgggccctactccagctgcctgcatcaggctgttttagggcgggagactgcccagaggattctgacgcaggtagaatccctgccctgaaagcctgcagggatccccggaccctggtccaggccttccaagctcaagggttgcactgccctctggtggctgtgggggagaccaacagctgacccagccttctgcctcccacctgtcttagatcaggtgcttgaggacgtggctggagttccccactagaccggggtgggggtgggggtggggggtggggggaggtgtctgagaatgtctctgccttctaatccagccagcatatcttctggctcgccctgaactgaggagaaaccccagatccctttgggaaggtccaggaagggcaggagtggacaggcacagctctgctgtcagcactgctgtgggggtgactgtagccccagtctgccctggtgtttttctctcgctcttctccatgccggcctttgcctctagactgagaaaccggggttgactcaagtggcacctgcaaaagtgatcatggcagttcacttagcctgcaggtgacagggactgtgaatctagtccctggcgagcctggaaagaggggcaaggtagaggctctggctgccggggtttctttggtgagtccgttcactcggctggacacagacggatcaggaaagattcctgttgctactcggctggtggccagagggagagaggacgtgtccgtaactgaagcaaggtggataagcttcgggaacgagcgaggcacagattctgtgctgggggagtgatgaggtgctggaggagctgggtgctctgctctgcagggaatcaggaaaactttggggctgcagctccaattgagctgggccttgggggttgggtatgtttggttccttggaaactgggaagagggaatggccatcttttaagcaaaagcccagcggctataaatgctacagtgaggctgggtgcagtggttcacgcctgtaatcccagcactttgggaggccaaggcaggtggatcatgaggtcaggagttcaagaccaccctagccaagatggtgaaaccccgtctctactaaaaaaaatatataaaaattagccaggcggggtggcgggtgcctgtaatcccagctacttgggaggctgaggtagagaattgtttgaacccgggaagcggaggttgcagtgagctgagattgtaccactgcactccagcttggggaacagagtgagactatgtcttgaaaaaaaaaagaaaaaaaaaagctacagtgagtagttgagtttgcctaggaagcgtggaagttaagtcagacgtactttcaggctgggtcatgacttgtcacttaagcagagatgagcacttgagaggttttgaagagaagtgatgtggcagccttactgcatgttccatggacagactccagggaggccgtgaaacccccagagcacagcttctaagaacgtgcccactccttagcacgtcacttctcccaaccctgccctgctctgaggtctgtgctgtgaaggtggccgagtagactggacggcagggagtggggctgtcatcatcagatgagagctaaggggacccccaccagggtggcggcaatggcagagggtaggcaaaacgcttgtatttgcaacataaggtgagatttgacagctgaccgagggtgggagcagcagccaaaaccaaaaaagccagagggaagttgcaagcacagaaaaaatagaagatttaatgggagaaataacaatagctggcatctattgaacacttactgggagctaggtacagggcccattcattcattcatgcaattaaaactttttttaagaaacggggtcttgctctgttgcccaggctggagtgcagtggtgtgatcacagctcactgcagccttgaattcctggcctcaaggagtcctcccacctcagcctcctgtgtagctgggattataggtacgtgcggtacacctggctccctttaaaagttttttgtagaggcagggcacagtggctcacacctgtaatcccagcactttgggaggccaaggcaggaggatcacaaggtcaggagttcgagaccagcctgaccaacatggtgaaacccgtctctacttaaaatacaaaaattagccgggtgtggtggcgggcgcctgtaatcccagctactcaggaggctgaagcatgagacttgcttgaacccaggaggcgaaggttgcagtgagccgagatcgcgccactgcactccagcctgggtgacagaacaagactccgtctcaaaaaaaaaaaaaagtttcttgtagaggcagggccttgctttgttgctggtgcaatcacggctcactgcatcctctaactcctggccttaagcaatcttctgtcctcagcctcccaaagcactgggattacaggcatgcatgaccacacctggtccctgccattgtttattgagcacctactgagtgccatgtattaagtgctgggtatttgtcagtggacaaaacagattaaaaaaatcacagcccttagggagcttaccttctggcaggggcgtcagacaataacacagcaagtgctgaggaagaaacggaggcggcagggagcgtggcagttgagcgtggccttcatggagctgcgacagtggtactcgggcaggggcagcacggaggctgtgcgccagaggaggaggactgaggggcaagggggagagctctggttggaaaggcaggggagattctccagggccttgccggtgccagtgacaactggggttttcctgagacgggactgcgaggaatgggggctctcaggcttgagagggcaaaggtgggtctgggatgccgtctgcccacagagccccttccccaacggctgcccaggccaaggccaaccctgttgggttgtgtggtgtgagccatgaagccgctgccaggtttgtacctcaggcgtggtcgtgatgccccagcttcaccggccctgcctgtggggacgtggtgcctgtgtgcgggagcctgggcctcagccgaggccctgagctccggcactgcccagaacccagctcagcgctggtactcagcccgcccgctgtggccctggtggagtggagcacgtgcccagtgggggctggccttgtcccatcgcggacctgtcctttcccggggcagggtggtgtgggagagggtatcagggacattttctgagtctgctctgtctctgccgcccctgcccgaacacagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggtgagtgagggcctgaggaccgcgtgggcgggcaagtgagccaagggggcctgtcccctgcctctcaccaggcagcccactgtcccgtgaggccactcaactcgtgactgtcaggtccagaactctgacgaagtaactggacgtagggcatggttcattgccttgcagatttcagctggttgacatcgaggaaacctgaaccttaaatcagagtaaagagtttaggggtaaaagcctctaaaagatgaacgaagcatgtttggccaacagaagaaacagacgcttcctttggttgtagggagtttaataatggtgccagtgagaaccgtaagccctgggagtggtgcctgctgctctgctgagctccttggttggaatccacacaactttctgagctctaccatctgcttggcactgttggggatacaagattggtccggggcactgtgtccccagaacacttagcggaaagaactacatcctcccaactgccaaatgcaggcctgtagcggtaggagctgagaggagagaaagttccactttttcgactctaccagctgaaaatgcaggcgtcctcacctcctagaaatccaatcatgcttctgttcagtggggccagcctgtgatgtcccagcagctgcctagaacgcaggagtggctggcgcactcccatgtaactctgcatgtgcgccgaccgcctgacggtccttgccagccttgtagtctgtctagtgtcccccaggaacccccttcctcctgtccattcagctaggtctgcaccaataaaatgggcctaaggcgtcgcaggtggtcactagttctggactcgaagtgccttgggcgcagggatgacccaggcttcttgtatcccatcaccgtctaacagtgggcacatgggctcaccacacatgcgtttgcttaccgagccccctgcagggagtgatcgcagtcttccctttccattgcctctcagaactcaactgtttctcattctttccgcccagcagccctggatacttaataagtactttgaagtgcttcttcatactggggactgtctttcctttgagagggaagagtattagtaaaccaggttctgtgtgcccctctgtgcaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgtaagaacccttgaggtcagctccttccctgcctgccgcccatgcccttttctctggaaggttgagaagcccagcggggcccctgcctctgatgccagcacaagggttacaggctgtcctgctcgggtttggttttgctgttgtgagctagaaagctgtgtgtaaaggtgacgaagagcacccagagtcctttggagctttagcagcttactattggagacatgctccattcagaggggtggcaaaggctcacgtcacactcctggtggggtcctcaaggcacaagcaggtacagagtggaaggaaggggctggagggctcacaatgagcttttcagacctctcaccttgccataaaaaataagtgtaatgtggccagtgcggtggctcatgcctgtgatcccactgctctgggaggccaaggcaggtggatcacctgaggtcaggagttccagaccagcctggccaacagggtgaaagcccgtctctactaaaatacaaaaattagccgggcatggtggcgcacacctgtagtcccagctactcaggaggctgaggcaggagaactgcttgaaccctggaggcagaggttgcagtgaactgagatcgcaccactgcactttagcctgggcgacagagcaagactccatctcaaaaaaaaggtgtaatgtgaaccaaaacgagtagtcaaaaaagggggggaactgtctgaaatcttttccagagcacatctgtcccataaccaggtattacaagtcacagtctaaaggctgggcatggtggctcaagcctgtaatcccagcgatttgggaagcagaagcagtgggattgcttgaggccaggagtttgagacaaaactgagcaacatggcgagaccctgtctctaaaaaatttataaaaataattagctgagggccaggcgcggtggctcacgcctgtaatcccagcactttgggaggccaaggcaggcggatcatgaagtcaggagttcaagaccagcctggccaagatggtgaaaccccgtttctactaaaaatacaaaaaaaattagccgggtgtggtggcgggcgcctgtaatcccagctactcaggaggctgaggcaggagaatcgcttgaaccctggtggcagaggttgcagtgagccgcaatcacgccactgcactccagcctggatgatggggtaagactgtctcaaaaaaaaaaaaaattagctgagcatggtggcgtacgcctgtagttcacgccgtcatggaggttgaggcagctcctcaggaggctggggcagaaggatctctttgcttgagcccaggagttcaaggctgcagtgagctgattgtgccactgcactccagcctgaacaaaaacaagacctgtctctaaaaacaaacatacagtgttcacaatgctgcccaagaagggccagtttttgcagctgcccccatgtagcaaaatctggtgcttctgtttcatagacccaaatggaaattaagtggatgtgtcttatttgtaaatttaaaaatattagcgaatgtttgggaatttttttttttttttttgagacagaattttgctcttgttgcccaggctggagtgcaatggcacgatctcagctcaccacaacctctgcctcccaggttcaagcgattctcctgcctcagccccccaagaagctgggattacaggcacacaccaccatgaccggctaattttgtatttttagtagagatgaggtttctcccatgttaggctggtctcgaactcccaacctcaggtgatccgcccacctcggcctcccaaagtgctgggattacaggcgtgagccactgcgcccggcctaatgtttgggattttatgacatgtcagaagcattacttcaggctttggtttttaagtaaaatagcatctaatcctctactgagaactcataagaaaacattccttatatgctgtggtcttcagttatacaagcattttaaaaacaggagaatgaatataaatcttaaatcaggcattaaacccagctgaattgttggaaggaggtaagcctgagaccattcctggacagcttttaccaacacccatgtaaagggggaaagggtgggcaagacgtgtgcagcagtctgtatggacagcttaccagagactgagggctgaggcagaatcgtgattcctctgacccagcaggggcctcctgacaccgtcagtgccttggagatgtgaatacccacctcaccgcctgaacggcctgtttttgcagttgcccccatgtagcaaaaagtaggatgcacggataggacttcagggctctggagaacgtgtttttgcataaaccccagctttgctctactgtggcacagagctctggagcctggtttgtgaatgagcctagctgattctggctttttctcctttcttgctctaggggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttgagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttacc

SEQ ID NO: 11910 - DNA, 33720 bp, Human
gaaattaaagggaattaaagaaaagctggcaaggagtaaggaagggaaaagtttatatttttaaaaaacctaaagtgactgatgtattcaaattcctggattatataatcttcaaggaaagatacagacttttcctctattctggaataatgatgatggtggtcctagggctgtctatagatgtccaggcccgagcagtctgtttcaccagtacaatcccagttaaaatgcaagtctgaggggttgtacaggccatgatcatagagatcctggagagatcccgctggtatatgcactgggccttgaggcaggcaaaggtgcaatttctaagtgatcgtgtatcctaggggacaaaatttgtcccagaaaaatcatgaagtaggcaaactcccctgggcttcagtgaattcttttctaaaattaagagattaagttctaaaaatgcaagaactccaagatggcttggagttttttatacactgtatacctaccttacagggatgcatgcagggtgcttggtacagggcctgacacagagtaagccctccatgaaaggggtcggtgataatgatgctgatggtgatgatattcttggttgcccagtatcccctatctacacctttcttccacctgcagtcacctactgcaatatcttccctgtaccactttaatatttttgttgttgttttctttatttttttaagctgtacacttttattgaactggtcttgtcaggtttgttattttttaattaaaatctattatactcttacttacctgagccacccttagttatgatttaaaaaaaaacaaaaaaaacagggccttgctctgttgcccaggctggagtagtacagtggtgtaatcagggctcactgcagccttgacctaggctgacgcagtccttcagcctcagcctcctgagtagctgggactacaggtgcgagccaccacgcctggctaacttttttttttattattattatttttgatgtaccactttaaaaacaaagtcaaaagaaactactgtagatctcacattggtagagtcaatttgagacccttgcctcggagaccagaacctggtgtaactttctcttaacaaaggttaatagccagtggggggtcagggttggaactcaccgaatctgcatcacatagaatcaggtacctctcacattcacgaaagtgaattatttttaatgaattgtgctgacagtatgcctcttgcaaaaagaactagccctagattcttttctagctatcaagatggaaaacaaccacatcgttaattcagacggaggggtaaaccaagttaatcagactccaagacccatactaattgttgaccaagtaatgccacagtattccatggctaaggatttccagcttgttccagtccctaaaaatctgttctgcacagttaatatttcacaaaaccaaaagggcttagttgcaagcacaaagagctagaaatcaggagacttgtggtttctattgagttctatcattatctgtctaataagataaataagtcacttctctgtaactcagtttccacatttgtgaagtgagggaagagaaacatgtcctaaaaaccatgcaggggctctggaaagaaaaagagctaagaatggtgggttttttataaaagttacacaaatgaatggtttttgtctccgtttttctgaaagtgggttaaaaatagcctccaaataaagctaaaagaatttatttagactaaattgcaccagagaagtagaggaattaagagatatgacaagcaaagatgggatgtttcaatggaagaatctcaggcagtaaaaaggctatgctgtaaaaccagaacttttgttagcactgcatttttaagatgaattggtcatagttaatgtattggatggaagaatttttaaacatctgccccaaagtatgctgcatccaaaaaatatataacaaaacgaattcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggttagcggcgtcgccctctcccccggagctctggggttagttaacctttggccaggcagcgttcctgggcgttcgggacactgcactcggccgaaagggtgcaaacatgttggataagatgcggtttaactctttaaataatttaaatgtgcattggcggaaagctcactctctccttaattgtccccggcctccgggagccacggagagccttaaactggcgggcagagcgagtgcggtgcgtggcttcgcggggagtggtgtccgcccctcccctgtcccgccccgcccccgggactctcccgcaccccgcgacggtggggccaccccacctgggagacgctggcagcggggaagtcagatggcgtatcttttatttaattctcttgtcgggttgcagagaagtggttgaaaccgaggggggacgcggcgcactttacttcgagccttttagggatgactaaggactcatttaactggatgcctgctacttttttgggcttgccaaggtggttttaaatttggctgggagtcccccgagaggtttaaaataacccggcttcaggcagcataggagtctgatcaagtaatggtggttaacttcactcatgagtcctcctgatgagccaggtttcagagctgacttttttttttttttttttttttttttttggccatgtgacttaggtcgcaccctccacccctgaatcgcggtttgcagggaggtgtggtccttgccggaggtcaaggcttggtaatgaatgttgggcggttctggaggcctcagggaatagttcctcccagggagggtgagaggcatggccgtacaaatgaatgtggccagaaagacatctatctgccttttaaaatgggctttggagacttccagggacctgggtcatccaattctgttggttgtgtttaacatgaacggtaaaagttggaaagcattcacatttggacatgctgtcttgaccatcttcggaatggttcttttacaagcgccattcagaggtagcggggcttggtcctctcagataagccttttgcctctgtcttgtgacaccgtgtttgagagggtattgttggagttagttggaaaagtgttgtcattttttggtgtaatacctcgatacttttaagatgaggtcttgggcctgtggtttaaaaatgatacatggaaaaaaatgatacttgattggggttttttgttttgttttgctttcctttttaaaagaaaggccacgtaactgcttctcattccatttcctttggaaacttgttcttgtggaggtggctgctggcaccggaatcagactgaatttcctccatggttaatgcaaaatcaggttctgtttggggtcatcatttaggttgccataaaacagcacgttttaaggcttgtatctgtaaggttgctgaaaggcatgtgcctgtgttgggggatgtgacctttagtgtggctctgggggtgaagtaggggtatattaactggagggtgttactcaccaacagctgttgggcgggcctggctgtgtcagccatgttcccggagttcagttgttcccatcgacacccactgccaccttgagcaaaggcattttctccttcagggagctgcccagtcgtgcagccagggaggcctgcagttcctctgtgagctgccagagtctgtccgactcaggaatagggtttccagcgttctgggccattcggctgagtgatttttctcaggcatttatagaaatggctgcttctgtgtgcgtgcatgcgtgctgctccttaattctccataaggcaagtcattcggctcagctgtttcaggagaacctttttcccagtcaggagtggaaaacgaagtgagatgttcattcagctttaagtgctacagtcagtgctttgaacctagggatgtggtgattgcaggtgcctatgttttggggatctctaatcttagtgcatggttgaacaaaacctcagcctgggttaatattgtcggaagtgtattcctgctagaggaggtatgtgttaaggttactttaaataagagacttggaggtctcatgcatttggaagtttcagatacaacttcaatttaaattgactttagggtagggtaaggagcttttctaattttctttctgctggtgttaaatcaagaaggtgggcagagatggcatttggaatgtctgcattctgtgaagattttaggagctaaactccctgccacacccccttgcttagtgctgctaacattccctcaagaaaccctccagcttgctcacttccttatagagacacatacagctgccacttcatagaccacttctacaccagctttagaagttgaatcattcaaacagattttcttctaattcagtgctgctacttctgtagtgtgctgggaggaacgacacagttgaggccagctaagctgggttctgatttgtcctattgttttctcatttgagaccataaggaagttactttaattcagagtttgcaaactggaggcttgctgctgaatttgctttgcagatttgtttggcttggccaacacagggtttataaaaatttaattagttaccaacatctaaaaatcagaggattatagcatgaatccagatttctggcttgtctggaaaaatcaaaagatctggcaaaactgggcctgaattcttgcctagcaacaattggcttgaactgatcatgatatggggcagtacctcgtattttaatcatttacaggatctcttttggcatttaagtttgcaacctctgctttgtttaagcctcactttcttaatccacaaggtagggctactatcctcaagtcacaggttcttgtgcaaagataacatctataaagcacttggtagggttccacacacagtaaccccttgagaaatgctgggtcctgtggtttgtgtataatgtacagaacgtcaccttaaaaatcaggaaacactggataaacttatttttaagcagtatgttaatttacattttcaaatagtatgttcagtttgtttttcttcaaccagaccagatcttttcaggtgacatacctctaaagtttaagcagtggatccattgttaatctaaagaaaacaaaagatgcaacaaatatactatttttcctgtttccagactttttggacactttatgatgtatttatttgtactgtttcagattaattttagaactattagagtattttatatgaaaatatatcaagcatattatttgaaaatgtaattaacatgaagtttatcctaagtctcctgactttgtggatacctttcacatagagtatgggcagattttggggggcgggtggtaaaggcagtgttataaggaaacaactacattctaattccagctcggaagtcatcagaacaggctgatgttgaatcatgctgggttgatatctggatgacagaaaccttaggccttgtttctgtgccaggtgccatcttattctctttttggaggggcttaagtcagctatcgccaagtggtgacaatgggttgagtttgataacactggttataggattctgaagatcagaaaaccccaaattccaaccatgacaccccagttctatgaaaaaatatttttcagtatatatatatacatatatgtatatatatatacatatacatgtatatgtatacatatatatacatatatgtgtatatatatacatatacatatatatgtatacatatatacatatatgtatatatatacacatatatatacatatatgtgtatatatatacacatatatatacacatatatgtatatatatatacacatatatatatatacatatatgtgtatatatatatacacatatatatatatagtgcaaaaggaggctcacataaaaaaccaggagaggtgggggctacaaaagcccggagtggcggcttctgctccttagcctcttcgaacacattcttgggatccttggcatacttggtgtgagggacctggatagcctccgtagtagaagttgtcctccaatatggaaaacagatttttttggtccctctaggaatgtccatcactagccaactctaacttaggtgggaattttgcttaaaggcatgaggttgccctgagcttcttgcactcttctcccttaattactgtaaaaggttttggagtcaactgtttggtcaaggagagtctgatgtcatcggaggtatcaggaaaaactcacttcattgcctgggaggtggggccttagggacagagcaaggccttgccctagactaaggggccttagctcactgggctgcccattaagtaggccctgcccagcccttaccaccatctcttctcttcatgagtggaacggaagccctgtacctggatccttagggacacattctctctaccccattcttctttccagagggctccccagagtgatgtggaatggcatttcataacccaacttgcttcatccaacatagatgtacaactaggcctgagtggggcttgcacaggtaactgtttctctaccctttttccataattgtcccctccattactgatcctcctgcctcagcctccagagtagctgggattatgggtgtgtgccaccacactcggctaattttttgcatttttagtagagacagggtttcaccatgttggccgggctagtctcgaactcctgacttcaagtgatctgctcacctcggcctcacaaagttctgggattacaggtgtgagccactgcgcctggcctcccccattacattttaattccacagatacacttgagctgtttatggactatgccccattccgaaggcgacaaatcgttgtaatagctaagacttttttcacctgtcacagaaccaatttttgccccctgggagatgatactgcctcaccccactcagcaataggagtgatatcaagtatcctgttagggaagaataacaatctatgcaaaaggctgcatacacatggcttctagctatagaggatgggtttctaaggctgcaagggtttgctatagggtttgtttctgggttttagacaagagggtaaaactcccttgaatcaagtgaaagatgcccagactgttcttcagcccccagcccaagctctctgcagaaatctgaccctggggctggaggctgttaggaccctatagctcttattgctagtcacaaggtaggagccacccagttgcctttctttcctcatttcccatttgtcctgtgtcatcctccatctatctgccctagcaaagacagtcggggggcctctgagaatcttctgctggcaagattacagtttcacgatagaaaacataagtggagtcaaattacagagtacgcacactgtttcccttgattttcctctcacatcttctgtgcgtggtgagaagagagaggggaggggtataagtgggttcctgggtgagagagggaggtaccagagtaaatacagtgccacttggatggtgacaccccattaccttcagacacaaagatgtaagctgagggaaatgaattcttggattcagggaaatgaattcttggattctgaacatgagggtcagatttacattcctgtctcaattgttgacgcttatcccaaggactagtcattctgcaacatctgtgggaaattcccagattgaacttcccagggagaaacatcatatgacatattgggaaaatggctgacaatggttttccttagtaagttcattgagaagaaaagtgggcggatgatttcccagtcttcactctttcagaagcccctaaaacaatctgacatgctctagttggagcctgctttctatcccatcagtttgatttctgaatgccttatgatcattagcattcttcattaaaaaaaaaaaaagctttgtcgcatttgttagtcttgacttccaaatcttccgtgttcttttttttttttctctctctctctctctttccctttggctgttctcaggcttggagaaaaagcttgtagcatgccattccttcctccactgctagaatcctcccccacatccgaccctcccaccttttcctaatgtttctccagcaagcccagcgcccactgaagagcgtaaattagtgcctagtaattggtacaaaggcactttctgtttctatgcaacacacgcagaaaggaggggcaaaaggaagacgaagaaaaaaaccccacagatggttaaaaagggaaagaagtgagatcctctttcagtggtctttgagcaatcctggctctctttctccgccccactttttgttgaaagttagtcacaggcctaggcctaactcagagcacttggtggcagcagttgttagtatcaaaagaatagcacttggaggttggaagtgaccttgggaggtcatcacatccatcattttgtctttaagaaagcacatccccaccctttctcagagagatggggattgttctcttgaaatgttttggggggacttgaagggctttgaagcacaccaccaggtttcaaaagctgcctatctgccttgactagcatgtgagtggtcatactgtgtaatctcccagagcctcaccagctcatgagggtactaggtagttggaagcatttgtcagcagaaaatgctaaagcccctagcttcaagcttggctctgcgggtgcctaggaatttttccttcattttgaattctttgcagtactttcatttgaattctttccccccacttgctctcctgggacttcagtctatggttaacatttttctttttcaccttagtttaaagggctgcttcatggaattaaccaagtgaaagggcagaggtggagtgagctggggtggcctatgccctttttatgggagcagcactctctttaacagcccaaggcagagctgctgagaggtttcctaccactccctacctggaatcgtcctgaaactttaatacctttttgatgcattaaggccacgagtaaacatttgttttatcccagtgtcaagcagtcccctcagcaaataataggactaacattattattcataagaatgtgatcccccctgagggagtgagaagcacccattttttttttaaatacatgggaccttccaaggccattcattgccatgtgtgtccaaagcctttttgatggtgtgcccgaagccttctcttttaatctcagtttctagtgtggtataattgactttggaatcctgagatgagaattgaagaacctggatctgaaatctaaaggttctagagctgagagaaccagtttgctcacgatctaagccagagctgctgctgctgggcctttgaatttgtttattttttaatgaaactgagaatgatcacaaatttgaacaggagaaaggaatctaggagaatttgaacaggagaaaggccaatccttaactggccagattgagtctttttaaaaagtgaggacatttatttaaatagattaaagtaagagacgggagcttaagccatacaaaattagtgacaaggatttgaaatgcagtcagtggtgttatgtattcaatgaagtttgaacatttttccaagctgagcctccgtccttgtggaagggagtatctcccaaagggcctgacttgaaccaaagtgggaaccagtggaataggcaatggtcaaaaacacaaaagtctctcttgggagttttggacattttagaaccgggagcaaaattacagatcatcttggcccaaagaaatagagggagaagaaaatgtttcaccatctctgtcttccagagagctagctttcataagacaggcagttagaaatgaagagtaaggcctgacctatttcatattgaacagtcaaactgaggaactggaatgtgagggggcctttaccttcagtacagagacagtagatagagtcgtcagagcacaggcttttgggtccttctgacatgggtttttgaatcctgtctccaccattctatttatgacaactcaggctctacttaccttctctgagcctcaggtttctcatctgtaaaatggagctcagtaattatatatttatgaagttgttatgaagcttaattcagatgaggtgtttaaatcatttagcacaccattataattaaaaataaagaatttatgtgtgtgttccagaagcccttgattcctagaatttttgtttagaattccagattagtccagcactgcctcattcacttcaattatttattattattattattatgattttgagactgagtctcactctgtcaccgaggctggagtgcagtggcatgaaggatcttggctcactgcaacctctgcactctccccgcctacttccccctaccccctactcaagcaatcctcccacctcagcctcccaagtaactgggaccacagatgcacaccattttttgtagaggctgggtttcactatgttgcccaggctggtctcaaactcctgagctcaaaccatttgcctgcctcagcctcccagagtgttaggattacaggcatgagccactgcacccagccatctcattcacttaaattatttattgagtgacttacatgcaaaaagctgtgtaaaatgctggtaccaggcactttggattttgtggctaatagtgataataatgacaatttctaacatttattatatgtcaggttccaagctaaatggtttacatgcattgtcacatttaaactcacagcaatcctgtgagatagaaaggtgctgttcttctcatttaataggaggaatcagactgggagttagttaacgtagttcaaggttacactggaattttcctagtctgtctctaggtgggtggagttgggcatgaatgcttgctgatctggaccccttgagtttccgccagtgggaagagaccctgtgttttacgtggttctcttgggtttggtcccagagccaccagtcttcagctgtctactcttgttgttctgactctggcttatggttggttttcatgaacctcggttaggagtgtcagcagaaatcttggactctgaccatacctactctgtattttccatagttatccagaagctgcttccttcccattgaaaaataacctggttgtgggcccaaagctgtattagtcaggacaacagaatccaaacagggactggcttaataaaaaaaatgaaactttattggttcaggttacaaacacatctaggggtagctctcatttcggtgtctgtggatacaggcactcagtttctgcctctccatggctcagttttgctgccttttgctacagcctcattcatggggttggtgggggctgtctccaaatagtggtgagatggctgcccgcagttccagactcatatcctgccacttaagcaaaccccaaggaaagacagttttccattcccaaagattccagcaaaagttccaggctttaagctccatgactagttcagattgtgtgccccatccctgaaatgaatcactgtggcacgactgggtcacatccaatctctgggtctggaggtgtggggtcaccctccctggaactacatatatccagaatggggaaggagttgttgccaaaaggaaatttaatgtgttatttattatccagaagggaacaaatgccagacaggcaaaaccaacacccattctctctgtcatcccatttagttagttatttatttttatttgtatttttttgagacaaagtctcgccctgctgcccaggctggagtgcagcagcacaatctcggctcactgcaacctccacctccctggtttaagccattctggtgcctcagcctcccgaatagctgggattacagccacaccccaccatgccaggctaatttttgtatttttagtagagatgggttttcaccaggttggtcaggcttgtcttgaactcctgacctcaggtgatccacccgcctcggcctctcaaagtgttgggattacatgtgtgagccaccatgcccggctatcatcccatttataactaccaacaggattttccaaagaacagagtttgacaaaatgagaggcaaacagtacgatatttttttttctatatatttttcttccttttggtgggaaggagctccgaactatctctggagttcaacccgaaagataggccataagtgaatgtacagaagggtctttgcagaagatagatgattttgacaggtattacatacgcttaggcaaacacccactggccctcctgagtggatgttctagaagccaataataaaagcctcacatggaacaagtataacagcagcagggtgaacttcaaagccattgacttggttttaattccagtctgtccattttaatgtccagagaaacaaatcatgtttacaggaacatttattaccctatatgctaataggtaaaagcctagtctatgcaaagacgagctgtttatatggcagttcccactgggattcagaagtgtattcagtgtgcacaatgcccaagaaaaacactgtaataaatcataagaggcaaaaagtagagcttaaaaacaacttaacaaaaacacataaaagtgacttaactccctgtgctctgtaattctacagtagttttgtaccattaccattttaaggaaaataagcagaatgacaaccaaacagctggctttctctcgtattgtaatccatactcatggccagccccaaaatgcttgttcagtgagcattatcccactgaagcggggggttcccagtgtgaaaaacataggctattttctctaacctgaggcatttctttttctttttcttttctaattgattttattttattttatttttatttatttattttttttgagacagtctcgctctgttgcccaggctggagtgcagtggcatgatctcgctcactgcaacctccgcctcctagattcaagcaattctcctgcctcagcctcctgagtagctgggactacagggacatgccactacacccagctcatttttgtacttttagtagagacggggttttaccatgttggccaggctggtctcaaactcctggcctcatgtgatccacccaccttggcctcccaaagtgctgggattacaggcgtgagccactgcagccagcctaattttttttcttttcttttcttttctttttttttttttttttttgtgaaggagtcttgctctgttgcccagactagagtgcagtggtgcgatctcagctcactgcaccctctgcctcccaggttcatgtgattctcctgcctcagcctcctaagtagctgggattacaggtgcccgccaccacacccagctaatttgtgtatttttagtagttgatagggtttcaccatgttggccaggatggtctcgaacttctgacctgaagtgattcaccggcctcggccttccaaagtgctggattacaggcatgagccaccgcacccagctaatttttgtatttttagtagagacagggtttcactatgttggccaggctggttttcctgagatggggtctcactctgtcacccaggctggagtgcagtggtgcaatcacggcttattgcatcctcatgctccttggctcaagcagtctctcacctaggtctcctgaatagctgggaccacaggcacgcaccaccatgcccagctaatttaaaaaaattttttttttttttttttttggagatgggatctcgctatattgctcaggctggtctcgaactcctggcctcaagtgatcctcctgctccagtctcccaaactgttgggattacaggaatgagtcactaacacccagcctaacccgaggcatttcttcccaaagccctgcttgctcctaaatttcaaaacaccctctagaaatacatgcccaaagaggggactatattccttttctgagatctcagggggagggttgagtggggactgttttgtgaagggtggacagctctgacctgcagttctttgtggtctttggtgccaaacatcaagccatgtgacttagtggctcactccatcccaagagtagaagggttaaaagcttgaaaagctgctggtggcccatgtggcatgtatgagtaggatttatggccactgcagccatactgtggtgtgcatacagtgtgcagaggttgagcccagagggaaaaagctggatggaaacacttgctggagtggcatcacttttcaccatgagtccttatgaatgccacagcctagcaggtagagtacgtgttgactaatcaggcatcagtctctccatttctgctgctgggggacaatctttttcttggcatttcagggtctcagttacttctgcattaaattgtattctcttttggctaaatgtttgcaaaatcagggttctctctctaattcggggtcccttgcctttcctttccctgggagtgatcttctgtttggtgggcatggggctcatctcttgtttcagcctcgtgggagagccatccatgttgcatgctgtcctttgaccttgtggtgatgtccactgagacgtctgtcatgcacttgcctgtgtccccatcctcacaggctgacatcagtggctctgggtgttagatccttgcactgtgacccagtcctcctgtggatttctccaacagcacagttttgggctcaggaacacagtccttttccccaccctgcactttagaagggtgcgcacactgagacccctctcagctgtagctccccaactcctcaggtgttatggcctgtgtggggcttccaagaggaccttatttgtataaggcacttcctctaggcatgtctcgaaggctgtctctacaaggagaataaagacctggatatttcttagagacctctgtgtctctaatacagtcctaccagctctttctctttttctgcccctcatgtcttggttggaagatctggcaaattgagagtttttttaagctcaaggacttaggttttctaaatgctactttgaaaattaaagctcagtggcaacttatttatcctaaactatgtctgatccccctgaggcaatgcatttggaaggaagggcctggaaggcagagaattggaaaaaaaggcactgtgaaaggtcagtctctgtgcttttagtttgagtccaggctcttctttcacatctaatctcattttgtgcataaaactgaaggagcaatttgaaacctggttttaatctggtcacacactattgtgcagggcgtccttgggcacgtcatctgccctctgagttggcttcatctaaaacatgacaggtttgaattccatggtgataaaaatcaccaaaattgcaaagattcaaagaatctgttcttgggatagctttgccattaggcatttatatcttgttcaatatttaatgcctaggtagatatttattatctatgtttcccacaaatagctgaacaaaggcagcatagtctgggatggcaggaattacctagtctgggccagggtctggtctttgaagggctagctatgtggttgtggggaggttgcatcatctttctgggcctttggaggatccctaagatttcatccacctctaaattctgttactctgacttttatgatcttttatcacactacaccaagaggcagatcttcattgtgttaaaaatttatgtttagggtccacattttgcctctgcactatttttagttttcaggcagggccatataactgagacttcaagacagctcttggccaggtgcagtgtctcacggctgtaatcccagcactttgggaggctgagacaggaggatcacttgagcccaggagtttgagaccagcctggactacatagtaagacccctgactatacaaaaaataaacaaaattagttgggtgtggtggcatgcacctgtggtccagctacttgggaagctgaggtgggaggatcacttgagcctgggaggttgaggctgcagtgagccaagatcacgtcactgggtgacagagcaagaccttgcctcacagaaaaaaagaaaaagaaaatgtatagtttttgctgaatcaagaacctaaagaggcaagaatctgttgtcagctgggcacagtggctcatccttataatctcagcactttgggaggccaaggcaggaagatcacctgagctcaggagttcaagaccagcctggccaacatggtgaaaacctgtctctactaaaaatacaaaaattagctgggcatggtggcaggtgcctgttgtaatcccagctacttgggagactgagacacgagaattgcttgaacccgggaggcagaggttgcagtgagccgagatcgtgccactgcactccaacctgggtgacagagcaagactccatctcaaaaaaaaaaaaaaaaattctgttatctgctgtcttttgtttgaggtctgctggaactgcatgtgctgtctcacagatagctgaggttgggaatgtgtgcacgatatttggatatgcttgcttcttagactctgacatgcttaaatgaggaagtgctgcatacagatgtcagagacacacacccacttctcatttcagaacctaaagcataggacaagttgctttctacagataaacacagagatccggaagtaaaatctcacacctaagccctacactgtctctgttgtatcaacaaatacaatataaacggaagccaaatcacaagcaggattcagtgagaggtcagaagcaaatggtagtaatatgatgggatggcattcaggcaggattattctttcaaagcctatttaacatttttattcgttcagaacatctacatgcaaagcaatatttctgataaacaggagacttttgaatgaatgatttttgagttcagtgttcattgaaatgatgtatgcagaaaaatgtggacttctctgtacccaggaatggcctgcacacctcttccgtaatgtgtattggtggttctgcacatgagggtaatggagaatgggaaaaaagcaactgttcatgtttcgtacctgcatgttgacattgctttttggtgaggagagaagccagatggtgatggacaaatggggtgcttgaggcctagggtcagggcaggtctatgtggatgcattccccaccagtctggtccatgaatgctttcttagactcaaatctttgcacttcttcatgatctgactcctctcacctgctttctaacaaggacactcctttgttgggcaaccctactgttactgtttgtgcatttccacctctgaaggaaggttcctgtctgttcttataagagggccatgtccctttcacatatggaaaaagtaggagaggtggaaatagaggagtgagaagacagatgtagtatattcaggaagtttctgactttctccgttttgtttttttttttagtcagagtctcactctgtcacccaggctggagtgcagtggtgcaatctcagctcactgcaacctccacctccagggttcaagcgattctcctgcctcagcctcccgagtagctgggattacaggcatgtgccaccatgcctggctaatttttgtatttttagtagagacagggtttcaccatgttggccaggatggtctcaacctcctcacctcaagcgatccaccccccttggcctcccaaagtgctggattacaggtgtttacaagtgtgagccatcacaccgggccaggaagtttctgactttctgacaattagtttgagaagaagacaaaatgactcttctctctttggtcatggatcacttactgaagtgtcccagtaatttctcaatagaaagtaaatcacctactgccctccacttccatgcccatggaatatattccttttaaaatttttaagagatgaggtttcactatgttgcccatgctggtcttgaactctgggcctcaagcagtcctccctcctcagccttccaaagtgctgggattacaggcataaaccaccatgtctggcctggaatatattcttgatcaagccatttgtggaatggtttaaactcagatgtatcgctgttttctgtaagacttttaaaaaatattaaaataactttttctgactttttctcataaaagaaatttatactcactgtttaaaaaatcagaaaacatagggaaaaattacaaaaggaagtagaagttattctttatctcctcactggtagatagtaattgttcaaattttgtatatattctttttacttaatatttttttaattttaaattgtagtagagatggggtcttactgtgttgcccaagctggtcttgaactcctgacttcaaatagtcctcctgcctcagcctcccaaagtgttaggattacaggcatgaaccacctcagccagcccatattttgtgggcaacaggatttttttctctccatatatattcacacacttatgcagctgatcatacattgttcttctcagttagcagtgtatggctaacatctttccatttcattatataacagtctggtacctttttcacaggtacatattagtcccctgtaaggatatactttatgtattaaaccagccctttatttttgagcatttaagttaccaccttttagctctcataagcaatgctggtatcccttttcatgtctctatctaattattatcaaattaattgccaaaaataatctgcaggagaatattgccagatggccctggattaattataaatcccaccagtgtggtagagggcctgtttcctcatgcctccaccagtggtcggtatgaacagattttttaacgttttcactagcctcacagatatcttgctggtgtcttaattggcatgttttgattacttgtgagattgaatatatttttgtatgaaatattaaatattttcgtatttatttcttggtcattagtattttatttatgtatttatttatttatttattttgaggcagcgtctggctctgttacccagactggagtgcagtgacacaatctcagcttactgcaacctctgtctcactggttcaagtgatcctcccacctgagtagctgggactgtaggtgtgcaccacacagcctggataatatttgcatttttagtagagatgaggtttcgccatgttacccaggctggtctcaaactcctgggctcgagcaatctgcctgcctcgacttcccaaagtgctgagattacaggcatgaaccaccacgtctggccagtatttcttactttataaattatttatttgcatccttgcccacttttattaagttgggctgttcctttttgatttgcaagtcctttctgtgttacagattttaacattttgtcatatgcttcaatttcttttaatttattttgattcttaaatttttctacttatatatatttttaacatgcagaagtttaacatttttacgtattcaaaactatccttcaagtaggattttgcttttggtttcatgtttagaaagtctctattccaggattctaaaaatgctcacctatattttatcgttatggctttattttttacatttacatttatagcccatttggaaatcatttgagtgaaaagtatgaggtagggactaagatttaatttttttcttttacctgacatctaagccacttactgaattaaacattttctgtttcactgatttgaaataccccatttaccatgtacagaatccctatagattcttaaggttattttcagaccctactctgttccactgatttgtcttttcctgtgctgctatctcactatcttaattattacagctttaataatccattttaataactagtattgcaagtgctcacttattatttgttcttccgcaaaattttcttggcaagttgggcatgtttattcttccaaatgaacttcagaaataactttgtcaagttctagaaaaagaaattcttacggtgtgtgttaattccgtagatgaatttgtacagaattgccatattcacaccattgagccttaccatccaaaggcatggcaagcattttgtttgttcattttcttttatattgaggctttatgcatttcttcaccaaggtcctgaacttttattgttaggcttattctgactggttatggctggcatataagaaagccagtgctcttttgtacagttacatctgtgaatgcacctttaatttagattagatttttcagttatcttgaattttttcaaagagaaagttgtgtcaactgcaaataattcttattttataacccccccttcttctcaccatttacttcttattttatctaattgcactcattagtatttcctggaaaatgttaaattatagcaatgggagcgggtgtccatttatgctttgggctagactttagtagttatactacctttattttactgttgaccttgcagaggaaaggtttcagagctgatcttttatactgctgaggaattattttattttcctgaaagcttttattagggatggttgttcaattttatcatatactattttgtacacgataagagtgtgtatatgatattaaatgatactaaatgtgtgtgtgtgtgtgtgtgtgtgtgtatgagctgttaaatgggggaataatatcagtatgatttaataatatcaaattgtcctttttaaaattacatttcttttgtagagttggggtgttactgtgttgcccagattggttttgatctcctgggctcaagcagtcctcccatctcagcctcccaaagtgctgggattacaggcgtgagctaccacagccagcccaaattcttcttttatctatggaatcctagtgctgtttttgcaatcagaaaccactctttttttttttttttttttgagacagggtctcagtctcactctcacccaggctgcagtgcagtggcacaatcatagctcactgcagcctcaacctttgggctcaagcaatcttcccgcctcagcctcccaagtatctgggaccacaggcaagcaccactacgcctggctaatttgttgtatttttggtagagatggggtttcaccacattgcccaggctggtcttgaacttctgtgttcaagtgatccatcttgagcggctgagcattatttttcttctagaagaagtcttgattttctacatctgcaagaaactttaattcttaattggcactgtttgagctctgttctgaaaaggaggcctaaatcccttagatttgttttttaccagattggtttacttttgctagatgcaatggaagcttttgattttgtatttttgactttcctgtctccattaaagttagacccatccctggacttgggtggggcagggaagatgagaagaaccaggtaggaaagagacgacattcagatggcaggcctccctgaccccaggcaggacttcagtggcagcctggacagctcagggagtctggggagggttgcctatgtccagtgagcaagcttggcacttggcaagtacccggtctctgtcttctctatggagaactcacctccattcgtttcaggactgcccacaaaaaaatgggcttcatttggcatcatcaactaatcagcagtcgaggaggctccctctcaaaagcagcaagtgtccttttgtgctaagtaggcaagcacatagccagggggccccagtccactgttcttgcaccctccgtaggcccaggagaattctggaggcctgatgactgtctctgcaaaggaagtcttttacacattgtgcgcagtgttcagtagcttttttgatcacatttattttatactctgagctgagtcagtcagcaagaggtgcttagcttgttactgaaaggggcggggagtggtatataaataatgagaactcagagaaacttgtgctgttaacagctctgctccagtaaagtggagtttattgtgtcactgcctctgggtgtgttttcctgtgaaggccagaaataatgcagtggtacaagtgtgttgggtatttttttccctatccccaggaggatggtaactctctcattaatactaaagacaggtttaaagattctctaattgatagttgcattgctgtgtgatttgttcagcgtgaaggctgaccattctcctttagaccttagcaccgagcctcaaagagagggcctgacttggtttcccccaggctgccagacgaaggtggagtgaccgtctctctaggccagtcctctcctcctctgtagatcatctctggtcccattcagccttaattctgttctcgtctacatgtgacttccccattccatgctttcttaagtgcaaaacatctatcattttctaaataataccttattatatgactgtcattaacttatatgctgggatgttagattcaacatcatggcatgttagatccaaactctccactgtattaaaaaggtgggagatttttcaaagggctacaaattgtaggtccctaagcagaatccagcctgcgtacacaccactgggtggcaccataatttataatgttgaaattgaatgcctctaagtaggggaagcaccctgttcagttcaccatggaatccattatgatccatgattgaatgcacctgctcccaccctgtccccgacctgtgtctggctcctgaagacatttgaatttacaaattctggtggccagttagaagttcaagtcctctgttatttgtttatttacttgagacagggtctcactctgttgcccagactggagtgcagtggcgtgatcttggctcaccacaacctccgcccctcgggttcaagcgattctcatgcctcatccccagtagctgggattataggtgtgcaacgccacacccagcttcaagtcttttgattgagatcaggaatcaaccaactttttgcaaaaggtcctgatagtaaatattttcagctttgcaggctgtacagtctctgtgggcaactgctcaacactgctgttttgagaatgcagctgtagataatacttaaaccaatgagcatggctgtttccaataaaactatatgcagacaaggaaattttaatttcatataactttctcctgtcatgaaatattcttttaatttttttcaaccacttggtaaaaaccgaatataagaatggtataagctattcttagctcatggcaggccagatttggccagtgggatgtggattgctagcccctgatttagatcactgaccaaaaagtttttaaagttttccaaaggatgccagataaatcaaaatgatcccgggccttttatactagcaactcacttccaagcagatcttttttaaatgcgtaaaaatggtaaacttgaattatacaagttacatgagtctaacgaagcttctatttgctcttgattttctcggggctctgtgggtgtccctctctgctctctgtgaaacacttcagggataaggacgctaggtcaatgacagcacttggattagaagcaaggagaaccatcacaaaatgacagctccaaggggcagtcaagagagtatcactgtcagctaggtcgaaagtgaattcagtgggaacaaaccctgattacacttgaaatatatgtaagtcacaagcatagaaacttaatagttctcctattctgatggcttcatgccagttttccatggtcacttctagaaagccatcttcctaacacagcgagagtatcttactccttttccagtcctagcccacagctgaatggtcttctggtccattttccccacagtggacacagatcccccaactaaatgaaccccctcctctcatgactcacttgaaagaaatgagtacacatgccagtgaggaggctaagccacattagcactcctccaagaaaaccacttctaatgagtttttgtcttaacaagcattgagaaaacactgagctcttcctttcattgttttcctcaccgccacatcagaagggagtggagaaagggctccaaaaaggaccgagcagagagggcgttttgttttggtttggtttggctttttgcaacttaaccattctatgagttctgaccccttgttatatttttcatagaacatgtttagaaaaacatttcccccataactgcttcactggggttaaagaggacttcactgcagtctaattctgcaatagctcaggtttctccagtagccagtaatatctgagcagatttcaatgtgagtgaccaggaggaggacgagagagagagagagagagtgtgtgtatgtgtgtgtgtgtgtgtaaagtttgagcatttaccaaatgcttggcaccatgagtaggacaaaagtcatacatgacattatttttgcctcaagaagctcagccttgatggggttgtaacaatctgtattttgacttttgctcaaaagtctgctgaagtgggttaaaatcctgtttatctaatggaagttgcagaagtgtagttttcaactccatgtctttattgagtttttcacgggaaactcttttttttttcctctttgcagccccatccccgagcatcaaaatgcatcaataaccctagctcttatccaccttgagtagggcccagcattcattggtttgctattgccttttgctgccgtagcttttcagctcagagctccataagggtttatacgtagatctgcacatagagaatcaactgctacagattcgttttacccacattgggtttcctcgaaaagtacgttgtacagggtgttgttatgactattgctctgcttagaaaacagcagagagccttcatcatgaatagattatcacaaaggtgatagatttggttgttttatcatatttctgcatctcatcagcacaggttaagagacgctggggaaaacagaatgaataattttggatgactcaaatgcaccacgctggacagctcccagcctctgcagtttctctatgggttctgggaaggccgggacaggagtgagaaaatattcactcctcacacctagccaaggagtgtctggagagttctgcggaaaccaggaggctgtgtgtcctctgtctatgcagcagctattgtcagctgtgcttggaaaggtgtgaagagtaggcagaggcaggctcttgggagccagggcgatggcagtcacttataagtggaacaagtgtggttctcatcttcaacagctcgtctgcttgtctgcctgtgtatgtcctccccaaacacagacatggccttcacctcccctgccttcatcttgtggggtggggagcagcaggaggttatggatgctggcctgataacatctggcaggcaggacttagctgcattttcagtgggacacagacattagtgtgaatccaaggaaagcaatcggaaagagggatgtggaaattgtcaagtccccaggacccccaggagtcaggacagccaagtggccaagagcacgggccttggtagacagggccagttcattactctgctttccagttatgtgaccctgagtacagagtttaaccctccaagtctcagttttctcatctgtgaaatggggcaaccttgtggagtgcttgtgaaaattcagtgagaagggcacgggaagcccttagctttatgcttagaacaatgttagttcatcttttatgaggaatatagaagaaactggaattgtttggaaatgggagaagagattaaagaaagacatatctgtctgcagatatttaaaggattatgatgtggcagaaggaacaaacatttcttttttttttttctttttgagacagagtctcactctgtcgcctaggctagagtgcagtggcatgatcttggctcactgcaaccttcgcttcctgggttcaagcaattctcctgtctcagcctcccaagtagctgggactacaggcgcacgccaccacacccagctaatttttgtatttttagtagaggtggggtttcaccatgttggtcaggctggtctcttaactcctgacctcaggtgatctgcccgcctcagcctcccaaagtgctgggattacaggcgtgagggattacacacctggcacaaacttacttctagtgttaagacaatatgacttaaagtatggcctttgcaggaaggcagattttatatcaataaaagatgtgacagagatgctcaggaacaaccagatgctgagtggcccctgcactcaggagctcagggagaaatgctcgttccaggtaggaggctggttggacccaatgccaattcttttccatcctacaacaccaagaaatttagcaaaaaggctcagcttttttactcttgaaagaatttatgaaaccagcaattgtgtggaataaaacagaaaaaatactttccaggggacccatagggtaccaaatggcaagctcatttgcttagagatgttagcaactttctcattgtattagtttgggctgccataacacacaaccacagactgggtggctgaaacaacagaactttatttcctcacagttctggagactgggagtccaaggtagaggcaggggacgggttcgtttcattggaggcctctctccttggcttgtagatggtggcttcatccctgtcttcccaaggtcttccctagtcttcacatgtctgtgtcctcatctcctcttataaagacaccagtcgtggattaaggcctgccctcatgaacttgtttaacatcagttgcctctttaaaggccttaacttcaaatgcagtcattttctgtggtgctgggggttaaggcttcaacatagggattttggggagggggacacataataatcatctccgagggatttatcctttgagtcgtagggactattgaccatgaccgcccttcggaatttttttcatgttctttgagctgtatcctttctgattcctttctcttaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaattgttctagccattatgtgttgtaaaagggggctatttcaccataatgaaagttacttctttaacctgtgttcgcaggattttgggatgagtgcaaagatgattttaccctgtacctttcaacacatgcaatagttatatagacttgtgtgtatttactattcacagacctctgaggaagtagatgcaatagaggtcacttgaaaccattgtgttatgctggaggggaatatttatattttgggagataaatcactttaagaggcttttagagctcataactgtgcagggtgtactaggaactggtcagagaaagttgtaagctcagattgtgctcttgagatacgatattaataagaacacacaagttgaggtttcattggctcaacagtagaaacataacaccaagcaaagacaagcatcaaagtgtgtgtgtgtgtgtgtgtgtgtgtgagatttatgcagacatgtactagctattatgtattaattaagcttttattgtaaactactcatggcgttgggtgtttaggtttttcacatttaatccttacagcagctcagtacagtagataattattattatgtacatatttctgatgaggaaattgaggattggataacttgccaagaggcacatctaataagtggcacagacagtgtttaaatttggatctgctgaatccaaccctgcatctttgtatgcctgcatcacagcagcaagggatttactggagtgtaccattcatttgacccattttattgagcacacctattcatgccaggcactgttgtcactgtggatacaaaggtgaaaaaatagacaaggaccctatgttcagggagtttctgttagtagagggaaataaatagtaaacagattatccatgtactctcagatagggataagcatagtggcgagaatagaatagggtgatgtgattgtgacttggagggtggggagaggctactacagattgaggaggcagggaaggactccctgagggtcttcacatttaagctgggacctagatgacaagaaggaactagcctcagaaaatgtgtagggagtgtggaaggagtttggcaggaatgtgaccagcgtttggaggaacaggataacagtggggtggctggaatataaactggacaagaagggaagggaagtgctggggtggttggcagggcccagttcacaagggccacgtattgcaggttgtaaaacggtgtttgattttgattctaaggggaggggcaatctgttggaagctttaaagcagaagaatgctacgatcccacttgtatttcagcaagctctttatgagtgccagggaaaatggattttagagggacaagagtggaagctgggagactagccaggagatttctatttgtccaggcaaaagatgatggttttccagacccgaaggttagcagtggaaagaagtgaatagtttcaagaaatacatcagaggcagagtcatttggacttggtgatgttaggatgtcgggggtaaggcataaaaaagtccggtaatgaccctcaagtctatggcctgagcaacaggtagatgttactgcagagtggtgaggatggaggaaagggggaaagaagggggtggatgagggaaagggcatgggttcatctttggacatgttgaggttgcagtgcctgtcaactgggaatgt

SEQ ID NO: 11911 - DNA, 8374 bp, Human
aaagtggaaacggggatcgagaggttagtaaatgctgaagtcacaggtaacaaatagagctgggatacagatgcaggtctcattgactcagaagtccatactcatactctttaatttctccatctctgccagcctgagggacactgtagactatgtaaactggaataaagctgaactcaggctgggtgcagtggtggttcatgcctgtaatcccaatgctttgggaggcccagagttcgagatcagcctgggcaaaacagtgagacccccatctctacaaaaaacaaaaaaattagccaggcatggtggtacacatctgtagtcctagctgctcaggtgagaggattgcttaagcccaggagttttaggctgcagtgaaccatgatcatgccactgcactacagcctgggtaacagagcaagaccctgtgtcttttaaaaaaaaaaacaaaaaagctgaactcttagtctttgctcctttaaggaactcagataattaagctgtaatcactatgttccttttccaacagccctggaagatcattctgagttacataaatgtaggaatatgagtaccaaaaacaaaagtcactggagcttcaaacactagacaacacccccaccccttgtccgttcaaagcttgcacctctggatgctgacataaattcctaatactggcagtagtttactgtccttagaggatcttccatagtctttgaagcttgattaagttgtactatctggatgtaaaaataaatataaattttgtgttatttacactgaaggcactaaaagctagcaagaccaaacaaaaataataaaatcactggagaaaaaattacctgtaagttacctcagcatactttttaaacacccacagtacatttagtaaaataaaacctagtcacactagcttacttcagaataaatatgaatcccaaaggggaaaaataaacattaattgtctggatattttttttttttttttttgagacggagtttgctgtgttgcccaagctggagggcagtggcacgatctcagctcactgcaacctctgcctcccgggttcaagtgattctcctgcctcagcctccctagtagctgggattacaggcgcacaccacatgcccagctaatttttatatttttagtagagatgaggttttgccatgttggccaggctggtcctgaactcctgacctcaggtgatccacccacctcggcctcccaaagtgctgggattacaggcatgagccaccgtgccaggccaattatctggatactttcagatcatatttctgccaactccctgaaatacaagttgtctataaagttatgctatttcatgaactttcacttttttttttttttttttttgagacagagtcttgctctgtcacccaggctggagtgcagtggtgtgatctcagctcactgcaacctccgcctcctgggttcaggcgattctcatgcctcagccacccaagtagctgggattacagatgtgtgccaccacacccagctgatttttatatttttagtagagacagttttaccacgttggccaggcttgtcttgaacgcctgacctcaagtgatccacctgcctcggcctcccaaagtgctgggattacaggcgtgagccaccacgcccaaccaaacattcacgttagaattgttgccttcagagtaagtcacttgccatgctgccgaagtctgtgagatcttttaagctctttttgaagtttgagtatttgcacttgactgaatagtttttagaaatgaaattatatagaaccaatatggtatatacagcagtttcttggcttaatattggttttgatcaactctaaacctaacaaataagtaatttatgtttgtggctccggcttataaactggctttcaagtcctttgccaagaatccatgctaggtgtttgtgctgccttgatcttttagaaaagaactggaaatggcagtcagaaatgctttcacaaatcaggggcattggaataataagggtgtagcttcccaaagtgaccttttcaaggtggaaaacatgcattcttgcacttttacaaaagttacactttattttatattctgaaagttctggattaatgtggtttctgctttcctgtaatacagtaaatcactccatggtagaattcaatttacttacttattttgcagaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctactaaaaatacaaaaaaaaattagctgggtgtggtggcagatgcctgtaatcccagctacttgggaggctgaggcaggagaaccgcttgaacctgggaggcagaggttgcagtgagctgagatcccaccactgcactccagcctgggcgacagtgagactcgtctcaagttaggctgggcacggtggcttacagctgtaatcccagcactttgggaggcccaggcaggcggatcacctaaggtcaggagttcaaaaccagcccggccaacatggtgaaaccctgtctctactaaaaatgcaataattagccaggcgtggtggtgggcacctgtaatcccagctactcgagaggctgaggcagaagaattgctcgaacctgggaggtggaggttgcagtgagccgagatagcaccaatgcactccagcctgggtgacagagcgagactgcatctcaaataaataaattaaaaatataaaaagtttaaaaagcacctgtgacttgagtctatttattttcagttgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggaggtatgatgtcctgtgttcacaaaccatcgatccctggctggtagctgatgctgtatggtagcctagacctggcttctgaataaactctatttctttttgtttttaaagggtcaaattattatgtgaccaaaaaaagaaacaactagaagatctcagttattgtcgagaagagaggtaagtgtcaaaaataagaagaatacaataggtcagtaagactggaaccatattctcaccctaagatgctgagccacattaggtggtttcagcatcaaggggtggacctcaagagtctcttgtgtcttacatcattaggaaaagtctgcgggaaatggctgagcgtttagctgacaaatatgaggaagctaaagaaaaacaagaggatatcatgaacaggtcagtgggctgtataacatttagttacctagtcaggtactaacaacgatatttaagaaaatgggcattggcaggtgcttacatacctacggaactgaactgatccccctgcctctcctctgaagtatatgttggggaaaacatgaggctctcccctaacccttcctatggggcctacttcagaaacaccagattcatgaattatgagcttgtgattatgtttctcctaattagtagagaccttaaattgagatgtttgcttgccttttctaaaggatgaaaaaactacttcacagttttcactctgagctcccagttctctctgatagtgagcgagacatgaagaaagaattacagctgatacctgatcaacttcgacatttgggcaatgccatcaaacaggtaggaatagatccaaactagctaaatttggtaatttttcttaaagcacttattctacagaaaattttacaaaaatgtaaaaagaacagattcaaatagatactgtgaaaatgtgtggcaaaccactgccaaaatatctattattttaatacttaaggttactatgaaaaaggattatcaacagcaaaagatggagaaggtgttgagtcttccaaaacccaccattattctcagtgcctaccagcgaaagtgcattcagtccatcctgaaagaggagtaagtaaatacttccaatcagctattatcgtgagatagtttttcctttacagtatgccagaatcaacctgtcttaatagaaacctgaatcttggtatttgcatgtcaagtaattactgggatgagagccacatgatacatagggacttaagaaatgactatggtgggaggattgaaagggatgaccttctagtaacatgattttgttgtgtggccaaaggtattttacagtaattatgttcaaaaatatttccagtacttgcaccgtttgccaccttaaatgaatagtgaacactattgctatccacctgaaaccttcagctgttaattttagcaaagcagttcttagatgtttcaacattaccagtttaaattcttaagaatccatataaatggtttattataattccaaaagtgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagctcaagatccacaattgcaaaggccactgctggctcacttcctcacaagctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtactactatatctgcttagaaatggctgagtgactgtcaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataaccatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccgctgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatccgctctaactgcacctggagaaacaatggtgagataactacaggtggctcctgcctagattttctgaactttgactggtttagctgagatgtagcagattaactcaccagagtactagtcacttcaaagggagacagcaagaacaattaaaaattttaaaaataattccccaaagctaccgtgtaacggactgggatttttttttgggggggagagttttgctcatcatccaggccagcccaggccagagtgcaatggtgtgatctcggctcactgtagtctccacctcccgggttcaagtgattctcctgtctcagcctcccgagtagctgagattacaggtgcctgccatcaca

SEQ ID NO: 11912 - DNA, 6166 bp, Human
ctgagaatgatgcttagccaactgccagccaggaaagtcccacaaccagacggagctgaattctgccagtgacctgaatgagctggaaagtaaattcagcctcagagctgcaaaaaagattgcagccctgttgacacctggtgattttggcctcatgaaactcagcagagaatgaactgagccgtgttgtgccaaaattctgacctacggaactgtgagataataaatagatattttttaaagtcactaagtgtgtggtaatgtgttaggatagcagtagaaaactaatgcacagacgagttgaaccaacatctgtgtgtgagacttggcccacaggacaagctggtgcattttttactttctagcaactggagcagggtaagggcccaatgttataatatgaagaagaccagcttgcattttctaggtgcttacctcattttaggtgctgtgcacggtactttatgtgcatttcttaccttgttcttcacaacagccctacaaggatttatgcttttattgttattatccctgttttataggtgagggacctgattgaggctcacagaggttagctacctgggcaggtgtcacatggcttattaatggcagggctgggactcaaacccatgtctgtgggacatcatacccaagtctgtgcacataagtgctatacttcacagtgcaccacgaccccaattaaatatgaagctaatatgtttccatatacaaaattgctgatatttaaactcctgctaaacactcacaactaagaatgcctttcatcacataaagccctttaaccttgttttaatgcccttggaatactacaccactaggtgctgagcaaggagaaaaaaaatcaaatttggatggtcaaggaaataggagactcccacgccacccccgccccaccccccaggttctgcaagccaaagctcagagcacactcttacatttctcttcaaatccttggaggtctcacttgctctagattgtgtcaaagattgtgccccttccctgcaccaggcactcaattccaggggtggaagttgtgatggagacatttttataccttggacataaagatcaggagccaaaaggaatatcaggtggaacaaatgctattgcttacattttatctggaggtgggggtgcgggttgatgtgccaatttgctctcagttgcatgtacagaaattgtgacctcaaattcagccaatggaaagtctgagtatgaacattcacattgttcagacatttaacaaatatgaactgagcttccataatgtgatggggtttgcatgagaagctaatgatgcagtaatgaataaggtgagttccatactcatagatcttccaggctccattactccaggctaatgaaggaagcacagaaaagcaagcaatttcaggatagtataataagtgctgtagtggaggaggcactagatgcctagagcaaatatgggagagacgccataccgagattcagaagccagaagtagtgacccttgagctgtggcctcacggataagtaggagttggccaggtacagaggcggcagaggagaatagcccagccccaggggatgtcatgatgtagatctgatctgggagcctacctatgtccataaatacatctggagtataggaggcaaacaggctatcggttgagactgaggtcagaaagcctttctgctagttttttgaagagattgaacttaattataaggggacttggaaaccattgaaagaaaaggctgagcagtggcatggacggatgtgggtgctttagaaggacccctctggtggaagagccaagaattgatggaggggagtgagtggagcacagagactattgggacctgagagaggtggtagggggtagaaaggaagggtggggagatcagggatggggaaaagcagcgggattccagagctatctgaggaggaggggccacggggtttgttcgtctggtggagggagagaagggagcccaggatgacagacagccaggcctgatttggccaaatcatcatgcaaatattattctgggctgacaggcccaagttgcagtcagcagaggcaacacgggcttataatttgccatttgtgaacgtcctgaggactggagaatcagctaggaagcaaatcttccttctgctgcataagacagccaaaagcacctctgaggataggcatctcagggatttcagagcaggtaacgccttttggttgttttgaatatgctgacagaagaacaaaagctttcaggaaaacaaagcccaaccccttaatgaaacaggaaaggatatacagtttcaaatgcttgcttgctttccttgttttctgagaagaaagatgccttgcctgttgaaggtggcagatgcaggttgctctgtgggcctcgggaaggttcactgcagctgtcacctgcccaacccacgtgtcctgaggcactgtgacatcttgacaggtgtcctgactcttggccttgacatgtcctgtcacgcctgcctgtcagctgggactgggcttggggaagagcttgtgggcctggggcctggtagtacttgcttagttaaacatctgtggctgctatttccctgtcacaggctggcaagtcagaactactcagattcacttgcacagcaatggtccttcagtcttctgattatgtggctctgcaacagggagagggagatattcatgagcaagtgtgcaaaatgcatttaatgcctgctaatggtgtacagccatccattgctttggtctgcccagtgtctgtctccctatcttttgataccaggggccaagtttctctggggaattcctttcagtttttgcagttctgggacagttacccttcacccagcactatgtcaatatgggcacatgactcaagccagccaatcagagttcactttccctagacttggtcactcagagggagctatcccttaggccacagtgattggttcagaaatgggcacataatcaaactagaccaatgagtctcagttctgaaattttgagttaagattgcttggaaaaagaactgtttactctatggaaatagaagctggagtgatgaaatttggggtaccgggagcgacagggccatagtgagaagagaaccctacctgaaaatgaagtcagaaggaaaaggaaagtagacaagaatgatggagagagaggcagagacagatccctgaagacatcatttaagatcccgaattcacctgtgcccaaagccagactagtcctgaatgatttagttacaagaactaataaatgcctttttccataagtcagtttgaggccagatgaatagaaattgcatcccttattgagtcctggctcaagtcaatttagcaagcatttgttaagatccacggtgggagctatacctcagagctccagggagcacaggaggtgtgctacaatcacagccattgccagtattgttattattccatttattagacatttcagacactcctcagcactttacacacattatttcatttcaccctttgagcacatcctttaattaaaaattgttatctacactttacagggaaagaaacctagaccagagaagttaagaaatacatccaggggtgggtgcggtggcttacacctgtaatcccaacactttgcgaggccaaggtgggaggattgcttgagcctaggagttgaaggccagcctgggaaacatggcaaaatcctctctctattttcaaaaaatacaaaaattagccgggcatggtggtgtgtgcttgtagtcccagctacttaggaggctgaggtgggagaattacctgagcccaggaagcagagattccagtgagttgagatcatgccactgcattccagcctaggcgacagagtgagaccctgtctcaaaaaagaaagaaaaaaagaaatatgtctaatatagtaataatagtgacagaggatgtgagttatcgtctacacactggcaggcaaaagaggttacttcctcccatctcaaggacttggaagtaagggaaataagactgtacacccaagaaagcaaaatggaatagatcggagtagagatctgccaagttgccttacagagccaggacagcttccagccagccaggctagatctagctgcctgaatgtattgacagcaaaaaaaaaaacaaaatgaaaaagggtatgtcaggagaggtgtcagccaaccatggaggcaaaagcgggggagtgaaagaggaggatcttggggatgcccttcataccactatccaggagatgggtgtcatagccacggagcttcccagtggccaggccatctctagggggagatgagagggaaggtggggccaggaatccagcagtcactctttccatcaaagccaccatcctgctgtggaatagttccccagggcctcttagcctgatgcccttacatgactacttcaaccaacatccctagttttgaggatgccattcttctcttcatcgtgaccccttctactctcttttaaaattatttctaggcctcttcttccctagaggccgttgtctatgggaaggggactgtgcttgccacagttggacattccaggttctgcagtgatagtttcatatcattgtaaattcagctggccttcggagtctaacttggtttcccctgtgacttcctacaagaagagactgagttggtcagaagctaatgaatcttttggtctatacatctttcagagttctccttataagataatcacaaggtctctattttgtaatgctaaggagacaggagctggctactctggaggctgcctttttggagatgtacttcttctgtggcctgacaaggaaggtttcagagcctcccggactcaaggccaggcctgggtgatggcatagctaccatgtaaagtgcattctccaccaggaatggtggctcatgcttgttaatcccaatgctttgtgaggccaaggtgggaggattacttgagccaggagttcaagactagcctgggcaacatagtgagactcccagctctacaaaaaataaaaagtaaaaacaaaacaaaaaaaatagctggaagtgggggtgtactcctgtagtccaagctactcagaaggctgaggcaggaagatcacttgagaccaggagttcaaggctgcatgagctatgattgcaccactgcatttcagcctgggtgacagagtgagactttttcttctaaaaaaaattctttaaatcaaaactcagaaaaataaataaataaataaataaataaagtgcattccatggatatacctgtgccctggatgagaggggccaagcagctttgcagacagaaagaacaccacaaatttaaactggagtcccagcttcattactagctaagtggataagttttccaactctttaaggctcagtttcctcagataaaacatgaagaaaataataggatctgcctcccagagtggctagaagactaaaatggaaaagaaaagaatgcaaagggtttagcagggcacctgacgtggttgcactcattagctgttagtggctctcttcttgctgatatttttgcatcctgggatgaacacacatccctatccacatacttttctatgtatgatctaggcctgagtgttccatacagtgactcagaccctcaggaaggcagggagtcttggagaaagaaggcacctggccttataggtggcctggctgacccagcaactatccatagggtccagtctggaaatgtcaatgagggaaatgggccagggaggcttggttagaggggcatcacaagtcagcttcagccccacatgccataagggaatgcaagctcagtatagccatatctgtgccatttttcaatagaatccaagaatctagatttatttatgatagcaacttatttcaattcttttaaacactctgcaggcccaacaaccagcccaagtgcaggaaacaatcttggggctcctctaattttgatccataatctaagggctgggcagaaatacgtaggagttttctgagtttgggttcctggaagcagactcttctttgtactacatgacaaggatgtagtacaagctgtccttgggggatgtgttcccaggaaacatcaataaggcaatgggaaggcaagccaataaag

SEQ ID NO: 11913 - DNA, 11237 bp, Human
aaggatggttgaactgacccaggtggaaattggagcaggtcaaaactcaatgctgatcagtaacagggtcgcacctgtaaatagccaccgccctccagcctgggcaacacagtgagatcccatctctaaaataaattttaaaaataattaattagaaaaaaaaaccagcctgtaatcccagcactttgggaggccaaggcgggcagatcacctgaggtcaggagttcaagacaagcctggccaacatggcaaaaccccaatctctaccaaaaatacaaaaattagctgggcgtggtggcaggtgcctgtagtcccagctacccaggaggctgaggcaagagaatcgcttgaacctgggaggtggagattgcagtgggccgagatcgcgccacttcactccagcctgggtagcagagtgcgactctgtctcaaaaaaaaaaaaaaagaaagaaaagaaaagaaaaagaaaagaaaagaaaaaaactgggaggcctaagcccattcttggtgtcctcacactcttctgccccatctccttgcacccagtcttcccctgcaatctgtgctccatactagccctcaagccctcaacgtgacctagtatgagaactggattctgtcactctcctgctcataatattttatgccttccctttgcccagaatatcattctccctattgtttttaccaatggaactggtatttcttcaaggacatgatcaaatttgcctacttctatattatcttctaaagcagaattcatctctcttccctcaatatgatgatattgacagggtttgccctcactcactagattgtgagctgctcagggcaggtagcgttttttgtttttgtttttgtttttcttttttgagacagggtcttgctctgtcacccaggccagagtgcaatggtacagtctcagctcactgcagcctcaaccgcctcggctcaaaccatcatcccatttcagcctcctgagtagctgggactacaggcacatgccattacacctggctaatttttttgtatttctagtagagacagggtttggccatgttgcccgggctggtctcgaactcctggactcaagcaatccacccacctcagcctcccaaaatgagggaccgtgtcttattcatttccatgtccctagtccatagcccagtgctggacctatggtagtactaaataaatatttgttgaatgcaatagtaaatagcatttcagggagcaagaactagattaacaaaggtggtaaaaggtttggagaaaaaaataatagtttaatttggctagagtatgagggagagtagtaggagacaagatggaaaggtctcttgggcaaggttttgaaggaagttggaagtcagaagtacacaatgtgcatatcgtggcaggcagtggggagccaatgaaggcttttgagcaggagagtaatgtgttgaaaaataaatataggttaaacctatcagagcccctctgacacatacacttgcttttcattcaagctcaagtttgtctcccacatacccattacttaactcaccctcgggctcccctagcagcctgccctacctctttacctgcttcctggtggagtcagggatgtatacatgagctgctttccctctcagccagaggacatgggggccccagctcccctgcctttccccttctgtgcctggagctgggaagcaggccagggttagctgaggctggctggcaagcagctgggtggtgccagggagagcctgcatagtgccaggtggtgccttgggttccaagctgagtccatggccccgataaccttctgcctgtgcacacacctgcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggtaagtggtcatcaatctccaaatccaggttccaggaggttcatgactcccctcccataccccagcctaggctctgttcactcagggaaggaggggagactgtactccccacagaagcccttccagaggtcccataccaatatccccatccccactctcggaggtagaaagggacagatgtggagagaaaataaaaagggtgcaaaaggagagaggtgagctggatgagatgggagagaagggggaggctggagaagagaaagggatgagaactgcagatgagagaaaaaatgtgcagacagaggaaaaaaataggtggagaaggagagtcagagagtttgaggggaagagaaaaggaaagcttgggaggtgaagtgggtaccagagacaagcaagaagagctggtagaagtcatctcatcttaggctacaatgaggaaattgagacctaggaagaagggacacagcaggtagagaaacgtggcttcttgactcccaagccaggaatttggggaaaggggttggagaccatacaaggcagagggatgagtggggagaagaaagaagggagaaaggaaagatggtgtactcactcatttgggactcaggactgaagtgcccactcactttttttttttttttttttgagacaaactttcacttttgttgcccaggctggagtgcaatggcgcgatctcggctcactgcaacctccacctcccgggttcaagtgattctcctgcctcagcctctagccaagtagctgcgattacaggcatgcgccaccacgcccggctaatttttgtatttttagtagagacggggtttcgccatgttggtcaggctggtctcgaactcctgatctcaggtgatccaaccaccctggcctcccaaagtgctgggattataggcgtgagccacagcgcctggcctgaagcagccactcacttttacagaccctaagacaatgattgcaagctggtaggattgctgtttggcccacccagctgcggtgttgagtttgggtgcggtctcctgtgctttgcacctggcccgcttaaggcatttgttacccgtaatgctcctgtaaggcatctgcgtttgtgacatcgttttggtcgccaggaagggattggggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgaggtgagcgcggagctggccgagaaggggcaaaggagcggggcggagcggggccagagacgtggccctctcctaccctcgtgtccttttcagatccacgtggttcacctcagcaccgcctttgccagagttgacgaggccttggggcgcccgggaggcctggccgtgttggccgcctttctggaggtaccagatcctggacaccccctactccccgctttcccatcccatgctcctcccggactctatcgtggagccagagaccccatcccagcaagctcactcaggcccctggctgacaaactcattcacgcactgtttgttcatttaacacccactgtgaaccaggcaccagcccccaacaaggattctgaagctgtaggtccttgcctctaaggagcccacagccagtgggggaggctgacatgacagacacataggaaggacatagtaaagatggtggtcacagaggaggtgacacttaaagccttcactggtagaaaagaaaaggaggtgttcattgcagaggaaacagaatgtgcaaagactcagaatatggcctatttagggaatggctacatacaccatgattagaggaggccagtaaagggaagggatggtgagatgcctgctaggttcactcactcacttttatttatttatttatttttttgacagtctctctgtcgcccaggctggagtgcagtggtgtgatcttgggtcactgcaacttccgcctcccgggttcaagggattctcctgcctcagcttcctgagtagctggggttacaggtgtgtgccaccatgcccagctaatttttttttgtatttttagtagacagggtttcaccatgttggtcaggctggtctcaaactcctggcctcaagtgatccgcctgactcagcctaccaaagtgctgattacaagtgtgagccaccgtgcccagccacactcactgattctttaatgccagccacacagcacaaagttcagagaaatgcctccatcatagcatgtcaatatgttcatactcttaggttcatgatgttcttaacattaggttcataagcaaaataagaaaaaagaataataaataaaagaagtggcatgtcaggacctcacctgaaaagccaaacacagaatcatgaaggtgaatgcagaggtgacaccaacacaaaggtgtatatatggtttcctgtggggagtatgtacggaggcagcagtgagtgagactgcaaacgtcagaagggcacgggtcactgagagcctagtatcctagtaaagtgggctctctccctctctctccagcttgtcattgaaaaccagtccaccaagcttgttggttcgcacagcaagagtacatagagtttgaaataatacataggattttaagagggagacactgtctctaaaaaaaaaaacaacagcaacaacaaaaagcaacaaccattacaattttatgttccctcagcattctcagagctgaggaatgggagaggactatgggaacccccttcatgttccggccttcagccatggccctggatacatgcactcatctgtcttacaatgtcatcccccaggagggcccggaagaaaacagtgcctatgagcagttgctgtctcgcttggaagaaatcgctgaggaaggtcagtttgttggtctggccactaatctctgtggcctagttcataaagaatcaccctttggagcttcaggtctgaggctggagatgggctccctccagtgcaggagggattgaagcatgagccagcgctcatcttgataataaccatgaagctgacagacacagttacccgcaaacggctgcctacagattgaaaaccaagcaaaaaccgccgggcacggtggctcacgcctgtaatcccagcactttgggaggccaaggcaggtggatcacgaggtcaagagatcaagaccatcctggccaacatggtgaaaccccatctctactaaaaatacgaaaaaatagccaggcgtggtggcgggtgcctgtaatcccagctactcgggaggctgaggcaggagaatggcatgaacccgggaggcagaagttgcagtgagccgagatcgtgccactgcactccagcctgggcaacagagcgagactcttgtctcaaaaaaaaaaaaaaaaaagaaaaccaagcaaaaaccaaaatgagacaaaaaaaacaagaccaaaaaatggtgtttggaattgtcaaggtcaagtctggagagctaaactttttctgagaactgtttatctttaataagcatcaaatattttaactttgtaaatacttttgttggaaatcgttctcttcttagtcactcttgggtcattttaaatctcacttactctactagaccttttaggtttctgctagactaggtagaactctgcctttgcatttcttgtgtctgttttgtatagttatcaatattcatatttatttacaagttattcagatcattttttcttttcttttttttttttttttttttacatctttagtagagacagggtttcaccatattggccaggctgctctcaaactcctgaccttgtgatccaccagcctcggcctcccaaagtgctgggattcattttttctttttaatttgctctgggcttaaacttgtggcccagcactttatgatggtacacagagttaagagtgtagactcagacggtctttcttctttccttctcttccttcctcccttccctcccaccttcccttctctccttcctttctttcttcctctcttgcttcctcaggcctcttccagttgctccaaagccctgtacttttttttgagttacgtcttatgggaagggcctgcacttagtgaagaagtggtctcagagttgagttaccttggcttctgggaggtgaaactgtatccctataccctgaagctttaagggggtgcaatgtagatgagaccccaacatagatcctcttcacaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcaggtgggcctggggtgtgtgtggacacagtgggtgcgggggaaagaggatgtaagatgagatgagaaacaggagaagaaagaaatcaaggctgggctctgtggcttacgcctataatcccaccacgttgggaggctgaggtgggagaatggtttgagcccaggagttcaagacaaggcggggcaacatagtgtgaccccatctctaccaaaaaaaccccaacaaaaccaaaaatagccgggcatggtggtatgtgcctagtcccagctactcaaggaggctgaggtgggaagatcgcttgattccaggagtttgagactgcagtgagctatgatcccaccactgcctaccatctttaggatacatttatttatttataaaagaaatcaagaggctggatggggaatacaggagctggagggtggagccctgaggtgctggttgtgagctggcctgggacccttgtttcctgtcatgccatgaacccacccacactgtccactgacctccctagctccacaccctctctgacaccctgtggggacctggtgactctcggctacagctgaacttccgagcgacgcagcctttgaatgggcgagtgattgaggcctccttccctgctggagtggacagcagtcctcgggctgctgagccaggtacagctttgtctggtttccccccagccagtagtcccttatcctcccatgtgtgtgccagtgtctgtcattggtggtcacagcccgcctctcacatctcctttttctctccagtccagctgaattcctgcctggctgctggtgagtctgcccctcctcttggtcctgatgccaggagactcctcagcaccattcagccccagggctgctcaggaccgcctctgctccctctccttttctgcagaacagaccccaaccccaatattagagaggcagatcatggtggggattcccccattgtccccagaggctaattgattagaatgaagcttgagaaatctcccagcatccctctcgcaaaacaatccccccccctttttttaaagatagggtctcactctgttgcccaggctggggtgttgtggcacgatcatagctcactgcagcctcgaactcctaggctcaggcaatcctttcaccttagcttctcaaagcactgggactgtaggcatgagccactgtgcctggccccaaacggcccttttacttggcttttaggaagcaaaaacggtgcttatcttaccccttctcgtgtatccaccctcatcccttggctggcctcttctggagactgaggcactaggggctgcctgagaactcggggcaggggtggtggagtgcactgaggcaggtgttgaggaactctgcagacccctcttccttcccaaagcagccctctctgctctccatcgcaggtgacatcctagccctggtttttggcctcctttttgctgtcaccagcgtcgcgttccttgtgcagatgagaaggcagcacaggtattacactgaccctttcttcaggcacaagcttcccccacccttgtggagtcacttcatgcaaagcgcatgcaaatgagctgctcctgggccagttttctgattagcctttcctgttgtgtacacacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaatatgtgttagtcacctttgttccccaaatcagaaggatggtatttgaatttcctattactgttattagcacgaatttagtggtaatgcatttattctattacagttcggaggtcagcagtcagatgtcagtagggcttgttcctccttccacacatcactccaatctcttgctcccattgtcacaactcctacctccacatttgacctccttgtctcctcaagaacccttgggattacactgggcctaactagataaccaaggataatcatcccatctcaaaatcttaatcaccaagtttcttcccatgtaagataagaacaatgcacaggattagaacatggacatctttggagaaggggaattattctgcctaccacagatgctatcaggaagaggacagaaatgactgatactgttgggatggctgtgtgtgtgtgtgtgtttgtgtgtgtgtgcagtgtatgtgttgaggggtagggcagacagcagccctaggcttaacatcacactcaggcttttgggttttcaccctgctcaaggaaaatgtgtcacttcttgcagtttttgcttcaggacgtgctgtctggcccagctggctgctggaacagggcggtgctatggatggcagctcctctgcctgtagggcacaaggcccacgatgtcccccagtcctgtcagactccctgcttcacagagcctgttcacagcccctcctcaatgagcccaggccctccatcccagtttcccctgaaaaggaagtcccaatgcagagcaaggacccaggccctgctcattcaggggtccctcaaactccattgccaacaccaaagaaaggattaaagggccttgagaggctagtaacatcagttttattgggttggggtggcaaccatagcctggctgggggtggggctggccctcacaggttgttgagttccagcagggtctggtccaaggtctggtgaatctcgacgttctcctccttggcactggccaaggtctctgtgaggggaagcagcaggtgagggagaagggagacacaagggggagacgtggggaggcagggccaggggaaggtgacatatagacatggagtcggtcaaggaagacacatgcattcacggacctcagggccccatggcagggacaaacagatggactgactaggatgaggggaacaggacggacgtggatgcctcactcaaggccttggggtcatagaggtggggtggggagggctgagtcataaactactttatcctcttctttagaaggtttaaggaagttggagacagaaggtaagacaaagactgcgccaggaaaggaagggccagacagacagacttgaggtagaaaacagacctgctgctgcagtgaaagccccatgttgctgatatccaacatttttccaagctccattccagaccttttgcaaccttcttgcccctgtcctgcacctcaccaccctacttcctttccagtcactctgtttgatcctggaaccccagctaagtgctctgaggtcagggattggcaccagaggcggtcatggtttgatggggccacacgtgcccacatgcagtggtgaatcagagagcgacagccagggagtgcctgtgcagaggggtttcagcgtgggccatggtgttttgtgggtgggctcagtgcaggggctgggggtgtcagtaagtgccagggtgtcaggagtgaaccagtgctccgtggtggcgatagaggtgctctctggagggcaggaaaacagcatggagaccaagttcagaatttattaagcagcaaaggagggtggaaggggataggtaaaggatgaagccagtgccagagtgggtggtgggcatgatgggggctctccctaggctgctcccagcctggctgtgcaatgttggcaatttctgctcctcctgcctgctcccctccccatagagagaatggaaaggagaggagagaagagagctgaggtggccacgctggcgtgg

SEQ ID NO: 11914 - DNA, 61124 bp, Human
taagctcttcatgtgtaccccactgtgctgttctcctattctcagttcatctctttgcatctcaacttggaaggtaagaacttaatcaggatgcactgaacaattggcagaaactcatgtgaatgtaactatcttgtccagttccttaacctgtgctaagtccaggcaggcacctgaagaaaaaaaaaaaaaagcatgaaggaggcttttgcccaaatggcactatacttgggggattctgagtagggctgaaacagcctttgcaaaaattataactgaggaaattatggcagtgacaaagatcagacctaaatgactcagtctttcttctaactttcatgctgtccttattcattcctgggcataggccaaactaaccttagaaaggaattcagtttatggtttgactcagaaacaaaatcaataatagccctttcccgaaaagacccccttcttgcctgggtgccagtctgcctttgtacgattaatctattagttacaacattagaaattatggtttaggggtcctgcggcgtcaggctgcaagagtctgaaccttcccaagttgctgctggggataacatcgctattgtaaaatctaacatcctattttgcagaccctgcactggatggatcagctgacaccactcagaccgtgtgtgatctggctcaaccagttctgcgatcccacccaggaacagaagactgcaagaaaacgttacttcaacccccctgtgatcccatctgcaacctgaccaatcagcactccccaagtcccaagcccctatctgccaaattatctttaaaaactcccagaggcagggtgcagtggttcaacgcctgtaatcccagcactttaggtggatcacgagatcaagagatcaagaccagcctggccaacatggtgaaaccccgtctctactaaaaatacaaaaattagctgggtgtggcggcgcgtgcctgtaatcccagctacccaggaggctgaggcaggagaatcgcttgaacccgtgaggcagaggttgcagtgagccaagaccatgccactgcatttcagcctgggcgacagagggagactccgtctgaacaaacaaacaaacaaacaactcccggaatgcttggggagactgatttgagtactggaatcccagtactttaggaggccaaggtaggtggatcatttgaggtcaggagttccagaccagcctggccaacatggtgaaaccccgtctctactaaaattagaaaaattagccgggtgtggtggtgggcgcctgtaatcccagcactttgggaagccaaggcaggtgaattatctgaggtcgggagtttaaggccagccttaaactggcgaaaccccgcctctactaaaaatacaaaaattatctgggcatggtggcatgtgcctgtaatcccagctactcgggaggctgaggcaggagaatcgcttgaacccgggaggcggaggttgcagtgagccgagatcacgctattgcactccggcctgggcaacagagcgagactccgtctcaaacaaacaaacaaaggaacgaaaacctccggtctccggcacggcaagctctgcgtgaattactttctccattgcaactcccctgtcttgataaatgggctctgtctaagcagcgggcaaggtgaactcgttgggctgttacaggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggtaaagtttccgcctgcttctttcctaacactcctgagcgctcagccgcccctgggctgaaggctcttcaatgataaagtaaaatcattgctgcggggagcagggaaggtgtagtaccaaatagtagattctcaagaaaggatgctccgttttcctttgctgaggttgggtcgggaagcacgttgctttctagtggcgcttggcgcagatttggtgttaaaatgtttgcgtgtactcccgggcaccgccagctctgaagatgtggcttgggaacttgctaaccagggaggagatgcaaagccaagatttaaaacagcgttcccctgatccacgtttagaaagtagagacatgactgtggcattctgattggggtaagcacagagaaaggtttgctgtgcccctgtgcagaacccgcagacagtggtaggcgcttttctttggaggagaggatctttaccattaagtcttacctacaagtcaaagggatgatgcatcccattcttaatcattgtttttctccaggagggctctactatgctgaatgtacgtgtgtgtgcacgtacacacacacacgcacgcgcgcacgcacacaaaccacacacacacacacacacacacacagcatatttctgattgtaattagaacactaaatcccaaaaggctggaggctgagggactgaatggaggctccgtggagtgacaggaggaggtggcagaggggacctgaactgtgggctcacgccgggccagtgagctaacacgtgtacagccaaggctggttcattaatcttttggaataagaaagtgattttggaccgaaagtgattttactggctgaaactagattcttcctggcgaggcagtggtggtgggaaatgtgtcctgctcagcagcataaaagctctgagcctcctctcttggaggtcacagtgcccatggggaagggcaggggagccaggctgtggataactcttaattaaattccagtcaactagctggcatgatgtgcttgatattatctccctcatctggtcagggagaaacagaagcgatgtaacagaagttgggagaaaggagcgatgtaaaagtgaaaatcaagttttaaaaccacaaactttacatgtttccttttacgaaagctgcactgagaccaaagtttccctggaaatctctttagtcctaagttgctccaagaccaaagggagaaacagccattagttggccctctttcctatagctggttgctcctctcactctggggcagctctgcctcccttctctctcttttcctgcccttccctgttctcttccctccctccccttcctttcttccctactttccctgctcttcctcttccctctccctttccctcctccttatctcctctcccaattctccaagttgggactggggaagtttgtagtcaaaactccactttcgcctcactctgaggaaggagactgcctacccctgggtagagcacagcttttattctgtaaattctcatgcagtttccttgggtttttaactgccttagaggacaggtcaaagcaaaaatcactgaggtgtagaatgtcagcatgaacccaaagttggaggtggagaggagttaagctgagtaatggggtcaaagtgtgatctgctctctgcctggtgcatttaaacttccagcattggagaatgttcaagaacaatgtcaggggcccaggagggagcataataatgtgaagtcaagtgtcttctggagaaacccttggaattcttagttgccgtggctttggggggcatttcagtgaattctgcagagcttgccctgcccaaacctggtgtggagagccaggcagtcttgggctacccaggagatggttactcagggaaagttctagcacccagcacaggaagcaggcagggcccaggacctctgatatggatcttggtaaataccattttctctgggcattccctccaggggaacctccctgcccagtaccagctgggtctgcaggttctaacaggtttcaggctgagcctcccaggtttcccagatggaacagataaccttccttgggaaggaaactattcccctccaggaagggcctgctccctcaggatgccactgaggccttggcctggcctcgcttgtggaatcagtttaatccttttaagccttctgttcttacagctagaagtggggaaccagggggtgcaattcctgaataaagcacactttcgtgcgcgtgcacacacacacacgcacacatacacacacttttagagagacttcctgaggtcagagctgagctggggccctgatcctcacccgatgaacccccttgactcaccatcctcacttacaacgccgcttctccccagccctccagctcctgagcccctccagacactgccatttatacccaaagtgccgagtctggagtcccaagccagctcactcacagagaggagggcagggaatgttgctctggaggctgctgcctttcaacaagtccccagtcctatgtcaccaccgcgacctcacagtcccagatgtccactctatgacttttagccctgagctttccagagtgtgatgctgaggcctcatctgaggatgagaactccaacaacagggaaaaccttgattagcgagccctgggagggtagcagaagatgtagggtataaggctatgatttgaatgtgagcaggtacaatgcaaactgctggcaaggcagcagtgctcaggcagcagatgtgtttctagtggcctccaggatcactggagtggcctgtgcctcctcaggggaaaagtaagggtgaactcctctgttatttgtggaattttacatcctgggcctccaactgttctgcctgctaagaggtaatgatctggcttattatatctctaaggtctgggattacatcttaataatgaacctctcacacaaaagactgaagaaaatgtccagaagaggttttatgtcttctatagcttggtttgaaagcaatgctttctttattttttttcattgttgtttcagcaaaggggtgagcagtaaacttgggggtcacatacaagtttggtttccccgtggttctgaatgtctaattactaattcaagggaggttgatcttgggaccctcaactctcaatgcacccatagctggtttcaggggagtctgtggaccttctgaaatgacttgtatataaaactttatgtgtctaagcttagggaaattttttttttgagacagagtctcgctctgtcacccattctggagtgcaatggcacaatctcagctcactgcaacctccgcctcccgggttcaagcaattctcctgcctcagcctccccagcagctgggattacaggcacccgccaccacgcctgcctaatttttgtatttttagtagagacagggtttcaccatgttggccaggctggtctcgaactcctgacctcaggcgatctgcctgtcttggtcttccaaagtgctgggattacaggggtgagccaccgtacccagccagcttagggaaatttttactgggagaggtccataatactcatcggatactccagggggtctggactcctccacttaactactccaaagattgaggagacttgaagattccctaagttcatggcactaatgctaaattaatggtaaatgcggtgggactccttccagtgggaatatgatattggtcaggacacttcaccttggtggactttcatttcctcacctacaaaaggaggagatgggctatgagtgtaagaaagagatctgaactcttctcttccagggtgggatgtcaataaataatgcctaaacataaaacaatcaaggtaaaacaatattagcatgttatatagagatatggagataatagcaaaagaatcattttaaaaagatccaaagtggttgctctagggagcagtacatggttagggaatgtcagggaactgaggtttttgttacacagctttgtagaaccatctgactttctaaaccacgtgcaagtgtaatttgataaaaattaccaattacattggaaaattaaaaacaaaattaattacaaacactgaggcaaagaaatggaacagaataacaaaaaatatgagattaaaccggcttttttttaaaaaaaaagccaagttcactttttaacttttaaaaaacacaatttccttaagtaggaaatgccaggagtgataagtgaccagattgcttgtcacttaagttttactgcaaactaattcccacgagagaaaggggatgtgaggtgcttccccacaagggtacgcttttccatctgtacccttgtgggtcgagaaccacggagaccctgggaaaagttgggaggcagggatttaggagttgcacagtcccctcattggatgagtcacctgagacacacagtgggatgcttctctactcagggtcccttcctcggaggtgaagaggaaggccggcaggcagggtcacaagagcacagctctgcacttgtgaaaaagaccttttttgacataggaacgaagaacatttatgcatgaagagtgtggagtgcgaagtagtgggtgacttttgttctctttctggcagaactttgcctacacattcctactacccctggaattctaactcagatgtgggtagcagcttcctcaaagagaaactttttcccagctgggtgctgtggctcacacctgtaatcccagccctttgggaggctggagtgggcagatcgcttgagcccaggagtttgagatcagcctgggcaacatggtgaaactccatctctgtgaaaaatacaaaaattagccaggtgtggtggtgcgcgcctgtaatcccagctactagggaggctgaggtgggaggattgcttgagcccaggaggttgaggctgcagtgagctgcgatcacaccactgtactccagtgacagagtgagaccctgtctcacaaaaagaaagagaaagagagaaagaaaaagaaaaagaagaaagagagagagcgagagagagagaaaagaaagaaagaaagaaagaaagaaagaaagaaagaaagaaaggaaagaaagagagtgggaggggagagacagagagagagagaaaatgtaaagtgggaaaaagcaagacacagaacactatttccagtatgccaatgtttgtgtgaggagaaagagggagatcaatgcatatgtgtgtgtagccatgccatgaaagggctcccaatcatcagctaacctccttgtctaatggaagcagggaaggtagagtgggaagaagagcttctactgtatataccatttgatggcttttgggttttgagccacatgaaattattgcctattcaggtaataaagtttagcttctctaagatgtctggaaggcacctgctcaagaaccccctcctgcttccatgagcctctgcatgaaccaactgcctgtgctgctgactggagcacagttgccctgagaagctgctgttctgatgcagactcagaaaaagtttcaatttggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggtgcgtgcctgtaatcccagctactcaggaggctgaggcaggagaattgcttgaacccaggaggcagaggttgcagtgagccgagatcgcgccactgcactccagcctgggcaacaagagcaatactccaccttgaaaaaaaaaaaaaagaaaaagaaaaagtttcaatttctgggcatcgacctccttttcaatttcgctcatatcaaaacaaaatctgtagtgttttccattactcatctggttccattgtacttacttactgtgttttgttctttgtaggttccaagtggacttattttggtaagtagagattttaaatacttttttgttgaaaagaaaatagaaatggttgtatttaatgagaaaaacagaaacttcatgctctgtggaggtgattttgaagggtcggaagcacagttcttgtattgtagaaagagagtacaaaggcatctcctaagaacacttcaacttgggttgcatactgcactttctccaagcaggcgagcctgctccaggcacaggactgtgagtcatagtgtccaggcttcagattcctgcaaggatttctaccaaacctccaagatttggaggtaacttgccccacctccggactgcaagggtcctgggcaggagagagcctttctcccttgcaggacacatatcctattataaacaaagaagaaagggctcctctctgaaagtttggctgaggtcccagaacttaagctgtcagtatgtctagaattaacttcttgttgccgtgattgtaagctagcgatggatgaagaggtgttggtcagtgcttagtgaaagagggatgcttgtcttaaatgaagcgagaggagcaccagtgtgcttgttgcctgggctttctgtgggacggtctccaagagcatgttagccccatctggcaggcctgccagagaagcagctggaaatcagcttagctggagagttgcagtgaattagaaattggtcattggctggaatggatgtggcaggccagacacctgagtcccctggccagtgcgggaatgttgataatgtcttgttggggcacagccacagaagatgcacaagatcgattgttttggtagcagaagggtggaactgactcactggcacaggaggcattttaagcaagcagggttgtggccaaagttaaagccacaggatgcaatggctgtgggcggggacaggcgggaagttgattactacagtggaagcaccgtccagagaaagatctgacaccaatttgcataggtcagcctttggaggttcaccagcccaagatgcatagaaaagtcactgaactgaccaaccagctacccacaggccaaggtcccctcagccccagcactgcacggctccgttattgctaacatcccttatgtactgattatgtgcacagcacattgctaagtgggtgggtaatagaagggtaggctgtggtccatagttgggaattacttaaagctcacaattcaaagcagaacataataggtaataataacatcataaacaaatgcttcagagatctgagtgctcaaaggagggcgagtgtgctagggctagatggtcagggaaggcctcctggaggaggagggctttcacctgggccttggaagataaggaggattcggtgagtggggagtgggtgctgttggctaaggtgatgttgagcagaagcaagaaagagcaaggtggtgttcgaggaaagcatgtggagaagggtttatagcggagtcacgggctctaaggtcagagagataggctgggtcaaacaggggaggtgtggagggtcagggcaggcctttcccactttgtcctgctcctggaggggcagggcagggagtaagtctgtgttttaggaagagttacttggtggtaggaggtggagggggaaggatggagggaggcaggaaggtgtttggcctgtggagaaaccccgttccgtgtcttcacatccagtttacagtggtggcagtgagggggaaggccaggccaggataagagaactgacaaagtaagaatcgcagaatctgggccacagggccccttgggcaggttccgtgtgtaggaggtgacaggcatggaaagaaggtggcacttgggttctgggctttattccatatgatccccagtaagccatttcagccccaggacttcactttccccatctgtaacctggaggaggggttgtctagaccagtgtttctcaaactacggcttgggatcacccacatcaggatcacctggaatacttccccaaaatgcagatttctaggccttgggctagacctgggaaagggagggagcctgaaaaacctgtattcttaacgcactccccaagtgattcttagctgcactctatcagagaatcactgacccatggttcccaagacctgtctatccagagagaggaagcttgccccacctcttctgctggcctctcaggtatgatagaaacacagatcacatctctacggggtcctctatccctatctctctgttacagccctcctgggcagaatgagatggcgacagggaacagagacattgtgtgaaggtgtgggaggacaaattttttttttttttttggagtctcattctcacccagggtggagtgcagtggcgtgatcttggctcactgcaacctctgcttcctgggtccaagggattctcctgcctcagcctcccaagtagctgggattacaggggtgtgccatcacgcccggctaatttctgtatttttattagagatggggtttcaccatgatggccaggctggtctcgaactcctgatctcaagtgttctgcccacctcggcctctcaaagtgttgggattacaggtgtgagccaccatgactggctgggaagagaatcttaactgcctcttcatcatgacgtggtgttcgccaagggcgggcttctcagtgcagccacactgacctgtccagaagcatttctccctgaccactagctctggccagccctctgtccctcctaccctgcataattagagcagctctttgctgaggaagcagagggcagagtctaatgatgcatggacatgcatggggtaagcacaaaggcaagtctggtttttattagtgacatgggcatgtgtgatgtggagtcagccctcagaggggacgtgcaggagaggacagatggaagacagctaaggaggcaaactcctcctgaggtcttggctagctcctccttaggtcctggctggcagctggcacctgtgctcagggctgcacaggtagacagagggcccagcataagtgctggagggaaacggcttccaagcaataagggccgcactgaatggggcaagtccaaccaaaggctccgtgctgggcatggtggctcatgtgcagaactcagcttctttgcacgtacactgctgagtcattctccaggggcctcccactgtctggcacacatggtaggacttttagaagtacaaaaaagggagttctacccctacatcctcatagctgagtcaccaggctgactgcatggatggctcctccctggagagaggaggaccatctgactgccaagatggggccagcgccacctctttgagcccctcctagggtgctgaaacagcagctgaatggctgctgggcttagcatggctgaggtggcatcatgagagagaggctggggatgatgtgacatggaccttccccgccggaaatcagtcccgcatcaatcccgctgagcccggcagcttcacttgctgtgaactgaggacagctgcaggtcaggttgtcatgtgagctaaggacaaactccagcctgctaaggtatcagaatatgtgccctgtgggggatgaagatgaccggaaggaggcaggaagggttgtgggcacgttcaggtccttggtgtgggtgctgcagtcagtttttgagcattcatccagctgtttgcttatggtctacacacttttcggtatatatttcatattcaataaaagagttacaaagttccagctggctgggagattcatccttactctgatagcttttttagtccttccccaagaaaaaaccaaaccaaactaaaacaaaacaaaaaacccaaaaacaaaacaaaaaaaaaccctagtgtgttcaaaacaacagagcaaccagaaagaatgactgtattggagctagacccgagagcacatcatgttagctgagaatgggcgtggtgtttcatccctgatgatatcagatattggcttgctgcttcttggatgtgagctggttgagaaatagatgaaaacccctgtttgctcaagatctgcaaagtcttaaacgcgatgggatggcagaagaacatggatgacaagccttcctcctggagggtgcgccaacccctatcacagccccacagggcacccgcgaggccagcccctccatcctgttcaggaaaccttggaaagaaggtggcctggcacgggggtgccaggtggctggctgtggctgtggccgcacatgcttacaggtcagcctgcccagttctctgttgcggcaggccagccctcgtggccctcggctctggcaggactcggtgtgagccgggcagtgctgtgcattccttttgctgcactccttggttcctctcccagataatacattgtccgtcttaaagaatttcctttggaaatcagggggagatcctccactggggcaaacctcattttcatgtccctgaagtcctccaggcccacacctccacccgccttctgtcctgtatctgcggaaatatttattttctgtaatgaactttcttggggctccagacaccctctcagcctcttcccacacagaactagaaatggaacacatgaaaggaggccaggaagcaaactcttgactttctattcttcagcagtgataaaggcactgtgtgacctcacacctgaattgcaatataaaaagcaggctgcagtgagagctcaggggagactcaaaacagcagggagcacctgcaattaatagaccgagggctcttgtctctatcaaagggagggaggcttggccatctcaaaacattccagccacttctcgcgactcccagctgccatcctgaggatgaataaggggcacaaagtactctcaggagagccggaaaaggccagacatgtttttcttttttcttttttttctttttttttttgagatggagtctcgctctgccacccagactggagtgcagtggtgcaatcttggctcactgcaacctccgcctcccaggttcaagcgattctcctgcctcagactcccaagtagctgggattacaggcacccaccaccacgcccggctaatctttgtatttttaatagagacggggtttcaccatgttgaccaggctggtctcgaactcctgacttcaggtgacccacctgccttggcctcccaaagtggtgggattacaggcatgagccaccgtgccccgcccagatatgcttttcctatcttttctttttttcttttttttttttttttgagacagggctttgtcatccaggctggagtgcagtggcacaatcactgctcgctgcagcctccatcacctgggctcaagggattctcctgtctcagcctcccaagtagctaggacgtatgccaccatgccaggctaatttttaaattttttagtagacacaggctacattaccaggctggtcttgaactcctggcctcaaatgagcctcccgcctcggcctcccaaagtgttgggattacaagggtgagccaccgtgcctggcagacatgtttttcataccagcacactgaattcctatccccaaatcccatggatttctgctggggttagaaatccgaccccctatcttgaattaaatctgtgttgtagtttcagttacttctaattgaagttgtgacatctagggtctgtctggatgtggtgtggcccgcctactcatagttacttctcatctttcctgaattgcagaattggggtttgtgcgtatcctggaggcttttggcctgtggctgccaaaatgcctacatttttgtgttcacagctggcctcatcagctgagtaaaaacatagggaagctagcattagttcctaaagacaggcatagtggaacagaggatgaggcagaaaaccaggaggaagaagcggaaactttacagaccccagaaccaggcgacctccatggaaatatctgctaggccactttctgtctggtgcgccttaggaaagtaatgacctctctgagccttggttccttagctacaagatgagaatcatggcatctacaccagtggttctcaaagtgtggtccctgggccagcagcattagcatcacctaagccaaatgcaaattctcagcccatcccaggcctacctcctaaccagaaactctggggggcggggcccagaaatttgttttaacaagtcctccaggtgattctgctgctcactcaagtttgagaatcccagctgtgcttcagagggttgtggtaaggatcaaataagataacacatggagagaggctcacacagggcctagcacatacaaagctaactgtagtttctttctctttgcctcgcagagctatggtgcagattaaatgaactaatatggagggaaaggccttgtaaactctacagcaccaaacgcatgagagctctatttttgttaggaagggttctgcttcttcacacttttctgaattgtgagtttttacagccaggaaatactccttttatattttcaataaacaaagggtatttcctttttgagtaagaaaggaatttaaaaaacacaaggactgcaagctctcgtcccaagggcctcacaggccagaatgtcctttctagcctggttcttcagaccaaggtgaagtcaggtctcatctccctggtgctttcctggcatccaggaaccagatatctggttccataaccatggcctcctcagccaagcccctgaagtctcccagagagcaggcaaattctctggttccctgtctagcccatgggggctgagcctagtttggggttcaggagtggaggcctgagcctaggaagaaacttggggctgagctatttgggattgacaccagcctagcctcatgcagcgcccttttcccactggggcagcatcaagccttggaaccgcaggtgcagcgggctggcaggtgaggaggaaggacgagctgtggggctgtcctgccagggcctttcaggcctctggctgtgctccgacttgacccttctgctacctgctggtcttgagccccgggcattcaggtgagggcagggcatggcttctgcaagagctggccagagcttttggcaacgcatccccttaagaagaggagccagtgtgctgccctgtgaacctgctcaaaataaatctttcaagcaaaaaggctgaattcaaagcatgagtgggaaggtggctgcgggcaggagggagaaagtcctggttctccttgaggaagagaataggtcagagaatgtttcctcgggatcctgcagtctcagaaggagcaggggcctccttcctggcctgttactctcttccttcgcaggggcaactgctgggcgaagggtgcaggcaccacggtggagcgcaggcaccatggccagtctcttccaggggccacaccaccaggccaagaaagagagatagcacctgctacagtcaaaggtcctattttattggtcctaagatgtccactttccccacattttagcatctctgaaattgggatatatcttgttatcagttgcattgagaagcaatgaaataggatagctattccacgaatacagagaagcaccatgttagatgctaagaacacacagaaaggggctgaaacgattaatttcaacaatactgaaaacagtggaggcaaaacggtataaaaataacggccattatgcacctggtctgacacagcacgtaagtatgatggggaatcatgtcagatcttgaactatagctttttccaacttgcagttaattcacagttcacgtatactttttggtgatgttgggtcgttctcacaagtatgtaaaaacaaagtaatttaggcactagtttttttagtttatgtaagtattcatttaaggagaaaactttccaattacctgacaagcgttcaatttatgccaaccaggaagaaacaaatactagctgccacctccttgagtctataaacattgactcagagctggtgtaactccaaatacgtagatcacttagctcattttaacttttaaacaattttgcaattattaactcgtgactaggtcagctatggtgtgaaatggatgcaacccatccagttctcagaaagatacctgcagattcagggcaagtggcacatgctgccccctccttctaggacacagggctctgcaaagtctcctaggtaatgatgacagtgagatttccttatgtaaggtcatgctggcattggcaagtggggcctggtgccttcccagggtggctcctcattggcacaccacttttctggaaactctatcagaaatggagaaaggagaaaagatggaactctcaatgtcgtggaagaaagttttgaagcaagtatgaggcagtgtttactgttgactcttttggctttggtcaccaggaagcccagaggaaaattgatgtctccaacttgagcaaatgtctattcttctatgacctgcaaatctaaagaagccatgctggctgggtgcggtggctcacagctgtaatcccagcaccttgggaggccgaggcgggtggatcacttgaggtcaggagtttgagaccagcctggccaacatggtgaaaccctatctctactaaaaatacaaaaattagccaggcattgtggcatgtgccggtagtctcagctacttgggaagctgaggcaggagaatcgctggaacctaggaggcagaggctgcagtgagccaagatcataccactgcactccagtctgggcgacaaagcaagagtccatctcaaaaaataaaataaaataaataaataagccaccttagtgttacccttctagcttggggatcttatttcctgatcctgagccaaaaccttgtaacagatttctggattttcatctagaaagagccttagtctagtggtaccctacattttcaccactgttttattctgccttcccccaccacatgggtaccatgatttaaacagtttttaaacatatttatatagtaatgaagtagtttaaaatttcccacttgttattaatcaaaggcagatgtaaaaaccaaccaaagttttcaacttgcctgagataaatggttcacattcattccacaaatattcactgagtgaagactaagtgccaaatattggactaaagaaacggataagtattggtactcaggaaatggttgacaaggcttggtccctaccattatgagactaagaatctggaggacagagcaattaagcggggccttacagtacagaggagagagacctcactcagtattttggaggaaaggattaaagaaggcttcctgggggaggtgatgtccaagatgagacctgaaggacacataagagcaagccaggcaaagggcaggggatggagggcctctgggacaaagggacagcctgtgcaaagaaggaagctgctatgttctggagattcctgaggacctcagtgatgagggaaggggcttggggccagagtgtgaagagctgagccaggccaaagagccaggacctcgttctagacacagcagggaactgcaggacatgcttttttttttttttttttttttgagatagtctcgctctgtcacccaggctggagtgcaggggtgcaatctcagttcactgcaaccactgcctcccagtttccagcaattctcatgcctcagcctcccaagtagctgggactacaggcacacgccatcacgcccagctaattttttgtatttttagtagagatgggggtgtcaccatgttggccaggctggtctcaaactcctgacctcaagtgatctccccgccttgccctcccaaagtgctgagattatagtcatgagccactggacctggcccactgctggaccttctaagtagaacactgacaaactgggattagcattttaggagaatcatcccagctgcagggtggagaatggattgagtgtgaaaccccagaggaagggagaccagagggatgtaggggaaagggagaggatctggaccaagggaggagaaatgggggtcctgaccttttgatataattgggccagaaatgtagatacccaacattgcaattgcctggagcagcctgattgtggctgaaagcccgtctctgctgggcttcacaaagtattcaaataggtgcccagacagccgttattgcttaggtgggccccaggcaggggaggggaagctcatgtcaccaaaccctgcccctgtttacaactgaagccaggaaagctcaaaactgtcaggtggctccagcagcctgaggagcagagtcagaacttgggcctcttaactccctcccggtgctctttcccagtccattggtggatgctcgttttatgccaggcactgtgtgccctgcactacacctcatgccgttgaggaaatgcagggattttttttgaagagtaaatagtgtagatttgccaggaattatgccaagttcacttgcttttcttccccccatcaggatcaaaggcttagcagttaaagaaaacacaatagacttaatacctattgacataaataaatattttacactgttcgttgtgacatgctcatgggaaatgtggatcaaagaccagtgtgtccggatgaggtggcttatgcctgtaatcccagaactctgggaggctgaggtgggaggatcacttgagtctaggaggttgaggctgcagtgaactgtgattgtgccactgcactcagccccagcaacagagagagaccctgtcgcaacacaaacaaacaaacacacacacaccagtgcagttgctaggaagacaaaatagaatccagtcattgctgtcagcagcacagggctgaaagaggtgcaggagttcctccaggaacaatcttgaaacagtgccctcaggaacacatctttggaagaggttgggcagtggagggagtgcggtgattagcactggacaggaccacattggaagagggaacacagaggacaggccatgcacagtgaagaggcatatgccagaaatgtgcctggacgatgggccagggctgcagggcctgggcagcaagccgtgattcagtgagcagatatcatatgagaacggcacactgcgaggcaagagcccaggctgcaaagactgattgaagaggagcgcccacatcccccaatctgtgttcatctgcgtatttgtgttcttagatgtgtctgtactcacacatactcccagctgcatctcctgtacagtttaactgggacccagcctctcagctggtttctgagttactcacatgtgcatttatagctccctgcttggaaccgtgcttaggtgaaatcttaaagagactccttgtggcagtttcctaagagtcccactgtttttttttttttttttttttttctagtgacggggtttcactgtttcactgtgttgcccaggtgggtctcaaactcctgggctcaagtgatctacctgccttggcctcccaaagtgctctaagattgtgagccatcgcacctagccaagtctcctcaccgcccccccactttttttttgagacagagttttactcttgttgcccaggctggcacgatctctgctcactgcaacctccgcctccagggttcaagcgattctcctaccttagcctcctgagtacctgggattacaggcatgcgccaccacgcccggctaattttgtatttttagtagagatggggtttctccatgttggtcaggctggtctcgaactcccgacctcaggtgatccgccctcctcggcctcccaaagtgccaggattacaggcgtgagccaccgcatccggccaagtctcccactcttgataagccttttagtggaatgcttaacttgtacatcagcaaggatgaagcagggagcgacccatcccttggtcagactgcatctgcacagatgccctgtcagaaaacttgttatgccctggtaaaaagttaagaattataggcatcaactgtttcctgccacataactgtcccatgatggcatgggtacttcttgggttaataatcaggtgttggctttcctgcaaaggctgattatcacttgtcaaattatcactgctgaattgtttaatcaatggtggcttttgagcttgagcctgctgcatgcacagcagtgttctaggacttccaagaggaacagagggtgaccaaggagccatttttaccctcaagaagagttatctagaaggagggtgtgtctgcacagcttaggggtcagcgtccccacagcagctgcataggcagatagatgcacatagcctggcccaggggaggtgctcaggaaacacttgttgatgattgaggaaagaatgggttatttctctattaatttttggctctgggactcagggaaggcaccagagagaaggtgacattgatctgggatggtcggatttcagaggtgaaactggcctgaaaggaaatgccacatcaccatgtgcatctcattagaagtaaaaggagacatgtaggaaaccttagatttgtttttggtgaagtgaaagagagaagttgctctaaaaggttggaaaccagcccctaagaaaaaaagaaagaactgagacaaatcaactcaggagggcctgggacccagcgtgcgtaagagtctaccttgtctagacatggctcttacgcagtgattcctcacagcacagcacccggtgagataggtactgccacttccattttgtaagtgaagcccagagaagcaaagaaatgtgccctaggtcacatagctagtcggtggcagagctgtgattggcaggttggtcgaatgcctccaaagccctcgaccttcccactatacttcacgcatctctagagaagagacagaagtagccaggatgaaggtcttcaggtttaagaagaactatgaaaaagcaaaagatttttgttttcgtggtttttttactataaaggaaaactttaaataatagcaagagtgctataggtaagatatcagaaagaacatccttattgtgaaagctgttacgtgaaacattgagccagcatcaggtcaacgtccagcggccaatcttcactttagttcaggcttcatcctggggaacttcaggaagtttctgtcttttatcagatcccctctttgggtaatttccagactccccagggattgttcacaaagtcacaaatggctagttctccactccctccagctctggaccattgcccagggcttatctgctggtcacgtctcaccacctcatagccgttgctactgcctgggctctggtccctccaaagagcattgagaagctgctgtcgtggaagatgtgaactgtcatggttcagagctcaggcttgctactcactggcagtgtgactttggtcatattagtcaatccttctgtgcctgggttcctttgtctattaaaaggaacacagtgtctatatcatagcattgttattcagattgcagtaattaacacatgttaagcttacagaatggcagttgacaaactgtggcccatgggtcaagtccagcccaacacctgttttataaataaatttctttggaacacagctacattcatttgtttgcatattctctgtgactgcttttgggctacaatagcagagctggtagtgacagaaaccacagggcccgcaaagcttcaaaaacttactctctggccttttgcagaaaaagttagccaacccctgatatagaatgatgcctggcacatagaaagtgctcattaaatggtagcttaaacaaagaaaagggaaagaagcctcactagttcttgagtttaacaaaatttgaatgaggtcctatgatgaatgcttagacaatgacaacctaaaaggaacatctaacacagctgtttgtgtgatcagtgctccctgagggtggtgatctcttcctgcctcctcaatgccaggaggtgctgccatcatgctgtgtcccatggactggagtccctcctgactgtgttctcccaccactctttcctgccccagagaacgactgacagggagagcagccaactccatcaagatcaacctccgctgtggggcatgctctggttcctctttcctcacggccctgaggggacaattacaatagtccagtctcgaccttccagtctcttccctgtggatattttgggcaggataactctctgttgtgcaggactgtcctgcacattgcaggatccttagcagattccctggcctctgcccactagatgctagtagcacccccccaagttgtgacagctgaaaatgtcttcagacattgccaatgtcccctgaagggcaaaatcgccccagttgaaaatcactggcttagtctaaaataacatcacaggtggggcaacagcaacccggtctaggatggcttaacttcatcctttgaaaaacagtgttctttgcaaaggcacaaactgctaaagatgcctccagtttgtattattgtatcattaaacagagcatctcacctcgaagcagcagcatctggactgctccgttgggggctacacttccactgggcagctccctgcctcacatctgtgtaggtaagagggtctatcaaagagctaccttccacagcccagagacggcctgccccagagtgtggaagatgcttatgaatccccccacccctggccccatgctagctttccagcttcactgtatttacatccgatgccacctcaagtgtcaggaagaaactgttgacagctttaaaataatagtttattcaccgattcgcttattctcccctccagtctttaatgaatccctttgtgggctggtcacagggaaccagagacagagcccttaccttcaatgggctggtaggtgagggggaggtagacatataagcaggtaattacaatgaagcacactaagtgctatgatgacgtgtgctggtgttgtggaacacagaggggacaaataacctcaattcgggggcatgtgcgtctgtcagcaaaggcttgcctgaggagctaattctggaaacacacaggagttagcagggcaaggagaatatgtgagtatttatgtgcatgggtggtgagtgttttagggatgaggatggcatcccattgcaggcaacagaggccctaaaaagcaggcgagagcacgtggcacaattagagactcagtagcctaatgtttgaggggtagtgttgggagacagttctccatgggtctttcatgtttcagcatatctgtgaacagagacactagacaggttttgttccagacttgcttttaaaggacgtttatgtaacaaacagtcttagatgatagtgacaatatctccctgcagggcaaagagtgatttatttgctgtcagcataataaagatcacgtctcctttcagaggtaaatgttggacaggtttgctagccgccccctttaaaagaatgaggtttcccaagccttgagttcctcagccaatgatgctgagcagtttgcatatgccagtgtcacttggtccacatatcattctgtggaactggggctggggaaacaggtgcaaacgttactctggctactgctgtgagtattaaactgtcccttgtctctgacccaggcatctcatgtcttctgccgatatccatgaaactggcagactaacttgttaacttgcaagcaggataaaagctctgaccctccacacttttggacaggtgatgagtggggaaagcaaagcctggagaagtgagtgggattgtgaaggtcttgtgtgctacatgacagagcttgatatttatctcaaggagccactgaagaactttcagcagagaactgtctggatctggtgtgcactgttgtggagagtggagagctggagggtgagcctggagaaacacggccaatgaggggtacagctgtggggcaagtggtctgaacaagggctgtgccagttgggagagtggcggtcaagtttaaaacaaacttcatactatccttgatagcattttttttctgatccaggattcaatccagatagcatttatctgtggtatctctttagaccttttatgcccttgacatttctgaagcatgtagaacggaccttgtagcatatagcatatagatcttagagaatgtccctcgatttttatttgtctgagggtttctcatgacgggagtgaggttgcatgtgtatatatatttgtgtgtgtgtatgtgtgtgtgtgtgtacatatatatggttagggttaaggtacatatacacagtagagggtgtgagagaaagcaagtgtgcaaaatgttaacaactggtgattctaggtgatggctggaagtgagggttgaaggagaggagaggaacgagtcagttgtgatcgccaggcatttggtgtggtggctggtattaccagctgacatagagggttggggggagctttggagggaggaagggggaggaaaagatggtgagtttggttatttttaaaaatgatttgctagcctgagtccccttccagccacatctggttttaggatcccatggattatccaaagggggtagccagcaggcaggtggtctggagctcagaggaaaactgggcaggggcagagctggtgttgaagccatgggaggggacagcttcaccccaggggagtgtgtctgtaagaaggagaaggggccaacaacaaaaccaccgtgacagctgacattgaggggcaagtggccacagagatctgagaaagggcagggaaacgggaggacaattcaacaaagcagtgtccccagaaacagagggttcagaaatcaggagtggggggttagtgccaccagggtcaagggctgcatgaagtgcgagggccgaagagtctgtgtggactcagtgggacatgggcgtggaagagcagggaggtctgaatgggaagtaaagacacagatgcgggtatgcacacagttctttgaagatgctcggccgaggagacaagagtaatcaggtcaggggcaaaaaggggtactcgcctgaggaagtaaacattggatgtccacagctcagagttagttcaaggtcacattcaaattagataccccgatttcccccggcctgctgtctaaatgccaaatcaagtcatggcttctcacctaccgcttcacactcttcacaaagatgagtgctgggaaggcggatggggagagggagcatttttttgtcagccaggggagacagctgtaccagtgatgaaaagcacctgtgacattttcaagtctctctctgccaggaaaggagcctgtcacaaaagcagcctctgcccacagtattcgctctcccactggtttcccgtgagtgccggggaacattgctacatcaccctgtgtggaatatggctttatgatcatgatcatttgaagttttctcttttcactcaagagcttgtcacaaataatagccttgttgaccccaggccctcattttctggaaaccaggctgtattttctccatcttcctttccttccagctgccttgcagcactctgcacagcttattttctaaaactcaaacaggagaaacaccaacattttatttcggtcaataactattttacacaagagaatccatagcaatttaactagagtcaaatatttaaactacaataaaatgcagtcctatgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtatgaggtttcctttggaatattgaaatgttctggatctaagtaggggtaatggttgcacaacatcgtgaatatactaaattttactaatggtagttttatgctctatgtattttaccacaacaaaaaattaatttaaaaaaaaagaaagaaagaaagcaacttcaccctgagaccagagagaaaaaggccctgactctgctcacaagaaccacaaggccttcagtgtgatgagggtttcacagcagctcttccctactttggctgcccatgagaatcatgtgagcagttttttaaagcacctcccacctcaacaccaagaccaattaatcctgatctcagggactggggctgggagcaaaatcaggagctcttggagattccactatgtagccatggttgagaaatatggctctgggctggggattctccaaatgtggttcctggacccagcagcagcagcatcacctgggaatgtgttagaaatgcagatgctagggctccgtccgtgaagtactgaatcagaaactctgagggtgtggcccagcagtctgtgtgggaacaagccctctaggagattctgattgtgcactcaagttctggcaaccactattcaagtctaggccaagtaaactacagagtttttctcaaccagtgagtattcattgagcatctgccatacgtttggttccataaagggtgccgtgaaaataaaaagacctatcccagctcctctcaagcatctggtgggttagattcttggaaaagaaatggtacattaaaatgagatcagcctttttacggctaaacaatattccattgtatgtctgtgccacattttgtttatccatgcatctgttgatggacaattgacttatttccaccttttgactaatataaataatgctgctatgaacacaggtgtacaggtatctctttgaatccctgcttttaatactttgggatctatatctaggattagaattactggatcaggccaggcgtgttggctcacacctgtaatcccagcactttgggaggccaaggtgggtggatcacttgaagtcaggagatcgagactggtgaaaccccatttctattaaaaatacaaaaattagctgggtgtggtgatgtgcatctgtaatcccagctacgtgagaggctgaggcacgagaatcgcttgaacccaggaggcagaggttgcagtgagctgagatcacgccactgcattccagcttgggcaacagagcgagagactctgtctcaaaaaaaaaaaagaattgctggattatatggtaattctatcttaacgttttaaggcaccgccaaactatttgatgttcccaccaacaataaatgtttgagataatgaaaaagctctgttatgtatattttactacaatttttaattttttatttgagatgctctgtcacccaggccggagtgcagtggcgcaatctcagcttacggcaacctccatctcctggatttaagcgattctcctgcctcagcctcccgagtagctgggactacaggcgtatgccaccatgcccagctattttttgtatttttagtacagacggggtttcaccatgttggccaggctggtctccaactcctggcctcaggtgatctgccctccttggcctcccaaagtgctgggattacaggcgtgagccaccgtgcccggccgacaatttttaaaaagagattaagccatgaaaacatggttagaaacatgaccatgtttctgatggtcaacactgaataaaaattacttcaaacaccatatttaatcatgtaaatgttatgcatataacagtgcatgaaaaagacggtatctgtagtcctttctgttcagagatggttaccagtcgttgcctgagcctggagccccctatttgaatattatgtttaagaaagacagagcaggatgtcttgcgagggcggtggctacagggctgtggacttaacactttcacatctagcacgattcctcacatgaatgggccaaggaagatgaaggaggataacatgtggtgagcactgatggggggctcaggcctggctagttttcatgataggggttaggttgttagcatgtcagcagtttgtttaacttagtggtttgctgttgtttgttgcttagttcgagagctgtttgttgaacacttcagtgtgccaggctctgcagcaggagccaggtgtacacgcatgcagaaagcgagctgacagtctagtgcagcgcttctcagcctcagcccgcagcagcatcgcctggcagccttgtccaacggcagatgctgggcgccacccccagagtgtccggttcggtaggcctggggtggggcccgagactctgcattttgaatgagttcctaggcggtgatgataatgcttgtctggagccacgctttgagaaccactggactactggggtggaaaggcagacaatattgctttgatcagtgtggctgctgcaaggaagagaaatgcaaaggctgtataggagcacagaagagggggaaaccctttgccctgccccagcgaggggagggtgtttcagggagatgtgaagcagcttggtgtgtctgcaggatgcaagcagctcagcgctgctggaacgaaaaggaggggtgggagcagacacagaaaagtccagagagaggtgggcagagcctctccacgatgaacatactctaaggtcacaggtcatgagaacctaagaggaggttagaaatggagaagcaaaagcaaacagatcgtcaccctttacctttggcagcctggaaaccccacccgcctccctgtaataaacctcatctccagaaggaacctgatgcaggccttgacaccagtgtgtaaatgactgcggagcctttttgtccccgcctcatcccccacccagcaatattagacggggattattggcggggtggaggagaaggacttcctgagggtgggtggagggctgagctggcagccccagccttatggttcacctcttctggcctccagcctgcactcctggcccccaccaccatggctggatgggaaatgattcccatctctctctgtgttaatacatccatcagtcctgcccctgtgactagagccacagagaacacagctaagccacaagactcagagggaacagcagccttcatgtcccctctaaatccatctggaaatcagacatcctcaggatggtgtctgcatgtagaagccactttttttgttgtttagagatggggtcttgctatgttgcccaggcttgtctcaaactcctgggctcaactgatcctcctgcctccccaagaggagatttggggggatttaccaagcccaagtctcaaccctccgtctccagctgacccaaacaaaaattagacaaaagtttgatgcaaagtatggattaaagcatctttagaaaatgtgtttatttttattgatctataatgtaaaatccaagaaaaagagttggcctgctatggcaagtccagctttgagctttattcataacaagtaaccctccccttctagccctccctcactgtcccgggaccacctctgattcagtggtgatactgacaaaggaaaactctaacgctagtttgattcctcgccctctgtttgtacataataacatcataagacctcatccatcaattattaacccatgtccttggtcacctcctttccttctgggcaggacattggggtttatgactgtgcctctccgcctacccagcaggaaaacaggtagaattcagcaggttgtggccttctgtgcggtgggtcaacctcttaccaaggtgatgctgtgggaaccacactactgactggctgaacccactgggtttttatgagaagacatagatattttaatcagcttcagaagtgaactgcaggacctataaatatattttaaacatgtttttaaaatgtagcttctaggctgggtgcagtggctcacatctataatcccagcactttgggaggctgaggcaggaggatcatttcagcccaggagtctgagaccagcctgggcaatatagcaagaccccatctctttaaaaaaatggcttttacatgcagacaccatcctgaggatgtctggtttccagatggatttagaggggacatgaagtctgcggtcccctctgagtcctgtggcttagctgtgttctctgtggctctagccacaagagcgggactgttggatgacccccagagagaggcaggtactagcctcccaacaggaagacctttctaacagatggaggaatgtacacaagcaggtgtcaaatgatcctagctcagccttggcacagggcaggacccagacctggcaaagggaggccggatggatcccagactctttctgagtcaatgcatcacacatccctagaatataccagcctctccactgcagcagggcctctgagcttgctgggccctctctagtgaacgccattcctcacgtttcactcatggttggttctacttgtcctttaaatctcagctttaacggcgcctcctctgggaagcctgcctgcatcatctgcttgacagggatccctccatttttctgttgcagccctcgtttaattcctttgcagcgctcattgcagattgcaattatttccttgtgcattggtttacttgttatttattatcagtctcttacactggtctgtgagtgccgcaaggtcagagactagagctgttttgttctccattgcatcttcagcacctagtacagtgcctgacacatactagacacatttgttgaagaaatgaatgcattaactccaaaattaaattgcactccaagaaggagagcatttagagatttttctccttcattcaacatttgagtactcgttttttattgcaaatacaatccatcttattaaatgtgtattcaaatttggtacataatttttgatcattttcatatagatacacatgcctttcattatggtcagacctccttacaaaacaaactttgagggactaaccaaaagctatcattgtcctgaaattgtgcctatttgttgaaaaagggcgtgtcatcatctagaatgtgtaaactttgccactacagtggtatcctttggggcaagttttgatctgactgcgtgttggtagccggcccaaagagatgtaccctggagcttgggcccaggcaggttctccaggaagctgcctgcagtgagcactgacacagacacaggggggtccacctcagagtatgacctccaagaagtgtcatggggcagaattaatgttgactctggtgcctggatccccccactgtcttctcatggctacctttcatcagtgagcccctctttcttctgtctccaaccttccttctctggtctcttttgccgtctgcatagcagtttgctcaagcctcttcataaaaaacaaaaacacaggctgggtgcggtggctcgcgcctgtattcccagcactttgggaggccaaggcaggtggatcgctttaggtcaggagtctgagaccagcctggccaacatggcgaaaccccatgtcgactaaaaatataaaaaattagctgggcgtggaggcacgcacctgtaatcccagctacttgggaggctgaggcagaagaattgcttgaacctgggaggcggaggttgcagtgagctgagattgcaccactgcactccagccttggtgacagagcaagactcagtctcaaaaacaaaaacagaaacaaaaaacaaaatctttcacattaccctcaccttaccataaccaccacgcatacacccttctctcatccctttatggctaaatttctgaaatgagcttaaaaaaaccctccacatccattcaaggatgtgttcagacataagtagggatatgacataaagttctggtcttccaaaggtctttgaaactcatattctgagctctagtctgtaataagtttctgtactagtctggctctaacagtcacaggtgaggcaggctaacaatcatcactgcttgctagtgtgcacaacccgagtaggctggccgagaagttcaagtcagggactagaaagcactggggtagctttggcaggacctgagctggactttgaagagtggacgaaatttggaaaggtgcagaggaaagaagagggcatttgagcagattttttcataacggcatttgtgaaggtgggttggcatagcctgttcttaggctcagggagctggctgaagcatggggcaggctggggcgggatgtgggggcctttgaagactttgacaggttggggcacttcaaggccatgaaaaacagctaggctgtgctttgtcttgttggggtggggcagggcatgctagggagaaagggagtgtacggatgggtggtggggtggtgccacccaagccaggctatgacaagattgatctggttactgcaggagagccagcctggcagtgtaacaaggaaggctggggctggttgcctgtgggaagcctttgcagtgtgacatggcgagggcctaacccatggaagcatgggagtccatgacccactaagggcaaaggatagaccaagctggctctgagatgttgagccttggaggagcggggcccaggtgttctctgatgaggcattccaccatcaagctgtaatctaggccataacacatcctctaattgcaatattgcaaaaaatatatggactgtatgtgaaccctgaaatttacaaactgttaaaaatttatgacctatttggaaaaatttgaattctaattggattcggtaatcttaaggtattaattcttaactctctaggtgtggtcatggtactgtggttttaagagcccttatgttttagagaaacatatgaaatatatacagatgaaatatatctggatttgtttccagttatccaggtagataaggggagaatgggcttagcatagatgaggcaggactgtttctgaattgtaaactgtccaagctgggtgacatggggttcattccactcctctctctacattgtatacatttgaaattttctgtaaaaacattctggtccttggataatgcaggtcctacaccctgggcctcaaaattcccaatcagaaatcacgagaggcattttgagctgtgccatgttaatctcttgttacctttcgaaacaggaattctgaccacttctgttttgcctagagcaggaaaaacacatagacaggaaagaaataatgccttggctttatttagaaaaacaaactgtgaaagacacgtgatcctcctgtatcacgatcatgggaggagtccaaccaactggagaggcgaagtcaaaactcagaagagcaaaggcaaagttttagctggaaataaatgcttcttttaggagagtcactcccagtggaggatttctggcagtggagcacttggcatgagtgtgaaagctgacactgagttggaaaatggtagcccagggtgtagcggccagcataaggccagcactgtgcagtcacatgtcacagctcagggaacagaaaggcctgctgttgtcacctctgatattggttgtcccggtgcccaccctcatggcacctctatctctcacatgccacaaagacaggaggctgctctgacagtgtccccagctatgcaaggcggggacacccactagccattacatgctgggggagggccctatgaacttccttggcaggccatctcccaggctacagggcagaaatcagatttctttttcaattagtgcccccaaacagaaaccatttgcacacaggtaagctagaaagctaggagggtacattttgaacctgagcaagtgatctcatttttcctcctcttttttgaggagaagaaatacatgagggaattaaggtgggtgcacgttccctgggaaaggaacaagcatgaaacaggtgttgagagttcagcttagtaaacatgtgagggcccactctgtgccaggcactgtgggaagtgcagcgatggatgagccgtggtccttgtcttcaaggacagcgtggggaagccaggaaattccaggtgcacaaaatctcctggataaatactgaaggacacataagtcctgtgacccaagcaaagtaactgttacttagccaaagtcaaacttccggcaaatcgcttaaatctctatttttcacccataaaatggtgcaattctgccttgcttaccccgtaaggttatagagttataaggatcaaagctactacaatataataacaatgaggaggaggaggaggaggcgaagacaaggctttcttgaccttgctgacctacagacctgtgactggtgcccaaggacgaactccgctgtggatggcagccaggaccagggcaggttcctgatgcagatggctgtctgatcccagccagtcctggagcaccggtgccctgtgccctcattcccgaagctggttcccctgggcaccttgtcacatgcccagtagctgccttgacatgagcaacctctctgactcattcaaatttgcctgacagatggagaaggtgcttagtcctagtattcttaataaatatcagagcttaagagccagaaggaaccttccagaacatagcttccacacacatcccatccccaccactacgcccaccacccccaccatttgcacgaagggcaatggaggctccagcagggaacataacccactgaagtgttgggacagctgatgctggaatctcattctctggactcccctggtccaacatagctgcttctctttccaagacaggttttgccaacaccaactctactgcctttaatatccttagtctttcctgccccccaaataccttatttggtcctaacttccaataaagcgtatttagagcaagagaaaaaggaaacattccccaagtcacattttcccaagccctctgttctttttcactctttgggaaaatgtttcctaaatgcccatgggggcacgtgaccctacttataatatgggttcacagagacgaagatgaggggtccctatcttcacgaggctctcgtttagctatcagtaaaatgccctcttgatgaaacctttttgaacctccactgtgggaaaagaaaacccttctaatccagttccctttagtcatgtgtgcaaagagaaagcttctcaatgatgcatctctttacttcctgagttttttgcattcatgcctgcctggcagcttccgccctgctggctgtgggcccaggcagtattgtgagcacagaaaaggctggcagcctcacttagggagtcttaccctgtgctgtgtctcttcctgaccctggggttctacatgaggcctcacggttgcttcattctgctccccgctgcccctaaagcattcggtttggcccccagctgaataattgtcttactccagtttggccctggagtgcctgctttgatatcctccagcctccctcttccctagtcaccatcttggtgtagttgagttattttgaggccttgaaaataagaatagtagagctcagcggagactctgccatgcccaagtgagaagactggtgtccagtgaaaggttggactggagattctgcaattccgtcatgctgtaacatttctgaaaatgcatagcctaaggttgacagcctgaaaaatcagtagggttccgatgtgtgtgtccggacctagaagtaagaactaactaagcctgggaccaacgcctcatagcatttgaaatgaacctgggtaccaagtatcacttcggattcttcccactctcagatacggtcccctagttagagagcacgatgtagggggttgggattctgtggggccaatataacatttacacccttgtgaaacagtgcaggggtctacagaagaattcccagaagaggtggtgttcctttccccttttctctatttacccaccttccttgtgttgaaatactgatgaacggacccccagatggcaaagcttgatccccagctctgatagagcccacaggacaccctgggtctaccctaacgagccatgacatgccaattctttgcttttctggagaaaccttggcctgaaagtctgtttaattaccgtggagataatcttttaaacatagatttacattctttaaagactttttccctgtgggagtaggaaagttcatctgcacatagcatgtttattttcatttccaggggaggaactgctatctggtagttagcaagaagcttgagccctggaggaatttctttttttaaagtctgttcctcttcactgatagtgtgtcaattatattgtaataattagtttatagtgtggtcatatttttttccagcttaaactctgcacttcactctgtgattccaggcctataattatttaacatttgtcaatcatccctatcagattgggttctatagttactctaaatgtgggtatcaagagtcaatgtcctcaggggtttctcttcaggaaggtcatacttgcaaagccagcagccacaaagacctatttaggttggtgcaaaagcagttgtggtttttgcctgaaaggaatggcaaaaaccgcaattatttttgcaccaagataatacttggcactgtggtcagtaagacactaatttttcccacctggggtggccccgcagatttgctaaattcttccccgctagaatgccagcttggatgagcaggggctctattgtattcaacctggcagccccaagacccagagtaattcctggctcataataggtactggctaagcagatgctgaattgctgaaagtcaacaggtcttgacgtgtgtgtcaaacaggaacaatgtacaaaataaagcagagttcggtggccttctggctctggcctgtgcagccctagtccttctttccccacatcacttaagagcaggtggtcctgagtggttgctggacctgattctggaggccaagactctgagccttgaagatttacctccggggattcagaaaagaggagaaaaggagtaattgtattgaacagagaattagaagataaggaaaatccctttgtgagaaactctaaatcttgagcatggatctctgtgtccaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcaggtgagggagaggccttggagacctgaggggtatgtctgagtctccctcagctgccaggcctgtccttttccatctggcagggaggtgttccgtggaagcatccaggaggaggggtggggcggggcgggggtgtctttgagagattccaggagcactctctccaggggatgctggaggctctgggctctgaggatcctgccagggccgcacttcccagaagaagcacatctctcaggatggggcaggagaccggcctgagcactgtagttcattggctgtgcagctggagtgaattctggaccataaacgattcaaggaaccacacagtttggcggggggtgcccaggctttggagtcagaccaacctggatttgaactctggcttgactgcttacgagccatgagaatctaggtgagaattttagtctccttgagcttccatctggaaatggacatattgatggataccgtgaagactggagattatgtacgttggggtctggcatacagagtgaagtaaatgcttcataaatagcagttatcgttgctgttgctatataattctaaagcttggaaggtacttcactaaaggtgtctgatccatcaatatgtaaataaacacccatccgttggtctagtgttagcgtttctggcatcactttccaaggtgaaccaagaaggtgctggtgccactggagttgctttggggaaaagggaacattctcagggaaagagcccaggtgtctgacctttaggctgcatctctgctccgcacctcactccatccacctgcctctctctgggctccagggggtggcagcaggggtggagggagcattgcctacctgactgctctctggcagtgcacagctggccggggctctgaaggctgctcctccactccccgcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgaggtaagtagggctgccagtctggcagaggctgctctgcagtgggtggtgtggcaccttctcgacctggctgctgtgcagataacaccagagcatgggacaggctgccttcaggctctctgccccacctctggccctggcacaaggggcgcagccactccactagcctgtagctcatctgcactgtcctggtccctttcttctcctgaacatgctaagtttgtccctgtgtcttttactgagtgatgctgctggggaggcagtattcccagggtggcccagtgggacatacatgcccttcttttagacattgccttcctatctgtgcagataaaaatctcctgctgactcacactgggctcactgctcccccaaacttctcagcctttcttcatatgtcatgctgtttgcatcattttgatgctatctttccctctctgggcatgggttgtgtttagaacatggggacatgggtctagggccacccttctacctggccacaagtctaggggtacctggcagtctaatgtgcagggcatcacggcaagcagactcactagggacaagatgtcagccagcacagcatcgtgtcatgttgccttgagaagctactccgaaatgccaaaagaaaattagaagacgggcagagcatttgtcctatgcaattgcaggatggggtggggcaaggagggggttgagatgctccattttggcactccaatagccctgaactgggggtgtggctctgaatatttacagggaaatacaagcagataaatgctgctgactgatcagccaggggagtccgtggtaaatagagaccattcccctccagtcataactgctgaactgcttaatgtttcagactaatcataggtctacttgcaagcatggaagggataggatctggttcaataggatggtaccactggaggttcacatatttcagagcggcccttccctgaagctcaagaactgaaatttcctccaggctaattgcagtgttgagacttctgcttcccccatggggaataaagaaggtgtaaaccaaaaagtgtctgagactcaatccatttagaagtttattttgccaaggttaaggacacatgcccgggagacagggagacaagtctgtgcctttctacaaagatgattttgagggcttcaatatttaaaggggaaagggcagacactggggaaagagggagaaatgtttaaaaggtgtggggaggtaagaggcaagaggtcgcattcttctgagtttttgatcagccgttcacatgtgagagaggggtagaggaatagtcacttgtgcattcatctagctcagcgaatctgcattcttacaaaataaaacagacatgggcagaggaagcaattagaaatgcatttgtctcaggtgagcagagggatgactttgagttctatcctttgtcctgaacccatgaagataagttatccatttacattgtcacggtgaaattcaacagaactgttttagggtaaagaccttgcggcccacagtgaatttcctagtgggcaaaatgtgaggtgtgttgcttttttatctttgtagccgtcttatttaggaatagaatgggaggcagctcccagcttgacttttctctttggcttagtgatttgggggtctcgagatttattttcctttcacaaaggaggttagggtgtagattggcagggtttatgtgttttaaaatatttctacttcttgtattttctgctattaagtcacagcatcagaccaagagtctggttaagatggaccataaatgccaatactagagaaaaggcatcagggtgtccctaaagtgggtcctctaaggaaggaccttggaagtgtagtggttctttgggatggagttcatataagaagattctggtggggcatgttggctcacacctataatcccagcactttgggaggctgagacgggtggatcaccggaggtcaggagttcgagaccagcctgaccaacatggtgaaaccccatctctactaaaaatgcaaaattagccgggcttggtggcacatgcctgtaatcctagctactcgggaggctgaggcaggggaatcgcttgaacctgggaggcggaggttgcggtgagccaagatcacgccattgcactccagcctgggcaacaagagcgaaactccattaaaaaaaaaaaaaaaaaaaaaaaagattctttctatcttaatctcctcaacagggagctcctttatgcttggattagtcttcacttcctctgagcacaataagaaaagtacagacaaaccacaagctcaaaggtcagctgtaaaaggaaataggggcttaggacctcaggggttttaatcatatagaattcagctctgtttctcaaagtgatgccaggccgagatggtgtgggcagtgtggcagactaagtcctttgaggggaagatggtgaagtaggagctctgaagaaatccttaatagaggaccacttaaaagaagaaataatttgatatataattttttttaagttagaaggagccacttaaagttcgaaatgggaaaattaagctgtattcaataacatatgttgaactgtatttataaacacatgagatggaaaaggatgaatgaaaagagaaaagaaatagagttaaaatctcaatatgtcatagtctcaaggacaaagaaccagcaaaaatgcatgggttgtgtaaaccaaaaataaattctaagccccccaccccacccacctgccatctgaatggacctctcctcttgaccaagggcattccaaagttaacatgaaaactagttcaggccatgatgggaagagggagttggacatgacccattataccctcctcccttttggaatttaggaaaagcccacattcattaacatcaacacagaccttaggtctgatcagaaatatttacagtctattctctctgaagcctgctacttgtattcttcctctgcatgataaaatcttggtctctacaaccccttattggaacccagacattcctttctattgatgataactctcaaccgattgccagtcagaaaaaagttaaatctacctatgtcctggaagcctccaatttgagttttcctgcccttccagatcaaaccagtgtatcttgtacgtattgattgatgtattatgtctctaaaatgtatcaaaacaagccatgccctgaccaccttgggcacatgtccttatccttggcaaaataaggggagggtctgagagacctaacctagtctggggggctgagggggctggggttctgtcctcacagttggagtcaagtcttctgcagaagcgacaggctcccatgagtcgcttatctcctaatgggtggcttctcccccactgcagctgcacattgtccattataactcagacctttatcctgacgccagcactgccagcaacaagtcagaaggcctcgctgtcctggctgttctcattgaggtaagagatatttaaaaggttcttaggtgaaatttgaagcagggatgagattgggattccaccttttgttccatgcatacctgttgataatcagctgttcctgtatcgactccgtgtcaactccagagcagggggtatcctcctgtagtgcaccttctctcttggcctggaggcagcactttctgtgcctgggcagcagaaatggggaatgttctttggtccgttggaaaaacgggccccaacatctagccctgttgcataaggcatggaattgcccagttggggaggacctgtgctggaaagggatcatcaaactccatctgccccatcagatgcctgaactcttgatacaactcctgccatccaagctcctctagatccaagggacctctagatcagtggtccccaacctttttggcaccagggaccagtttcatagaagacaatttttccacggaccatggaccagggagggagatggttttgggatgaaactgttccacctcagatcatcaagcattagttagattccgtaaggaatacacagcctagatcccttgcatgcgcagttcacaatagggcttgtgctcctatgagaatgggaggcctctgctgatttgacagggggcggagctcaggctgtaatgcttgcttgcccgctgctcacctcctgctgtgcggcccagttcctaacaggccacagaccggtactggtccacagcctgggggctgggcacccctgctctatatgtaccctggaatgaattctttttttatcccaagatagaggaatgtcttctgattggcttgcatgtttttttttcctaatgaggctgtatgtacctcatttcccaacatgctcatttgtctgacgtggcttttgtgaactcagagctccttaagttctgtgtgacatggatgttagtcaaagccttcaggctcatatctggatcatcaagagcacacacggtaccctatgccccaggacattcaagcccaactccttaagctgaaaacaggacgtcctgagatgcaagaggcaggaccattacactaactcccaagagcctagtgatccatcataattgtccagtaaagtggatccttcaggcagtggtggcaacatacccacagctttgcccttctgatagcaatcgtcaatcctggctcagcctatcctgttctgtcccagtttaacctgccctgtctctgttgcagatgggctccttcaatccgtcctatgacaagatcttcagtcaccttcaacatgtaaagtacaaaggtgaggggtccttgcatgcatattcactctctgctggagaaggaggtagtcagccctgtgtgactttaagaaaagcaaacacaaggggcaggtgctgtctgtgttcaccaggttaagagcagcaggttgttgaacaatgttgcaaccaggtcctggggttagatgaccctgaaaggggctagttcatgtttctaggctcagtcgctctgttcagctgcacttatgccctacggagggaggctgacactatcacctctgcaacatgtctctctaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcaggtaactgtcgtgccagactcagccagagtccacgcggcacctcagtccccatcatcctccatatcacaatcaatgacttgatttcctcatttagtttcattggcagctcttcaaaacctctccaaatatcacaggtgtctgaaagcaccgcagaaattccaggctgagcttcaaaagaagtcaagctaggcaaatgaatagatgtctcctagttcttttttaaaaaaaagagctctaaatctgcatttgctaatatatcctcagtggctgggtggtattcacttcccaggcaggagagagcctggttcctttacagggcagaataaagacaggatcagatgaaatcatttaagagatgggattgcagcaatgactaagtgagggtccctgcccccaagaagctcaaggtctagtgcaaactggggaacaaaatccttagccatcacctctaaagcttcttatttgataggagatgagagagaagagtagaagtctgtgggatcacccgcgggttagtgacaaagctgagacccaaagttaggtcatctgagttccatgtcactgctcatacctgtcctccacagcctaaattcatgagaagaaaaatggctccccaggagacggggctggggccagcactacaccctggctcacagccccacgccagcttcatgcgtccagggcagcctcacagctgctcctctttacagtaagcttctgctctgagtcacctggtaaatggcagcaggtgggtggacaggaatgaggacatgatgaaccaagagatggatgaaacatgtggggaagcagcaacatcctacctcagaaactgccttgggaaagggttatataatctatgcaggtgcatgaaaatgccatggaacccgcaatcagatggcctgtgaaactcttaactccctcctttattccttctgatatgaccatcagaacaagccctgcgaccctctggttgagagctggcctctaatttaagttcatgagaggaactcagtctctgtggaggttaaggagcactccatcaccccaggtttccctccacgcagggcagattccaggtataattggaaactaacagcactgcctttccctgaagtctcgggtgctgggaagataaacccagcgctgcccagctcccactcacccactgtggagggaagcagttctgtggctttccctctgctttctaatatctcccacccggccccacagaagctggttccagaggcttctcccaggtgcaagagcggagagctagcctcttcccaggggatcaggtgaggaggtcattctgcctgcgggctatttctgctcttgccctcagctgctggctttggagacagccctgtactgcacacacatggacgacccttcccccagagaaatgatcaacaacttccggcaggtccagaagttcgatgagaggctggtatacacctccttctcccaaggtgaggagaggcagtgctggggggagggggtgcgggagtgtggtgccaagacattgggatcttctgtgaatgcagctctggcactgatgccctcaagaagttggctgagagctccctggctgccacgggaaccaggcgccttgtgagactaggtgtggggctcactggggtccccccttcagtgagtctttgcagagaagcaaaaagccgaggcccccaggcacatggaccagagcactctttaagcctgggagtcttgcacagatgggtaagagagaattccctggggacttctctgttccagacaatgatcccttctctaagacacaggataggaccctttccatgagatcagacttctaacttccctccctaggctttcttggcatcaaaggctgcagccagcctatcttaggcctggccaggtgattcatgcaccaccaccaaatgagcaagaatgttcctatgttagatgtaaaacagtgagtgtaacccacaaccatgtctaatgtagcagggcctgttaggcaaggaagcacccttgtgcactgcatttttgtctaacctccttggagcttgcataagcacaagcacataagttcccaattgaacaaaacttaatagcttggtttcttcctaatgctacaagggctcgggtctccctttcacagctgtaaccaataactccccagtagaacattaaccgttttccttgctcagtgcctacatcaacactgctggaaactgggcatcaggggaaaggggtgagggagcacttttggggcccacacccctcttcagacctctgagttcactttcaagctcactttcttactgtagattctcgactgcttcccagcttgggaatcttcatggctggtctgtgcagttccatttcatccccagcatcacgtgtggaccaaaccgggcctggcgttcatatttaaagataacccgttctcacctgcaatcccagcactttgggaggccaaggcaagcggatcacctgaggtcaggagttcaagtccagcctgaccaacatggtgaaaccccatctctactaaaaatacaaaaattagccgggcacggtgtcttgcctcctttgggaggccgaggtgggtggatcatgaggtcaggatttcgagaccagccggaccaacatggtgaaaccacgtctctactaaaaatacaaaaattagccgggcgtggtggcacatgcctgtaatcccagctactcaagaggctgaggcaggagaatcgcttgaacccaggaggcagaggttgcaatgagccgagatcacaccactgcactctagcctgggtgacagggcgagactccgtctcaaaaaaaaaccaaaaaacaaaaacaaaagaaacccgttaacccacttgtcagaatctgctctcctcgtctcacctggtgcacttttttgggttcctttcttattatatgaggttataacgatcacctcctaaacttagttgaacatatggagactgtatttgaaggccctttccaggaagctttagaaactgacccatccttacggtcaggattacatcattctctgtcttttcatgaagaactgcccaagaatttgtcttttgtgttttctcctctccaggtacaactaattaagatcatttccctctttcctcagtttctcagttggaaaacagaatctgtgaacagtagccttcctgaaaattcaaaatccatgtgatgataactaacagtttcttttctaggaaatgaactgagtgcatggaatgtatctgttatggatacaacgctgtcttttctcattcttctaagtggagaatgtagtatccaagggttaaatggaactacttcaactcttaaaaccaaaaacataaaaactctgccaggagattaggaactttgcccacatagatcagatagaattttgctcgcgatcccaggaccccattgccggctctgttctctgagctcacctatgcacacccagggaaggggtggcacatattctccttacagtcaggaggcctaggttcaaggcctggctttgcttcctcctggctgcaggctgtggacaaatcgtgtcccttctttggccttggtttcctcagccacaaaatgccaggtaatcccagctactcaggaagctgaggcaggagaatcgcttgaacccgggaggtggaggttgcagtgagccaagatcatgccactgcactccagcctgggtgacagagtgagactctgtctcaaaaaaaaaaaaaaaaaaaaaaaagccaggttggattaggtgatctcatgtcctttcggtgctaatatgttgtgatggttaagtggacactaacaactgccaatcctgactttacattgcagggacagtgtttgagggcagttacagaggatcagaagaaaccgggcaggagcttgactctgacatccaaaagtaacccccgcttgtaacgatggactatggcattggggataattagccatcttcttagaccggcttgtgtctaagcagctgcttgtagtggggcagcgtaggcaggtttttagccaagcgcttcagtagattctcccagtctggataggggagcttgaggggcctctaagcagaagtctggagaccatctcccagcttaggacgtcaagatcaaagcccaaatgcagcgttgccactgctcttcctccacggtttgcccagagctggtgcttccacaagcccaggttgggaccagctttctcctctgagtgagactctgtggcagtccaaggaaaacctgtccatctggaggctgattatagaagcttggccagaattctcctcccctccctttcacttcccaaagacacaggcagcaagtgcggctgcttcccaaggagcaatgaggaggcagtcccaaaggggtgaaggcccaaacctcatctgcccagggggctgcattcacgaggcctttcttacccagctcggagcaggcctcagactgtaacatgatgtttcaggtttacggtgtgagactttgtcagtgtgaaccttgagcagtttggactcaaattgtagcctcatccactgaggcatgtttgtaattagggtctggcttactcagggctttctctggaagttaacaagaactacagagtcagaaaattctgccaggagaaaagtgatgtttaaaaaatcatctaggatggccgggtgtggtggctcatgcttgtaatcccagcactttgggaggctgaggtgggaggatcacattagcccaagagtttgaggctgcagtgagccatgatcacaccactgcactccagcttgggtgacagagtgagaccctgtctcttaaataattaaaatttaaaaattaaaaaaaaattccctatgagagaaagtacatggactttggggaaggatctgaagtttagccaggttgggacaatttggaccgaatcatttaacttaaccctgctattttcctcaactgtgcttagaaaaggggtacaggacctgatttctgtccttaagaggtttatagtccagctacaccttagcctgggggcagagtttctcaaccttagcactactgacaacttaggcaggataattcttacagtggggggtgtcctgtgtgttgtagcattggcagcaccgttggtctctacccagtagatgccagttgcccctccccagttttaacaggcaaaactgtttccagacattgccaactctgtgcaggcaggaggggcaagttttcccctgatggaaaaccactgccccagggtttctgcggcccagaactcattgttttcactgatgtcataggagtctggagttttatatcacatgccctggtcttcattgttttatggcatgaacatttcagtgtgatgatggttatccctgaaacagtaaggctgaagttactgaggcagaacaaaccaacccaagagagaccttgttccccatcttcctttagaattcaagtatagattcttttttatatgattgggtaagaccaagagacgtagcgtgagagagaactgtgcacccttaggagtgtacaaatcctttatcaggggtgcagatgcctctgaagtagcaacttcttcaggatcccccctttattctttttctctctcccttttgtatgagtttttctctcttgtatgttatgtttcttgttgcctttagttaaaacgtccactctttatggaaaagtgaaagtcatgtcaggcacttttttccattcttaaaaagtgcctcttccattggctgggtgtggctcatgcctgtaatcccagcattttgggaggccaaggcaggtggatcacctgaggttgggagttcgagaccagcctggccaacatggtgaaaccccctctctacttaaaaaaaaaaaaatcagccaggcatggtggtgcatgccagtagtcccatctactgtggaggctgaggcaggagaatcacttgaacccagaaggcagaggttgcagtgagccaagattgcaccagtgcactccagcctgggcgacagagtgatactccatctgaaaaaaaaaaaaaaaaaaaaaaaaaaaaaaagtgcctcttccaagtggcagttggaagatttgagctgaaggagaaagcaagactcgtcctcaaggtgggcccctgggaggggacacgtcctcaggccagttcgggtttcaagtcaggtgctcttagtgggaaaggggaaagacggcagaggcagggggacatcacaggggctcaggcttagggctttggcctggttcttggttcctttgagttcacctcctcctagccagtggcaccaacactgggcccagatgctgggtaatgaagcaagagcccatcagacaaaaatgctaacaccatctagccctgtgctcaacatgtcagggccatggaaacttgagggacaaaaggaagccaagaagtttctataatcacatcattagtgggcttgctctaagcaactgcatgtcacccaccagagcagctatggcacactcagacaagggtgccaggcagcaaaccgcaagggcaaatctatagtcctgcaattaggatctgcttaagcctagacctgggcaattttatgaaaccttaaaaggagggagaaggaaatcagacatggctaagatggctaattatctaattttttgaggctagaatgcatgtgttatcattattgaccttgtatttcttaaagtttccatttataagtaaaagctattagctgaaagaatatcatcgattctcccaaaggatccaaatgattagccagcatcatttccaccttcagtcgctggtctgggtcagaggccgaacagtcaggagcattggtccaaggtgctaagaagtgaggtcctagtgcctttcacacaccacatgtttcccgagcacagtccgagttatgcgctatgggggacagaaaaccccatggtgggtgtcatcttgctcttaaacacagcccgtggcacagggcagactatgttcaggaaagacaatgggaaaaggggctgggcagacggctggacccacccttggtgatggggccctagccgatccttccacatcatctccccacagccccatccctgccctcttagcctcagcccccaaaactgtagggcagatgctttcaagtacacacacttgatgtctgggatgccccctccctcctccatctggaaaattctttcaagacccaactctaatcacgtcctcctggaagtcctccccatccctctaaaggtgacttaatctccctcagtgcagccagaaccacgtctccatctctgttatgttacttgacacaccatagagtaattattaccacacagcaaagacgaatagaaaaagaacaatacgtacatattatacacatactacaagctccttaaggccagggatgactgacgtgttactcatttttatgcctggcatggtgcctggtgctcaatataagcttgttgaaagaatgtccctgacccatctccagttccctcccctcctcagtgtcttctctgcagaatgatttacacataagcctggccagttgtcaccttttcgttttattgtcttgtttttctgtggtctccatttgctaacaatgttaaaaatcaaccatttgtttaagagagattaacgatcagaacttagctgtcagttttgaaggtctgggaggaagttgcctagagatgctgttgtgccttctgtagctctggcttgatagggatcaaaggcccccgtcccaccacccattctttccccagggacagtgaagacagcttagagtgccaagcaccaagtgccagcattgtaacctgcccctgaggctctgggatttaggcccttcagagcaacgtgctgtctgcaggggctgcattcctgtaatctacaggcaaagccctcagtcccatcatagctgtataaaaccagttcccccatgtaatctggtactatcttgttggcagatttctttgtagcaattcttgttttgggttgcatagcgttcataaggaaaactccgcagttaaatatgtcctctgaagatggctccactctgtggtgagggcatcttccttgtcttggcaaagcatcatctgaagatagcactggatttgcagtttcttgactctctgattttttattaggtgtaataataaggggctttttaccttcctaacagattttgtgtatttaaactatcaaacccctgataaatctaaactctctgacctcttttacaaggctggagacggctaaggatatcgctacgtaacatgccatctatgtaaacagtgtgtactttaaaataatacttgaaaaggattatagtccacagtcaaacagaatcgtaaatagagctagaaaatactagactgttgttccaggaacctccagatgtgaaagtgaggtgcttgttcctcgtgctggactcttctgtgtttatgcttgaggcttcagaagacctcaaaagcccttaaccagcatccctcagtccagcaagatgccggtggaagacgcagctcctgggcctgccagaacaggtagcaaggcccttgtggcaagcagctcaccgaccttctccgggtgtctgtaccttcctgggcaaggtgtgtgaccatcgagttcttctatatctgtgtggtttccttgtgtgtgtcacactgccgtctctctgctcgccctgagtcatacccgagcactttgtgaacaggcggctctcccacgtcctcatggtgtgcaccctcttaccagccagccccagagctccttctgttgggctgccactcgatgcctctcgtgggccacctctgtgacctagcctgtctccatttctactgtctgtcccattgttcttccgtgggaatcgcctcccttctttcctattcagaaacaaaccatttctttaacctgaaagtgaatttctctagttctgcccctccctgtaccatctttgatgcctgttctctacagtgcctagaggcttcgctctcacccagccgaggctctgctgggaaacaggctttggcttcgcactcaggttctagttctctggttgccctgacagttctccctgtgtcccgaaagtctcgctgactttctctctcccatcagataacagatgttttggcatctgcctccaatgggactcaagcccatttctgcaaagaagctgagcctccatgatggttggtgctgtctcgattggcagggacagcattccaacaacaccttcctgccctgggcttcctgaggtggtggaactatcgggtgacaccctcgccggcattcctcttccttaacagcttatgatgttggctcagtcaagctgcttcgtttttgctgtatcaaagtcttggctgaaaagtatctgtcccagtctctgggcctttctttgtcttcatgcctgtttggtctcatttcgttgtttccaaggagagtccatttaggccttgacaagtggtcctcaaggagcaaagatcccaggtcacagcactgggttcaactatgctgttgcttacaggacctccaacaggaaccccgcgtaataaccgggggaagccagactctccctccagagaagccaccacgcagggcatgtgccctgagaaaagccccacccttgctggggccttgctctccatagactttgctcagctccccaagaccaggcatgaagggtacccccaccagccacagactgggctgctcagtggtctggggcctgtgtgactctcagaatgtttgaggtgactgtgaaagagatgactttagaaaccatccagcctggatggcttagccaggtggtaaggcttcctagtaatagtcttcaggtggcgagaactggtttggcaccacaagcatctggagcttcaggaacaaagaacgagagtgtatttcatcaaagggttgggaagaaaaaccatggctaggtttattatgtttgtttttttaagattccagggaccatggtctctggttacatttaaaaaagaaacaaccaaccctaataccaagttccactgtgcagaggccacaggccctgcaggaaacagagcttgtgctgtacaaacactggaagctccctccaggtggagactcatgtcctcagtacctccccaagccacaggctggtccttgtgttcaggttacacgaagaggcctggggcagggagtctggccagtggagccactctgccacttgggaggtcatgagcagctggtggtggtgagcagagtagggagaataggcttccctgtccttggggacagctcttctccctgcctgctctgctaaccctcacagcagcccggtgccacctggggaagccagaccaggaacccccagggcccagccttggaccagggaggctctgcaggttcaatgtgagattgcagaaaaagacaatcggaaaagcacacggctgatggctcctggggaatcagctagacttgggccatacgacaggagaaggggcagtgagcaaaacctcaccctgcagcctcagatctggttccccaggctgttaagggccccaagggagagtccttggccccctgctggcatcttacacttgaccagggctctcccagggcctcagccaccactgtgggttctatgggcacaggatcttctgtgtcaggctgggtggccaccatctgtacaactgtggctcccagtgtgagttagaacaaataccccttcttcctccaagacacacacacatgctagaagtttccattgagatgagaaaaccaccagacagaagggtacctgtaaatctacactttctttagacaaaggacctgattaggagaatggggaatggctgtgggaaccttggaaaaaacaggctgagggttttcaggggagacttcatgactgggatcctctgctcactcaagacaatggattctcatgtgattttccccccaggaggtggctagtaggctgactgtgagacttaggtagctgggcacgggttcagccacactgaggacttctctctcaccttatttatcctcaacagtaacttgctggttgaagccgtaataccctggttccatggagcagagaagtggggctgatgtggtgaaggcgtttgtccaggagggacaaagcaaaaatagaaccaaaccatgatgacaagctgatgggctgggggagaagtctggtgatggattccttgcttaggaagtgaggcaggtaccagggacatggacaggagcctgcccaagcaggctttgatccctacctttcttcatctttcctctttggccatgttgtattaaaaactgaaatcttggctgggcgccgtggctcacacctgtaatccccatagtttgggaggccgaggcaggtggatcacttgagatcaggagttcgagaccagcctggtcaacatggcaaaaccccatctctactaaaaatacaaaaattagccaagcgttgtggtgcacgcctgcagtcccagctgctcgggaggctgaggcatgagaattgcttgaacccaggaggtggaggttgcagtgagccaagattgtgccactgcactccagcatgtgtgacagagcgagactctgtctcaaaaaaaacacaaacaaacaaacaaacaaaaactcaagtgaagtcttgccctagccaggaaactgttgtgataaaggagcatcggggccgggcgcaggggctcacgcctataatcccaacactttggaaggccaaggcaggtggataatgaggtcaggagttcaagaccagcctggccaagatggtgaaaccctgtctctactaaaaatccaaaaattagctgggtgtggtggcaggtgcttgtaatcccagctacttgggagactgaggcagagaattgcttgaacccaggaggcggaggttgaagtgagccaagatcgcaccactgcattccagcctgggcggcagagcgagattccatctcaaaaaaaaaaaaaaaaaggagcatcggaaggagggattgcagtatgaattccctagatgggcaatttcctgtacttcatcaggcaatccctgagccaagggtggacatccctagaggtctgtcagcctaagaccaaacaaatggtagagcgtctctcaacacgctgctcaaatccagtgtggtttgactctagagtaacctcgtcttttcctctccccttttaagtgcaagtctgtactgcggcaggactgagtctgggtatgtggctgggcagccagccgtgcatgctgcagctgggtgatcactgtgattcttggtgtgatccaagcccgtcctctctgcttctctgtactattgctctggctcctggccctctccttgctatgggtcttaccctcaagtcgctctgtgattcaaagatgaactgccaatcaaatgttcctctaatgaaagatccaatcactctacagcatgtgtgtattcaaagaacctatctaagactttcttttggtcatggtgggaggctgttgctgaaaacataccagagcccattgtggaggtcagctgacaggccgcatgaccttggcaatggactactggtcatctgggactgcttaggactgtgcaatggaacttgggggcaaaactgatggagacagccaatgggccttaaatccagcaggcaaagacagagtaagttcttatttgtgtagcccagggcttatcaaagtgtggttcttggaccacgtgcatcagtatcagctgtaagtatttggcaaaatgcagattcccgggccctgcaccaaacagattgactttgaatctctgggggttgggctaaaaaaaaaaaaaaaaccctacattttaaacaagctcttcagatgacccttgtgtaagtttgagagcatctgctggaaaaccactagaatttgcaaacggccacctcaaaatactccagccagtcccactaagccaaagaccagaatctgagaacagggatggggaaattattcctttctgtggatgattatgcagctgggccatgatttcacacccgggggccatgggctaagatggaggggaaggaaggaatgtaatgtgtgccctctacctcttcaccaggcatcatcctctcactggccctggctggcattcttggcatctgtattgtggtggtggtgtccatttggcttttcagaaggaagaggtgagctggtttgggtccaaaatgggaatggacagctatgtgtccatgatgattagtctgcctgggaaggcagctttgtggcatgaagagccgcagtcacctggaccaccacttaccctaggagggccgtccccaaagcacccgtgccctggcctcctttgcatgagacgcacatgtgaccctggtcgttcaaagggttcaggggtcactgtgctcagatttggaagcgtgtgtgccttgcttgctgctattgcatggccttggacgagtctcttgacttggggcttgtgcctgaagttaagcagccaggctgtcttcttatcaagatctttacatatgctttttggtctatgaattcaaaaagaaagatgaaggaaaacctgatctctcactcacattaactcttcatgccctttgtccatgtttttattgtgacatttggcttttcctaaaacctaatttatttggggggggtatgaaaaataaaaaggtttctgggaaccctgttatggaatcagaggtttgaagaggggggtgacaacgagacctctttcaaaatataggtctactactgttaggtgtgaaagagaacagttggaaaacgaacaagttctgtttttgttaaagctttatttggtgacactccctcccaagaccaacagaattggggaaaggtcccaaagagaggaatccaacttttaaaaacggcctcattccatacctgagtcaggctgctctctggctcgctcgctctcctctctaacaagagttatgtgttctttctgttctagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagca

SEQ ID NO: 11915 - DNA, 14515 bp, Human
tattagagatggggtttcaccattttggccacgctgatcttgaactgctgacctcaggtgatccacccacctcggccttccaaagtgctgggattacaggcgtgagccaccgcgcccagcctagaatttatctttaaaagcaatatacagttgaggcaggaggaagcacatgagaaccacgacagccaccccaaagagatggacaccatgccaaggctggaagcttttgttaataatcagacctgtcctaaaaaagaatgcggggctgcctctgaaggaggtaagctctctcttcttagaggtgcctcggtgcttgcctttttgggatactgagaagagggcttctgcctggggctgcagacaggaacccctgacctctgagatgccttgcagctcagagtctttaatacatttattccagaatccttcgactctgagattttaacatgttaagattccttagctggattcaaagactccttgggggctttgagtggaagtaatctctgattccttgaccctgaatcacagagtctgaagcttttgggatctgagatttcccacagtccttgtactcaaaagactctgagctgcagaagcctacccagacagagaggtttgtcaccaccaccaggcttccccacaaccactaacagagggcagggacccaggtgattgactcatttgctgggtactgggatttttttgctccccaggatccaggcaagcacctagaagaaagaagatactcaatgcattcattcatgactgaatgaatgaagagtccctaccctgtcccttcctctccatactgcgtccatccaatagctatcattaaactactaaagaggacttttcggagggtagggagcctcggctgatcagaaattgagccactgtcgcccagattatttagggtttcctaaataatctgcctcactgaatcactgaattccctactaacaggtacataccccacagatggacatcgcacagggcaaggactttgttcagctctcagctgtatcctcagcacctagaacagtaatgaataccctagcttaacttggaggtcaaggagctatcagtttgcgagggttgggtaggaattgacagtgagacctgaggcctgtgggaggggacccaaagagggaggggatgcaatagggagggggccaggggtgacaaggattgaggaagggagagaggggggaaaaaaagcaagggatgccttagaaccacatttcacagccaagggaacagaggcccagaaagggaaagtaacctgcttagggtcacacagcaccttgctcagtggagagccaggttttccttcctgtgcactcctccaagcccagccagaccacctgaagttccccaggcatctctgcctctattactccaggacttgaactttccgggtgccgggcaggtaccgggtctggtctgctccctctccctctggccatcgctgaggttgaggttttttgaatgtacaagtatggagaagggcactgccttcagaagcctgaacgtctcccctgagagggagggggtgcacaggactcaattgtttcagcttgaaaatgggggagagcggggagaaggggagatggctctgcttggggcagagcccctgcggggaaaggggcgcctgaaaggacgtgcgattcggagtgggctagcttatgcagagagcctgggggtgggaggaagctcgcactctgaaggacacgctgatccccgtggggactcccggcgccccgcagcccgggccgccgagggaggcagtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggtgaggggcgggagacgcctgcgtgcgtgcggcccgggggagcgccgagcaatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttgtagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggcctcgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggtactttagacctctcaagtgtttgggaccctctggtggggtcccatcatctcctccccttcccttccagaccctgctcagtccagctagctgtgggcacagccctggctaggtgatcttgtattttctttgtgggactgtaactcagctaaccttggcctgagggctggcatttctctgtggcaagatgggctgggctgtgggaggctggcctgcttgcagtaacttgccttcccccattcctgctgctgggttcagtggggctgcccttctccccagtagcgcatttcccttcagagattcatgtgcggatgggaagggaactaaggccaagaaggctcctggagtcccctggcaaatatgtggcaccccctgggacctgagtcaggcctgcttcccaggctggaagcccccctctgccggccggtggagatagttcagcctcctgcctgccacgtcaccaccaggagcaggcgctaagctgccgcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggattttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccaccttcctccccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatgatgtagaggaggataatggcccgaagggagagagggagtgtggaagtatcccaggaacagagactgtcccaattggaggccccagagagggaactggggcttgtccttggggccactgctactgctggggcttggggaggaggcctgagggcaaccctgaagccgtggagcagatggcctgtgtggcagtggctgtcagattggagggcagaatggaatctgatgtggctccagcttctttgaaggctgagtgcacatctggccagctgctggtgatggggaagggggtcactgctctattgagctatgtgtgactcacccttttccctagtatcctgtccttgtgctatgtcaggaagcctcctccccagccccaccgagtcttcaaaggagttggtcccccaggagcttttgtcctggggatttcccatccgcactgggagcactgtgggtagatgggcattccaagttcctgcccagacagaagccatgggcatggagacctggacctttcagcttggaaaagggagactgaggctgagtggacacaggacacacacacactctcagggtcacccttggggcagcaaagtggagcatcttggctccccatttaatgagtgacccaactggtgactcattaacatcccagagcagaatgaaaggcatgggggcggggcagccctccggctctgtccctcatcccttgcccaggcatctgggtttcctgcagattctcagctcagctgctgctttttctcactggaaaagggctcccagggctatgtgagatcagggctgaccactctataaactgatgaggaccccaggtctggccaagtgaccctgttttaccttcgttcaggaagagctgaggcctactgtgtactaggcacgggagatatagtggcaaccagattggctagcttttctgtcctggaggccacagcctacttaggagcagaaatagttatgaaataaacacacaaataagtggaagtgttggctggccgatgcaggaaatcaataaggtggtctggtggtgacttgctgggaatgcttctttgagtagggaggtaacagaggcctctgagaggctggcagctctgagtcaagtctgggattcctggactgtgggctctcttgcccccatctccaggggacttgtggcagccagagagctgagggtggttgttggggaggaaggccttgggcttcaagaccaccctgtctgtgcaatcctcacaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagctagagaaagaactcaaatcctttttttaaaattatttttattttgagatggagtctcactctgtcacccaggctggagtgcaatggcacgatctcagctcactgcagccttggcctccgggcttcaagcaattctcctgcctcagcctcctgagtagctggggttacaggtgcctaccaccacacccagctaatttttgtatttttactagagacggggttttgccatgttggccaggctggtctcaaacttttggtctcaagtgatctgcccgcctcggcctcccaaagtgctgggattacaggtgcgagccaccatgtgcggccaagacccagaatccttaaagcaaccttgggggcaggcagtgttaccttcatttcacagtgaggaaactgaggctcagcaaggaggaagcagagccaggcctcaggcccagatgcctctgtcttcagttgaagattagatgtagggttaataaatatttttgagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgcaccactgcactccagctgtaggatggagtgggacggaccttgtctcaaaaagaaaaagataaaaaaaaattaagggtggtcatggggcactccctgcccagggcacagctgtcccccaggtaccagggagggtagaaagcccacctcagagcatgcttccaaaatatctgacaagtgctagagctgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctcccttgcaaccaccctgggtagtgggcagaggctcagagagaagcaatgactccctaaggttccccaggctcataagtggtggagttgcaattagacctcaaggtaaaaacataatagccgcctttttgtcaatcgagagatatttttgacttacccaaaaaaggaaactttcgtgtcattctttccttggatgccacaaatggttctcacctgcagaatcgatccagacttgctgcccagagagcttggagagataaagctggagatgaagtggggcttaggctccaaaccagggacaagtggagctcgtactggtctgtgctgtagaccctgggagttcctggagaggggtcactgtctctctcctggtcctggccctgatccttccccagccccttctccagtggctgttgtcccacccccttctccccttgttcctctggtgtcttcctggaaccctcagtggagaccccaccccccagatatggggtagattgagttaggaaatttgaggcggatgacgtgtgcaaggtcatcggggtgggaagagctgggcctacctcgaatgcctgtctcatgaccccctgactctcaggacctcaggcctagttcctgtgtggccttgccagggaggtggatgttatcctgaagaatcctggacccggatgctgccattcactcagcccacagccatttactgtcctctctcctgcattgagagccagggagagcgctggacatgggccccgccctcagggagctccaagccaggtgggagagacaggcagcaccagactgataacaggaaggtccagggaggcaccactcatcctgtgggctcgggaaggcttcctgaaagaagtggtttctaaagagccctaatgggagacaggatggccatccaggatataagctgttctgtgaggctgtctggagagtggggtggggcgtgccaagggatgtggctggaggctgccacggaggcacaggtcatatgttaaagagcttatggttggcttccaagagctgtgcagggccatggaaagatgtttgtgtgtgtgtgtgtgtgtatgtgtgtatatgtgttttaactttttactatcgaacattggaaaaataaaagtagattagtgtaatgaaacctcaagtgtctgtcgcccagcttcaagcattatcagctcatggccaatagtgatccatttatacccactaattcccccctgcatctgattattctgaagcaaattccaggcatcctatcactctggacaggttttcagccccagagtgatgtggacatagttgtccttagatcagtctttctcaaacttgagtatgctaagaaagcacttggggagtttgtgaaaaggaatccatgcccactcccagagattctgattcagggggtctgggctggggtcaggacatgagcatttgagataagctcctgggtggtgcccatgctgtctgtccctgaactgcagctgggcagtgccgggatacgttctcacttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcactactgatggctcatatcaggccctggaatgctggcagatcgctggcagatcactgtgcagacagcgccaagtggcaggtgcattccgtgctgacccgggaaatggttctggctctggcagccctggagaagtagcagctgcaggacctgaatgagagcactggacctggagccagtcttcagcctcttcgcctttctttctttaccctttttttaagatgtgaatcttgctatattgcccaggctggactcaaactcctgggttccagcgaacctccttcctcagcctcctgagtagctgggactacaggcagggctatgggcatgagccactatgcccagctcccctagcctttccttgcacgctgacctcatgctacatccagggctacaggtacaaactcaggcacacatttagtaagttgcctggctttgggctgggctttggaaggagattgtggggatccttgcccttaggtggcccgaagtgttggatttgtagcaggggaggaggaggcacccaacacggtcctttttgacacagtcctccggttggatgcctcatggtccttagggctcctgacaccgtaccttagggagagagagggatgcacggaacagagccagtggccagggaggcagaggagcagaggatattgggctggaggcccatttctgctgcctgctggccttttaacctaggacaggtcatttttctctctgggcacgtccagctttcctctgccaaagattgtgacctgggggttgttggttcaggaagggaccccttacctggctgagcaatccagcagtagccaccaagatgtacatgggtctgcagaagggccagctgattcactcccatcattgccacgacagagtttcagcaagactgctcagagtcccagggccatcctgtgcttcggctcaatcattcagatctctatcctcaaggggctttgtctagaggtggagacttagggatagggtactcagtgctcactgtgttccaggcacctggatcattctgttccaggtgtgccacgcttgtccccctgcctcagggactttgcactagctgtcctttctgcctggcaggcggttcttgtagatgtttgcagggttgctttttgtcatccaggattcagcgtaaacgtctgctcagagaggccttccctgaccaccctacacaaccagtccctctcccacctcagtttctctaccatgatttctcactttactgactccttagcactatgaaattacccacttaagacttccctgcctgcctcccctcttagaatggaagctccatgaagagagggtccatggctgtttgtctattgcagcaaatcctgcacctagctttagcatcatgcacatatcgaggaaggctcccaggaggaggtgatatgggggctgctttaaagggtgagtaggcatttctggatcagaataatgctttgagtgcaaccagctggtacgcctttgtgttttgctcttcctatgtgccaaatacttaatatgtacaattttatccaagcttcctaacagcttggctagttaggtagggattgtccccatcttacaggtgagataacaggctgagcagttaagtgagctgcctgaggccctacagtcagtgggggccgagctgggactagatcctagtcggttgggtagttgcttcgccacataggaagggcaggagaggcccctaacacagtgcctggaacccagcactgagcacagattctagtaatgaaggcatgttaacttgcatacgatctgtatccatctctcttaatccttgcaatagccccgttaggtgggaagtcatcctaactttacaaggtgtagctcagagaaggcagagactgggctggaacccaggcctcctggccctgaagttcagc

SEQ ID NO: 11916 - DNA, 15222 bp, Human
cggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatcttttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaagaaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaacctttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcatcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgatgcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctcttttttttttttttttgagatggagtttcgctcttgttgcccaggctggagtgcaatggcatgatcttggctcaccgcaacctccgcctcccaggttcgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgttgcccaggttggtctagcactcctgaactaaagtgatcctcgctcctttgcctctcaaaacgctgggattccagacatgagccaccgcacccaccctctttcataatttttttttttttttcaga

SEQ ID NO: 11917 - DNA, 42232 bp, Human
  misc_feature (1)...(42232): n = A,T,C or G
ttttcttgttagctagaacacccagtaccacgttgaaaagactggtgagaggggacatgcttgccttgtgtcagactttaggtggaaagaatgtagtttctcacaacagaaacaatctattgttagctgcagaatttttgtagatgctctttatcaagttgaggaagttctcctttattcccagtttgctgagtttttatcatgaatggatgttgaggatgggcacttcttttatttgtgtgtgtgtgtgacaggatctcactctgtcacccaggctggggtgcaacctcacctctcaggttgaagcgatactcccaaggagctaggactacagacgccaccacatccagctaattttttaaaaaacttttgtagaggtggggtctcattatgttgcccaggctggtctagaacactttggcctcccaaagtgctgggattacagccgggaaacactgcacctggccaagggtttgcacttttaaaatgttgctttaaatcaatctattccagaaattgtaagcaacataaaacgtaaagcaagggaagtgagtatgaaatagcaactgttacaaaaactgcctactataatcaatattcttgtgcaatgcagtatgctgagcgtgggagccccataacaatcacttgcctccatggtctttggcaaatagatattactttattttttattttcgagacaaggtcttgcactatcgcccaagctggggtgcagcagcgagatctagctcaccgcagcctccacctcctgggctcaagccatcctcccacttcagcctcgggagtagctgggactacaggcgcgccaccaaacctggctaatttttgtatttttggtagagacggggtatcgccatgttgcccttgccctcgaactcctgacctcaagtgatcggcccactggacctccccaagtgctgagattacaggcgtgagccaccgtgcccggcctccaaatagttaagactttaaacttagaaaccctattcacaacacaaactccgagtgaagctcagtggcattttcttacaggaagaaatacaggagttaatcaacaggtatgtgggatgttcccacatcaaatcctaaagataaaattttaactcagttcctcctgcactatctgattctccccaaccttgtctcgcagaaaccacagcgcagcctgaaaacacgccccgtctagattcaacacctcatttagaaattcaatttctcgttgctagttggatagcgtttgccaagtaatttgaaaaaataaaaataaaccaagtggtctgggatttaaacaagataatgtagggtgaaaaaagcactcaggtgcggacagccatggagcgtgacttcctgtgcactctttccccgccagctcaacgccagagccgcgcgctaggcggagactgttggtggcggaggccggagtcgcacgcctacgagactgcgcggacccgcccaaaaggaaaatggaagtagtggcgtgaggctgcgacagtgaaggttatttttctctttttaaagggccgctagacctcccgtctaaaggaagcgcccgacgggcctccgaagtacacgcccaggcccccacagcgcagccgcccgaccgcctctcttcacaccggccagagtccaccctctcccactttcccctcccctcccctccccgccccttccctccccaccccttcgccccgccaaccctagacccggcatgcgtgcgccgaccttttccttccgagccgacctctccaccttcggcgcctcccaatgacaagcggcgcggagcattgtggtcccgtgcgcaagagcgaggccgagggcagaaaaagaaagcaaaagactagggcgagtcggtagagcgggccccgcgcatgcgcaagggcggaggcggtggtgaaaaagggtggtgcgtggtctacggcgagcggagtggggcggggtcgcgcgccttggcggggagtccgcgagccaggaggggcggggggtgaatgaaggagcgggcggaggaggaagtgtcatggcgtcgggccgtggagcttcttctcgctggttctttactcgggaacagctggagaacacgccgagccgccgctgcgagctggaggcggataaagagctctcgtgccgccagcaggcggccaacctcatccaggagatgggacagcgtctcaatgtgtatccttttctgttcgccgccgctcacgccctgtttcccttgcccggtcgccgggcctggtgccccgcgaacatggcgccgccggcctcggccttcgctgggcctcggcgccgcggtcagggaagtaatgttccggctcgggcagtcgcgaggggtcagcagaggaagggaggaggagataggaccccaggaatgcgggccaggagcctgcgttgtgtaatctgtttggggcagcgcgtggtggtggcggcgggggttgggagtgtggctcaggcgaaagaggaattttagggattattgcagaaaaggggcggctccctggacttgtccctgaccccgaagggtttgagaggtaggagggttagcgatgctgaaaggcctaagtgtttgccgcagcctttcccggctctcgtcgccggcttgatggcggctctcttctaccttgggagcgtactggagttctttatgttcttggcgtggttttgtatgggtgtgtgcgcgcgcgtttcaactgtttcattttgagtttagttagtcgtagccattgataaatagttccagggccctcagcgctgttagagtgaaaagatcagcagttcttattcccatttatttggcgtcaagcctattctcttcctgccgccccaccccccgcgggcatttatttctttatttccagtttggggtttggatttgaatgggaggtattggaaaagaacctgggaattttccatcaaaattgttctgggaatgagatcttgcttttgtcagatatttcctaaatattacgttccagctctcagcttacaataaacactgcgattgtttatatgcacaggttttatatgcaccattctttcaccaaattcaacaaaaatgtaagtactagttgtctgtttttactgtccgcaaatttgagggtaaatcgatacgcagaaaaaaagttggtcattgcgttgttggatttagtgttctgaattaacggtaaacgtatatcacgtgataaatattttgcttcagatgcggtgtttttgtgtttttaaaatttatgatgaattaaactgcaaggcactgttaagctctgccaggccttttaagctaaaaaagaaaaacatttatttctttacagagttattacataggttttcttcatttaaattctatacttaacatttgaataatttcagtagtgatgtacagtggaattgggcaagcctggtcgttctgtgatacatcttaattatgttggactcattgtttaaaagactgtcaattgagattaaattaattatgacattcttttgaaagagctatttagtagaaataattcatttcttcatttgctaacctagtaatttcttaagatgtcaacgtttctgtttatcacgttagcatcagttgtctcctaaaattttgggtgattcaaacgtccactcttgcttcagatatagtacgtcaggagtatgtttatgtattattagtaaaatttacacctgaatattaaggtatataacctgtaaaccttgacaaatagagtaatggcattttgttgaaatgttaatttcatttatgaaagatacgagtttggtgtatgttgagtaacacgcatactgtgttgtgtgtgttaaagaaaattgcatattgtttagaaatgtttaactctgctttaattctgtctttatttgttactttttatcatagttatttttagaatattattctgaaaggtatgtgtagaaaaatggaccaaagaagactttctgctatttgtggatagtcattaggacttatttgctaagaaaacaatcctaggaaagatcctcagaatattatttttgaaatggaaggaaaggcttcatggtttagattgagtcctaccttaatctcttcggatcctatttcatttatcagtttggcatacaggtttatcttggaccacaagtattttaatatacattttgatctcttgaagacttcttctatttcttttttaaatctgcataattcttgctctgttgcttctagtttcctagttatttcttgtgcataacatttaggtcagtgatagtgttatggaagagaaaggaagccattggtgataacatttagattaagggaattcattataaattgtctccaaaggcagtagtgaactaatgaatgttaatataaatttggcattccttacgtaaccctggataataatggtagaaattacaaatcaaaatagttctgactattctttatatggctacagatgtcccatttgccgaatcaggcatacttttgtacttccaataaatgatctagccacaagtcttcacttcttttatttattaattttttttttatttttttgagacagagtctcactctgtcacccaagctggagtacagtggcgctgtcacagctcaccacaacctctgcctccctggttcaagctattcacctgcctcagcctcctgagtagctgggactacaggtgtgtgccaccactcccggctaatttttgtatttttagtagagagggggtttcaccatgttggccaggccggtcttgagctcctgacctcaggtgatccgtccgcctcggcctcccaaagtgctgggattacaggcacgaaccaccgtgcccggccatcttcacttctttgttttgagccctccttataatttgtctttatggcgtggttggcgtgctttacaacaaataccctgcttaaagccagaattcacaactttagattgtcatttgcattctagctttcactattttacttaaatgttttccttcaataaaaaggccaaggtattaattttttattaccttctttaatgtcttattgtgtatgaaggtaaacttcagcatttttacgtagagtcagtaataattgaaatctgttcatttctgttttgagaaatattattatacccttcatatctgttgtctttttttacctttgctattataatatcaaaagtggtttttatatttgtgtcagtgcacttgcatcaattgcaccgcctcacttttatctttcttcccccctgttcttttagggcaaagggggtggtctgaaattgaatgtgagtcgcttttaaatttgtattattccacaccagtgggaaatttttttctatatactgaaatgtcatggtaaactttaaaaagcgtgaatcttcaccagagtaaactgaacaccgttcagcaaattaaaccctatgaaataacaagcttaaataagttaagatgctagtgacaaactatatctagtcttatagtaaatattaataacatccattaactgtgtgaaaatatttttaaatgttcaggtgacttaattgtattttcccacattgacatattaaaagttttaaaacccccaaaagtaatgtgctgctgtattaatatttaagaataaaatcagtatcagcatgttttggtgacccagaaatggtctcttatcattgagttcttttgtcagttactcagagttgaatagctgtcagcagtaaatgacttttatatgtagcctaattagataaatctacactttgttcactagatgcaatgaggttcatgtaattggaattaataaagaatggccttgctggatcaagctcaaaaataaatttagtaaagtgtaaaagccctggagccaaaagtgatgccaaggtatatactgagggaaagcacccaccccccaagtcacacttaagtagatattgacccagcttctcttacaaactcctaatttggtcttttgtgatgcattttttttcttataccagttccaggtctcttaagattaggttgtaaagagcacacccttttctaagtatttttgttggtcatggtctgttctcatagcacatctccaatttatttgatcttttccatcttctcttacttccattgcctctttcttgagctctagcaatcagaactccatgtataatatgcaagatttaaagctattgtagggcctggcatggtagctaatgcctgtaatcccggcactttgggatgctgaagtgggcggatcccttgaggtcaggagttcaagaccagcctggccaatatgatgaaaccccatctctactaaaaatataaaaattagctgggtgtggtggcacgtgcctgtaatcccagctactggggaggctgaggcaggagaatcacttgaacctgagaggtggaggttgcagtgagccgagatcacatcactgcactccaacctgggcaacagaacgagactctatctcaaaaaacaataataataataataaaaataaataaattttgctttttctcctgttcatttcaattcattgttatactctggtcatgttttacagaagtcaaatcagcatatgtttcattgtgaagtctaagcaggtgtttatagcttacttctctttctgccttttagtttaataaagcaataattaatccaacaataatcttatgcccaagatccattagcattacttggaaatactgcagtgctgtccagtagaactttctgcatagcgcaagttttgtgtatctgtgctcttcaatgtagtaggtactaacctgtaaatttgagacgattagcctagatgatttttaaattccttttaaactataaattacctggttgaaattttattaagatctcactatgccaggcactttatatttgtcttgttttctcaggtaaagtattctcctaaggaagcagacgcagttaccaagtgacttgtccgaaattaaaactattacgtggctgggatttgaacccaagtcctttgcttaatcccaaactgtagttctcactttttcctgttctagtatatttcagaagtagagcacagtagcaatttatgccagtgatttgtaagatttataaagtaaacaatgaaaaaacctcagatttttatttgcccgcctcattgcactaaatccaatgaggtcctctttataagtcccaaattcctctttttcaactatacatcagtgttagcatttatgcattgtgtatcactgtttttccttagggtgctttctctttgctttcatgtgactgtgctctgtcaggttttaagactcagctgaagttgctactctttcataaagcattccccagataactctcttttccatttgtgaatttatctctctgatcttacctttgaatcttattcacatccagttgtattccatctatttgggagtttatagtgctgtagtgtaactgtacatatatgagatgagtgttttctttttaattgtaaaatatataaaaccaccaaacaaatgtatagtggattattataaaacaaccttgtaatcaccaaccaagtcaagaaatagaactttgccaactaccccggaatgtctccacgtgctcaactcagtgtcgatcccctccctccaaaagtaaccagtattcttttttatttttttgagataggagtctggtcttgtcgcccaggctggagtgcagtggtgcaatctcggctcgctgcaacctccgcctcctgagttcaagtgaatctcctgccttagcctcctgggtagctgggattacaggcatgcaccaccatgcccagctaatttttgtatttttagtagagacgggttttcaccatgttggtctggctggtctcaaactcctgacctcgtgattccccccacctcgacctcccaaagtgctgggattacaggcgttagccacctcgcccggccccagtattcttactctaatcactttctttatagttttagcacccaactctgcattcccaaataccatagaccttgctcattattaaaaatttggtaagtctttgaagtctctcagtatgcatgtttcccctccatctttttatgtcaactaagttgtagctgttgaaggaccctagagtgtgtgacctgtagagtttccaactgtctgaattttgctgattgtatactcatggtgcagtttactgtgttccttttttcttgcattcctggaaaaattgatgattagatccagaaacttaatcagactcctgttagatcccttaggcaaggctatagatggtgttaatgttctttggtcagaaggtctaaagtctggttgtctctctttgtagtgttagtggctgctgatattcaatgcctgggtcctttcattcattggtgatactctaattctgtcatttctttcttacaaattggtatttttgtattggaattcttgattcatctcatatggacacccagtggcacgtatcatataggataattactggatttttgccctttttgtgatataattcacatattgtacatttcacccattgaaagtatgattccgtggggtttgtgggtttttttaagaatattcacagaggtgtgcatcaatttttagaagtcttcactacaccaaaaagaaacccccaaccccgcagtcatttctccctatttttcccccagcctattaatagacatttcattaatggaatcctacagtatgttgtcctttgtgactgacttctttcacttaccgtgttttcaaggctcatctatgttgttgtatttattcagtaggttgtttacttttcttgctgtactacccattattccactgtatggctagaccacattatatatatatgttcatcagttggtgggcatttggattgttagccactttttggctaatatgaatagtgctcttaagaacatttgtgtacaagtttttgtgtagacttgtgtttttggtttctcttgggcttatacccaggagtagaattgctggatcatatggtaactctagattccaataatattggaaacttggatagctgccttttttttttttttttttttttttgagactaggtctccctctgacacccgggctggagtgcagtggcacaatcatggctcactgcagcatcaacctcctgggttcaagtgattcccccaccttagcctcccaagtagctggaattacaggcacatgccaccacacagttaatttttttaattttttgtagagacaggggtctcaccatgttgcccaggccgttcttaaacccctggactcaagcagtcctcctgcctcagcctcccaacactcagcctaaagcagctctttccagtgtgatttgtcactttaagcaccactcttctagtcttttcttacagtctttgtgtgaactgaatactcttcggttactcatttttgtgagatattagctttcctgaactttaaaaaggtgatgtaccttcagagtgctttaataatttcacagagctcccttttctgttattttgtgtaatgttcagaagtgtagcagcttactttctgggagtttctggccctcttcccctccacatttttagtttctcttttcccttcttcctatcttgctgattgtgcttttcctcccaatggtttctcttcaaactggagtcttggaagagaaccttggaagatcaatttcaaaagttcgtagaagttagcttcggtcttttaatccttactgtaggtctcttgcatccatctacttattggactggcaaaactcccagtgctagctgctcttctcacattggcctgccatgatttccagtgaatgtcttttggctctttgaggttcttcttatatcaagtccagcacatgccccattcctttgcatcttgttgcactgtgctgtgtatgttgacatagtagcctgttttttcctcattcgtatgtgttaggaattccctaggaatggcttgtcatgtgatttggttgtagctatccatggggttttggttttgctatcttgttgctctgtttttctgtggggatttaagtatcccctctgcagccatcaactcagaattcttcaggtaaatcactaaaagtttaccttcattcagaagatgatacactcatttccagtgggacttcatctttccagaagtatttataagtacatttaaatgacagcctattgtggtcccactggaaatgagtgtaagatgaagttgattttttaaaaagaataaatcacttgaagtttctgttaaataaggaagctgtgggagagttcatttattaataggcattacaaagaatatatgatatttttgattgattttctcaaattaattctgaaagctactctagaacttccccagaaagctttaaatgttattttgaaacatgctgctcttatctgcctaattacagggatactgacttcagtgactctgtattattatagaagtcttatgaagtattcctgaagcggcttaaaatttttttttgcaaaattaaatgattgtgaaataactcataccttttctctgcacacacagatacatgtatattttagccttggtaatttatatgcttctctgtggtcctggctcatcctttttgttgagtcatcgcatggcaggagtgcaagagagtgaacccagtcctgcaagatccaaggcgctttcaaaccataacaaattctaaacttaggtgtatagagtagaataggttaatatattaacaaatgtgcattgagtgtttgcattggccaaggcatgcaaatgtctcagtataaaatcagacagattttatatagtttataaactgattttcaaggccattgcagaacaggagttttgtttttagtattaatagctaaaattggttaaggtaattttttaagtgaaaatccaattagataactgcattttattataaacatacatatacattctagggagtacatatttacacatgttctagggattaggggaaatgatggaatctccttaccactctacattttctggtgttaacctaatattttacccctaaataagctaaggctctgattgttagtgacatattacatactctttatatggctatacataaggaaatacatgtaacgtgaatttttctctaaattatttggagctgatacagaaaagaaatggatgagaactgtagaagttcacctatttgttattaaaagttaaaagtgaagttaaggcttgtgcttagtgacaatatgcagttcaagcaattctcctgcctcagcctctcaagtagctgggattataggcatgtgccaccacacctggctaattttagtagagacggggtttcaccatattggtgaggctagtctcgaactcctgacctcaggtaatccacctgcattggcctcccacagtgctgggattacagcatgagccaccatgcccggcctcacattgtatttctttttttttttttttttttctgagacggagtttcattcttgttgcccaggctggagtgcaatggcgcgatctcggctcaccaccgcctctgcctcccaggttcaagcaattctcttgcctcagcctcccaagtagctgggattacaggcatgcaccaacactcccggctaattttgtatttttagtagagccaggttttctccatgttggtcaggctggtctagaactcccgacctcaggtgatccgcccgcctcagcctcccaaagtactgggattacaggcatgagccaccgtgcccagcctatatttctatttgacagtgacggtgtgggctatagtcatttgtatccaccagcaaatagaattactattggccattcacactatagtaattccttccaaaggcaaatgtgcactttcacactaatcttaaactgagggttcatttagaagttgaaaaaaaaaaatgggaaagatgtttcttctgtggccaaaaatcggaagataatgaaactttatatagttccatgcttaaaaagaaatacctgagagggcaggaagagaaaattctgagggtttgggggtaatctttaaatgatgcaaggattcagagaggataccaggtatttccacacccccaccccaaggtagatatttcagttactttgtgttgctatagctccatgattggggttttgaatgcctagtgtgagtaactgtttgagttgatatggttcactttatgtagacttaaatatctgttaaaattatttttgttacccaaacaaattaataattttatgaaacaattgctttttaaaaaataatataattgcataatgtaaatgccaaaaagttatttgctgtttaagaaattgatattctcaaaacaaaacctgattctacttttaaattaacaaatgtgtgataaagttacacatggttaagatgcatattgtttattaagtatttgttacgttatgattaggctttcggtttccttgaaatttcttttgttagtgcatgcacactacatctatggagatctggccaggcatggtggctcacacctgtaatcccagcactttgggagacagaggtgggaggattgaaaccaggacttcaagaccagcctgggcaacttggcgagaccctgtctctacaaaaattaatttaaaaaaaaannnnnnnnnnnnnnnnnnnnnnnnnnnnnnnnnnnnnnnnnnnnnnnnnnnnnnnnnnnnnnnnnnnnnnnnnnnnnnnnnnagggtgaggcaggagaatcgcttgagacccaggaggtggaggctggagcgagctgcgttcacgccactgcactccagcctaggtgacagagcaagaccctgtctcaaaaacagagagagagagagagagagagaactaataaatagatgccttttttttttttttgagacggaatcttgctgtgttacccaggctggagtgcagtggtgcaatctcagctcgctccagcctccacctcctgggttcaagtgattctcctgcctcaccctccctgagtagctgggattacaggcatgcaccaccatgcctggctaatttttgtatttttagtaatggcagggttttaccatgttggccagcctggtctcgaactcctgacttcaagtgatccgcctggcttggcctcccaaagtgctgggattacaggcatgagccaccccgcctggcctaaatagatgtctttaacgttagctccttaaaaaaaaaagagagagagagagatacaattcatataccgtaaaatccacctatttagaatgcataattcagtggctcacacgaagttgtacaactatcaccacaatctcagtttagaatatttttatcaccccaaaaagaaacctggttgctgtaagcagcagttcaccagtcccactccccttcccaaccctgggcaacccctaaattattttctgtctccatagatttgcccattctggacatttcatataaatggaatcatgtatatatggtctttcacgaagcatgttttcaaggtccgttcatggtgtagaatgtgttagtacttcattcctttttactgcagagtaattaatattctattcgtcatgtggctgtacctctttttatttatccatttatcagctgatggacatttgggttgattacacttaacagccattccactggctattatgaataatgctgctatgaacattcatgtacaagtttttatgtgaacatatgttttcatttcttacgggtgagagttacatgagagtggaattgctggattggtatggtaactttagactccaataatctttttggatagcttttaagaaacattttgaggaactgccgaactgttttccaaagtagccataccattttgtgttctcaaaatgtgtgagggttgcaatatcatcacttttctcgtcttttttttatcgtagccatcctaacagtgtgaaatgatatcccctattctatgcattgtcatttttatgttcttggtggtatttgcagcacaagcatccagtttattaatatttttcttctgtaacttgtgttcttgatagcatatctaagaaacctttacctaaactagagtcataaagatttatttgtcttttcttccaagagttttatagatttagctcttacatttaggtctgtgattcctttagagttagtttttatgtatgatgtaaataaggatttgaattttttttttttttgagacatctcactctgtccctcaggctggagtgcagtggcgccatctgggctcactgcgtgctccacctcccaagttcacgccattctcctgtctcagcctcccaagtagctgggactacaggtgcctgccgccacgcccggctgattttttgtatttttagtagagacggggtttcaccgtgttagccaggatggtctcgatctcctgacctcgtgatttgcctgccttggcctcccaaagtgctaggattacaggcataagccaccatgcccggatctttttttttttttttttttttttttggtatttgaatatacagttgtcccagcaccatttgctgaaaagagttctttctcccactgaattttcttgggattgttagtgaaaatcaatggatcataaatgtaagcatttatttctggactctggattctattccatccccttatgcagaccacatagtcttgattactgtagctttgtaataacttttgaatttaggaaatatgagtcttccaactttgtgctttttcaagattgttttggctattcttagtcccttgtatttccatgtgaattttaggatcaagctcatcagtttctacaaaagaagctgggatttttatagggatgacattgaatctgtagataaatttggggagtactgccatcttcgtgataatctgttcgaaggaaagtggccttttgtaacatttatgtagtatatttgaattcctgtgcaatgttaatgttcttgtttcacaatacaagtcattttttgtccttttggttttttaagagaagggatctcactctgttgctcaggctagcctcaaacccatggactcaagcagtcctcccacctcagcctcccaggtagctgggacttagagtggtattttttagtatttattgtaggctgttaggagctgtgtctatataagagagagtagatagagccttaactatgaaatactaagtatactttataagttggtttttttcattttttcttttttgttttttttcagacagtctcactctgtcacccagcctggagtgcagtggtgctcgctgcaacctccgcctcccaggttcaagcgattcccctgcctcagcctcccaagtggttaggattacaggtgtgtgccaccatacctggctaatttttttgtattttagtagagacggggtttcaccatgtgttaatcttgaactcctgacctgttggtctcaaactcctgacctcaggtgatccgcccgtcttggcatcccgaagtgctgggattacaggcatgagccaccacgctcggctgatattttttcttttttagaaacattcataatgctcaggtactccccactaaataattttttaaatgccggttatgttaaccattttcagtatattgtttaagtataatgtagttactctatggaagtcaagccttattctcttaatcagtactgcttttcagcaatattgaatactgatattttggggccgttattaacccagctttcttttaaatgtaattaggtatcttaacatccagcttgaagattttttttaattttttaatataaatttgctttcatgtcagtctttcactcacataattatttgagtaagaaaactaaaatgccacactgggttaataacattttctgcaattccttagtgctggtgtttctagtgcagcaaaattaaggatttaaaccactttttaacaatgtgctggaattttggtttgataggctcacacttggcaaatgccaattaacaaatgggcattttgacttattccacttcctttgtcagtttgttacctctcttgtctttcctctactttccttttcttattctaagaccttctttctataagcctgtagtaaggttatacaactatcccttctcctgaactatagccttagcaagaaagttccaatttctgagctgtaatagtctgactagagcttgctgaatatttattaatgaagtccgtttcaaggcactgaaaatagttatcctagtgttagtcagggattggataggggggtgtttagggcaatgggagaaatggcatcactagcctatagaacctaaagatgaaacacaagaacaggttagaatgaacctgttggtaatagtaagtgaaaagcaaacttggaatccttttctttgcttctgttggggttttcctggattgggagatttaatgttgaagagtaatcagatagctttggctagttcttaaatacaaatacacccacaaagtgtttgcacaggattaattattaatattaagagaataaggactagaatgattcattgaaactgaatacagccatcttgggtgacttagaaattacccagactttttgttaactcagcctgaccttgcctccgctatcaaggttgaagccagcagcggagagtgaagaatatcagcagtaagggtatcaggagcagagaggggagacagcagccaggagtgggcaggaggagaaaaaatggagaaggaagggagtcagatcaagaagtaggaatggaaacaaaaaggaataaaaaagagaaggagtgaaaggaatatggatgtaaatcactgaagtaatgtcaaatatcataaattcagtgtttggatatgcttgcttagactgcagcaggaccctccaagaattaagtttacctgtgaaaggaagaaggtgagcaagagagaagggaatttaaaaaatacacttgttaaattgttttttaaatttaaaatcaacattaacatgcacaattttaaaaatttttcaacataataataatatttgagtcatattactagggagcactattctaagtcctgtgtatattggttcatttaatcctcacacaactttacaagcaggtactattaatatttctcccattttacagatgcagaaactgagccacaaagagaataagtaaattgtctaggctagtcagatcacagagccaagattccacttgaggcagcatggctatggctggctctgtcatctctacctccccgtctccatgatttgtatgatatatttctatagagaaattccacaaatatctatttgtctcattttgagaatgttacatttccttgaaatagttatatatctgctagagtaacaaactcatgacactattcagagttcaaacaattctaaacactattcgcatcaacttccttttacttttttccctttaatttgagaacgtttattaaactaggtccaaaatacaaaaataaatagtgcatggtccctgtcctcagtgaactgaatctcagtttgtaattgtttgattacttgaaccaaaccagctgtactcctccaatactagtgtgaattatttggcttgaaccaagcttgcatgtgccagtgaatgtttgttggcttcaaaagtatgctcacctttaaaagctttggaccaactagtaatatttctgttacccaaaacatttggaattcttttaagcctcacaacaaaatcaccttccatacaaaaagcagtagtacctagtttgatcaccttccttaatcatccttgaaattaaagcctcacatggatactcacaaaatatttatctaaaaaggtgttttgttttgtttttacagccttgatggaggaaaatatttgcaggttatagagaaggaaatgtgaatggaattagtggatttcaccaggaactttggaagagtgttgggaattagtgtttagctggaaagtatttcttgatcagtgtctttcaggcaagtaagagaaattctggatcatctgacaggaaggaagtttaagtactaaattcggtctaatttgacttttgacctgagcctctattgcttcactctgacaaatagttttagcatttgaaggcttgattaaccattcccctgttagacatgaataatgacaataaatgagagattgtgggaaactgagagtgtcttcattttcttgaatgtcttatgtgggcatcagctctcagatttttatagtggcatttggaatactttgaatttaatattagtgccactatatattatacatattcattcaacaaattgaacaacagccacatagtgctaaatcctaggaacacaaataaagaactctgttctgtgttcaagctacttccagactaaattactcttttgagcattctcaatttttctaatcctttccttgttgtaattttaaaaggaagaaataagttgaaagtgcaaattaaaattattcactcattttaagttaacattatttctagttcttgggagccaaactctattttacatctgttataaagatttaccagaaggaaaacttcttaaagtcatttttacttcatttacacatctgcaaatgcagttggactagaaaggtccttttcagatcctaattccagtgattaagtttcatattacattttaaaagatctcatactgaaaggatccactgtccctctgtcagaaattttcttcacctccagtttggcattgtttctgtacggtaattgttgacgccccctgcaagacatagtgaggctcaaatgttcatctcttgaaaaatgggtactcaaatcttgacatttagaaattgtcttcccatgggaaatttcttgaatgtaatcttaaaacattatttgagtttattttatgcctattttctaagtccacagttacttgatttattattaacttttggggtacatattcaaacttcatgtttctctgtcttagtatctttgtagtgcttgtgttcttatatttctgtcccaaggacctaatttactaagctaaaaaaaaaaaattgctaatttatggatctctgattggcaaagtttctactatattggtttatattacatgcttataccctggtggtgtagctgctttcattattgctatagttaagtaatagagataattaagtaacagttttatgttcagaatcctccttactttgccctctaggtggtttttctgttccttcaacaagatagtgaaggtatcttcactatcttgtgtggtagttatagccacacaatgaatcattgcttgattttttaaaagagtattagaaaatggtgactctgtgcctagaaaaggagtatagtgggtatacttgatccgcttttcatctttttttttttttttcaggtatagcatcatctttttgcttattttcttctttgcctccacaatgtgcaaattaatattatttaaactttctctttagcatttttagtatgttcagtcaacttacttagtatgtcttttcccttttcccctttgttctatgtgcaaaacgagtaaaacagatttatagattagttctatttaatgaataactttattaaaactattacatcaatcttgtcatagcccaactcacagttcatactattaatattgcattccttccttgcacacccgcccccccttaaaaaatagaaggtttgggctgggtacaggggcttatgcctgtaatcccagcactttgggaggccgaggcagatggatcacctgagctcaagagttcgagaccagcctggccaacatggtgaaaccctgtctttactaaaaatacaaaaattagccagtgtggtggtgcatgcctgtaatcccaccttctcagggaggctgaggcaggagaatcgcttgaacctgggaggtggagctttcagtgagccgagatcacaccactgcactccagcctgggcaacaggagcgaaactccacctcaaaaaaaaaacagaaaagaaaagaaaatagagggttttttgaaatgtatttgttcttaaatgaccagagttttatcttttctgcagataatatcgtctactgcattatttttggctgcaaaagtggaagaacaggctcgaaaacttgaacatgttatcaaagtagcacatgcttgtcttcatcctctagagccactgctggatactaaatgtgatgtatgtaaatactgggttttttatttttctttgtaaatttgaaactttttcataatgtaggcctaacaaaaatacacagttcaattagtggtgccttccaaatgctgcttgttttattacctcttaggaatgcaatgccaggaagcagtctggcagaaaaacatataatgtatgttcatgaatttggatgtcattctgaattatagaaggctttgattccaggtgctttgttgattcaaagatacttttgtttcatattttgttgttcagagttatgatatatgtagagggtaagtcctatcacctccgctggaagctgtatttgagaccagaatataaataactccttaaattgtcaacagatgaaggaacagaaaatcttctgaatttacccctagatgagtagtctttttaaagtattgttccttttttaatgcatgtactactgcttatctctctgatacataaagctgcattttattttgctttcatgagcagcatttttttagtattttaattttcctagagtaatgttcctttccagacaactttatcatcaacattgtaatagaccttatttgaaagaactgttttaaatttttctgacatcttaagaaataaggagaaataaggaagttagaattatggccctttaaaaattttcggccaggcacagtggctcatgcctgtaatcccagcactttgggaggccgaggcaggcggatcacctgaggtcgggagtttgagaccagcctgatcatatggagaaaccccatctctactaaaaatacaaaattagccaggcatggtggcacatgcctgtgatcccagctacttgggaggctgaggcaggagaatcgcttgaacccaggaggcagaggttgcggtgagctgagatcgtgccattgcactctagcctaggcaacaagagtgaaacaccgtctcaaaaaaaaaatttttttttctagcatcctgagttacttaatcaggaacctttacccattgaatgactaacagattatattaattcaaagtcccgattaatttaagcttcaatggaactatatctgattttattaatggcaagttttatcataatgttggctttaagggagtaaactgttaatgtagccattaaataataggttgtcattatttaaagataattcctacagtttatattaactgtacaaattcagaactatttcttggggtactgtttaaataatagaaattgactgttttaaaaatcagctcaatgacctttcaaagtagagcataaataaaataaaaggtacttttactctctggctttagaaatatgtccttacaaaaatgaatataggtatattcatatcagtaatatagtatttccttatcactttggtcaattgtcatgatttcagaataggacagcagtaatttttcatatcctttatttccagagtaactgtaatagagggataatttcttgaaattgaataaggaggttctctggtatttatgtccccgtgggtatgagatacattattttggtatgtttggtcatttctaaggtggcagggaagttaattctaaaatttactcagtgacttactgtgacttttgaggaattaccacatgaaatgtcctagagtgagtttgtaagccaggtttgggttaaaggcaggtttgagttggatgtgtttaattgacttggtgctacctgtctttaatatctcttgaagcaccagtgcctaggttgtttcactttacagactgtgcacatctccttatttcaattaacttaccctctttcatattggttaggtttttgttttctggtgtttgtttcctgttacagaaagtaattcagtttaggcttgccacagaatacaggctttctctgtcaccctcagtttattttctccatattttcaaactactgtggttcttttgtaatcaacctgtaattctcacaagatgtaacagtcatgcagtctagtaatgttatttttattttaatcaatttgataatatttttatctgacaggcttaccttcaacagactcaagaactggttatacttgaaaccataatgctacaaactctaggtacgtacttacatcagataatggctttttgtgtgtatttcactaaagcattctaaataagtgaaaagatttctgaaataattgtattattgaagaaagttattttaaaacaggttttagacagaataaggttgcctggttataaggaaattacttttctagaatttaatttcatttggcataattaaattgaatggtaaacgtacccttcagtatgatttcttaggttttcaggtagttgaagtactgtgcttcactctggatttgcactggagagtaaaatggtcctttagggttgttttatatgattatgatgtatacaaacctacacagcaatccttattctcctcgagctgccagtcagtattttatgagtatatcaccttttttattttatttatttatttatttatttatttttaagacggagtctcgctctgtcgcccaggctggagtgcagtggtgccatctcggctcactgcaacctctgcctcctgggttcaagcaattctcctgcctcagcctcccgagtagctgggactacaggtgcatactgccacacctggttatttttttgtaatttagtagagacggggtttcaccgtgttgcccaggctggacatgaactcctgagctcagggaatctgcccactttggcctcccaaagtgctgggattacaggtgtgcgtcaccacgcccggcctatcatatgatttttaatgtgacatagtaattatttaaatgttggtcatccttttctaaaggttatatctttgtatgcaagttcatttactgtcaccattcaccttactcaatttactgaaattgaggcctaagaaagtgatggcttatctaaagtcatatgttagttctggaagaacctactaggatgtggtaggaagaacatgggctttggggagatccaagttaaaatctgtaggcctctgacttgctttgtaaacttgggcaaaagttcctttacctgttgtacctccattctgtagaggtggaatagtatctgagtcatatcgtgaatttgtcatttttttaatttcattactccattcccagatgttgaatagaagtgcgataaatcagtcacaatttcccattgtgacagactcttcgttacaaaactagtttgtgtgaaatacatatgcagttgaccctcaaacagcacgggtttgaactccatgggtctacatggatttttttcaataaataatattggaaaattgggaatttgcaacaatttgaaaaaacttgtaggtgagctgtagcctagaaatattgaaaaaattggatatgtcatgaatgcataaactatatatagatattagtctattttatcatttactgccataaaatatacataaatctatttttaaaagataaaaattttaaaaagttaggcacacaaacagacaatatgtggctctattcgcagttaagagaaaatgtaaataaacaaatgtaaaggtacataaaattaattttaataatacgtaactgtactgctgtgataattttgtagccacctcctgttgctattgcagtgagctcacatgttatgagtatccacgtaaaatgctgtgtgacacctgtcatctctgaacagtttgtctctccagtaaattacatattgcggtaaaagaggttctggcatatttttaccgtatttagtgcgatactggaaacttggattaataccatgggacccatacaaagtgcctctagtgatgccagaagtgctcccaagaagcagatgaaagttgtgatgttacaaaaaaaagttgaattgtttgatatgtactgtagattgaggtctgtagctacagttgcccatttcaagataaatgaatccagtgtaaggttcagtgtgaaagaagaaaaagacatttgtgaagtcatcgctgcagctataccagcaggcacaaaaaccttgcactttatctcatattgaaaatgaagcttttatgtgaatgcaggattgctgtaagaaaggcatacctatggactctaatatgattggagagaagcttaaagcaaagggaaggtgaaggatctaaagccagagaatttaatgccagcgaaagacagaaattgtggtgtatttctgtaaagttacaccaggtgttgcctgcctctcctgcctcctcttttgtgtcttccaacctgagacagtaagaccaacccctcttcctcagcctactctgtatggagacctttatgatgatccacttccacttaatactagtaaatacattttctcttccttatgattttcttaatagtttctttagcttactgtgttgtaaaaatacagtatatgatacatatacaaaatatgtgttgattaactgtttatgttaccagtaaggcttcagcggtaagcaggttctgatcaacgatagttaagtcttaggggagtacttggattttcgactgcatggggatcggcacccctaggccctgcgttgttcagaggtcagctgtaaattatttgaagtttctataaaataaaaagataccaaaaaagtgagggtcttatttcttccaaatccaatgatttagcatgttattgttttactatacaaaattatataaatttcatttaagtaaaaaattgaaaatgaaaaatcataaatcattataaaatatttagttgttatataaaatcgtaatgtaatatccatattgtttatgacatattcttaagcacagagaatgaaaagtgttattttaaggggaacattagaatttagaagatatgcctctatggctttaaagtattctgcatatttaattacagtagaactatatatagaccacacaacaactttataaatctagattacccatttgttaggattttatttacttactgcttctgaagacaaccaaatgtgatcttcacttttaataaaaacagaaaccctgccacacctaagggttgattgcacgttgatagcttttaaacatttcatctttggtattagaaacagtagtttaagcagtcatgagacctctatggtttgtcatatgattttgattattaatgaagtatggttataaggtaactggttgaaaccctttgatctagagtgccgtatcatttaaaagctcgtttctaccactgtggcccaacagttatgtttatgaaaactgcacttttcatgtcttctgaaagaaagctttggaatattaagaaagatattacgtagttgaattccgtccttaaattgtgggaccagcttaacagttgtatttgccaggaatttaatttgtttttaagataatcccgaatcatttataattcagaattttgaataaatttacccttggtcttttaactttattttcataattgagacattgtatttgaaaaattatatcttgtcattggaaaagtaatgagaatgtcagtgatgagaaacttataactttggatttttcttaataatgaagaatatattatacgtttatggcatttctcaggcaagtactgtagtggtaagagattggaaaaaaaagtgcttatcatttcaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggtaagaatctcatttcactaaaactccggagggcttccaagtattaggactctatccatcccccattgagctttgctagtcccatttcagtcaagtgtgggccaatagtgcataggttcagaaaataatattaattttgggtttgtgtcaaactttgactttttgaaaagtgataacagttgaagaattttgaggccaacctcagacctttcagataaaaattgcctttgttaaaagatttgtcagtacggtggctcccacctgtaatcccagcattttgggaggccaaggcaggctgatcgcttgagctcaggagttcgagaccagcctgggcaacatggtgaaaccccatctctacaaaaaacacaaaaattagctggttgtggtggtacacgcatgtagtctcaactattcaggaggccaaggtgggaggatggcttgagcccagtagttggaggttgcagtgagcccagatcatgcccctgcactctaccttgggcagcaagagtgagaccctatctcaaaaaaaaaagttatttttgtggggggagtgttttgcccatattcatttgggcaatctaaaattgatttaatgtatttttcgagggtctttgacattactaaaagtggtttcctttttgtaacggagaaataattatagagcataatacatttagtttgtgatgtgcctgttaagcgtcttgtttataaacaggagtactttttaaaaatattgctttactgcttgtaaagtatctggtagtatctgatacagcattttctactcctaaatgaatcctatatatctgttgtatccctagaaatattttttacacagttgcatgttgttctgcttcttacttccactttcctgtttccatttcaagtgttaatgtattcatagcaaccacttgggacttgtaatgtgccattttctgttacttcctttttgaaaatagaattttgcagtttcattcatttactaccaagtttttttagatttatcctaaacaaaatgagtacgacttttgaaaatcttttgtttttagtatttacctaagtattctcacattttattcattctaaattgaattcattttatacctagtgatttattatgttagtggctacaattttttaaaaactgtctgatagtgtcattaggaagtagacatctgaaaatctaatttgtatttttttgtagtagcacacgttatcatttgtaagctagaacatatttaactgtggttcctgttcttcatggttatatcagcgtgttttatagcacattttcatctgaatattacagtatagcatagaattatatgcataactagttgtagttgttgaattaaggaaaaagggttagttttttctaagaacttgaaaaaggttaagctaaactttgtaagcattgtagccatataatttgctttaaattaagagcctattgaagaaacattagttgaaggaagtactagtatatgtttaaaaatattacttgtgaatattaacttaggaaattggattttcaggttactgttgtgaaatttgagtcaactttaaattctttatcagagattaatattttttgtacaagttctcctacaactaaaaattctagagacatgaagtcagtttacttgaaaaatgaaatagtaacttttaaaacatttacaaaaactacaaatttgatatgtcatccaaaacaaatatttagaccagattatttgttgttgttaatgttaaaatgtgactgattctttgagtacaaaccatatatatgtttaatgtcattttgtctgactaacatttcaggtaactagaatatatctcactccattttaaaagtactgtttcatgttttagtgtctttttgttttctttgctcttttacaacttttagctaacagcatttcccctctattctctgttgcacagtgactgtttctggatcactgaatttagatacatgcctaggtgaaaactgctaatggcattttttaattattattttttccttctctacgtatttttattcggagggggaggggaaaataaatttgatttctgtgaagtctttttctcccctctggagatgagaaagttggtattatgctactttgctgcagaattggctaatgtcattttacagggaccttcacttctgtgatttctccttccctccccaccaggaaagtcacactgcctccaagacatctgatgctttgacactcttccttagcacaactctgctaaaccccaatcccttttgtaaaacctttatgttgatgatccacatggggcagcagggattacaggtgccatgaataaaaaataggggagggggaaagaaatttgaggacggttagaggggtggagttgagataaactgatcctaggtgagcagaggggaaagatatgtcagtgcttgtggatgtaattgggaaaaagggaaactataacaagagcatccctgttgggaagactaagaggcagaataaggggagggaaaacttttcagtgtcttaagctaattaaaaattgcctttctgttgggtatcagtgttgaagcattctgatcctccctagaatacctgtatctttcctaagttagtctttaattagattctgtaatttgaactaaaatacagtggagcctcctgtatctgtacccgtatgctgtttctaggtttattctctgttgatgcttaatagcatgatgaaaaactgagcagtttgtgctctgtgttttgtggggtgggggtttgttttgttttgtttttgatggaagtatttaagccaacttaaatatgactgaggattaagtctggcaggcaactctttgtattttgtattagacttcaaaatcttttcttcttcttcttcttttttttttaaatccaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtagtaagtaaaatttactttttgtgtacaaatctttgaagtttttgttgtgttgagaactttttgattgtagcacgttaaggctgatagtattgtcttcgtttttttttttttcttacagcaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttggtaagtataaagctatttccagtttacaattatagttaaatgacaatttttaaaatttcacgttgatccagtcttaactttaaaatactcattaaagtttttttaataaataaaatttatgtaatttgaaattttttttcagataatacccactagtagcaagttaaaagtagtcaagtcctatccatgcctggatttgcataaacacaatttttcctttttttttttttttaaacaaaaaaaccttccttttcagtttatatagagtaaaaaatggtatgtgtttatggctgaacagataacatttccatcattgaaactgaactggaagaatagtcttaaggagcctttaatatataattctgttctagatttattaatgatttaaatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatggtaagtagagaaaataaatttttaagtttggaattatctaagttggcagttgtctgaattgacaatagaaagtgtcagtacactatcagatgaacagaatgaaaacaacaattcatcagcctaaagaaaaaaaaatagagtctggaagctgtgctcatacctgtaatcccagcactgtaggaggctgaggcaggaggatcacttgagcccaggagttcaagaccaggctgggcaacatagaccctgtctctacaaaaaaaaagttaaaaattgactgggtgtggtggtgcgtgcctatagtctcagctacttgggaggctgaggcgggatgatcacttgagcacgggaagtcagggctgcggtaagccttgaaggcactgctctactccagcctgggtatatattaactaccaccaaatatctaaagctttttcaggacttaaaaaataaataagtaaggtttagaattccataagctgacaagataagaatagtgatttaaagtatactaattctgttgagttttaaatgtgtatactgaaagttgagtgttaactgtgaagcagtaaacgaaagggattttcaggggattgtgtttcttgctctgtattaccattgttgccttacattgttaaatatgaatacacaaggagaaattgtgggtgtgtgttctgttaattaggaacgtggaattttggggatgttttgatgagaaattcctctggttgagaagtaaaagaagccggccagaaatgggagattcttgggattagggcattttaaccacgtactgtagatttcagcaagaaaatagataacacttttttttttttttgagtcagtctcactctgtcgccaaggctggagtgcagtggtgcaatcttggctcaccgcaacctccacctcccgagttcaagcaattctcctgcctcagcctcccaagtcgctgggactgcaggcacgagccaccacacccaactagtttttgtgtttttagtagagatggggtttcaccatgttggccaggctggtctcaaactcctcacctcagatgatctgcccaccttgtcctcccaaagtgctgggattacaggcttgagccactgtgcctggccttgttttgtgttgttttgttttttgagacagatactcactctgccccccaagctggagcgcagtggtgcaacctgggctcactgcaacctctgcctcccaggttcaagcgattctcctgcctcagcctcctgaggagctgggaccataggcgcatgccaccacgcccagctaagttttgtatttttagtagagatggggttttgcagtccacctgtcttagcctcccaaagggctgggattacaggtttgagcctctgtgccccacctgatgtttctttaagataggggtctgcaaagagtaacactattttagagtttgtgaactataaggtctctgttgcaactatacaactataccattgcagccagaaagcagccataggcaatttgtaactgattgggtgtgactgtgttccagtaaaacttttgttgacaaaaataggtggccagccatatttggccaattatccatagtttgcctgttcttatttgtgaaatatgcttctttgtttcatccttttctattttgttttccacctggaaaaaattatcccagaatatatatctcatgctgtattattgctgcatgattataatgtttttcttaaattgttagaggctttttcagagtttatccagaggaaaggaagtcttcaatgagttgaaatgacatctaaaactcagtgagggcttatctgttctatagcttgaaaaatcaggttatctaggtcattgttttagtttaatagtcactagattaagattaggtaggcaaaatttttttttcggggggggggtgggggacagagtctcagtcgcccaggctatagagtgcggtggcgcaatctcggctcgctgcaccctccgcctcccgggttcaagcagttctctgcctcagcctcctgagtagctgggattacaggtgcctgccaccacgcctggctaatttttgtatttttagtagagatagggttttcaccatgttggccaggctggtcttgaactcctgacctcatgatccacccaccttggcctcaaagtgttaggattacaggcgtgaaccaccacacccagccagtaggcataatcgtaataaaaatagtttatatacctggtgctgaagtaaaaagatcacagaaaagtaatctgccttttatcctgtctttaggtcagaggttaggttgtggtttatgtggggttttttgacacaggaggagctacctcatttccattctgaaaagtaaagtttgttaatttggagagcaattgaataggaatcttggagaactgatatgttaagactttcaccatgttttgcagcagcttttttttctgtgtcagtcacaaaaaggcaattcaaaattaaagacatgaaggtgtggccgggtgcagtcactcacatatcttgagcacaggagtttgagcccagcctgagcaacatggcaaaaccacgtttctactaaaaatacacacaaaccgggcatggtggcgcactcctatagacccaactactgtggaggctaaggtgggaggatcacctgagcctgagacgtcaaggttgtagtgagctgtgataatgctactgctctccagcctgggcaacagaggaaaccctgtctggggggaaaaaaaaagacatgaagatttatctgaattgtagagtgaagtgatactactattcttattacttactgaaataattcacttaatgattgtgttccagaaaagaacattggcttagacagtagctttgagagagaagggcctctattttaggcacatactgtgatttttgtgcatatagctaattaattatgttaatggattatttaacagattcttttgttgttctgctataaaatttaatacagtaggatacttaagaaaaacaaagcttacattttgtgtacgagattttggaccagaacttgaagtgtatttaatgttttacaaccaagttgttaacagaaattgagtcaaaacagttttgttaatgttggacccaaaagtagaaaaatagtctttttttttttctttttttttcaaatgaggaagtaaaggtctgggcattagggtttttttcatccaaactggatgaaaaagctcatgagactttagcagggactagtcatgacattgtcaaggaaattacatcttgaaagattaatggttaaattatagcttgtctgaagtgtcgatcttaacattggcttagaatagtttacaaaaaagcttgctattacaaaatgaacctgtagtctctattaatagaggttcccccagtattgaggtggaattggcattattaatattatataatattctgatgtatttgactgatgaatatttgagagtggctagtaactattaatgacattattagttcatcaaaaccacactactttggaaaagtgggtcatttgattgtaatcagaattttaagaaagttggtagaaatttacaatgaagatagtttgctaatatattaatagtgttgatagctaggaagtatatttggaggaattttcccctttaaaaaaaaagtctgggtgtggtggctcacacctgtaattccagcactttgggaggccaagataggaggatcacttgaggccaggagtttgagaccagcctggtcaacatagcgagaccctgtctctgttatttaacaaaaaaaagaaagaaagaaatgcaaaatattgcatagttccctgtataccctttagcttctcctggtactaacatcttacataacaatatatgattatcaaaactaggaagttaacattggtacaatactgttaactaaaccacagatgttattcagtattccatatttttccctattctaggatcccatgttccatttagttgacatgtcccttcaagtcttctccagtctgtgacagttctccaatctttccttgtctttcataacactgacacttaggagaataatggtcattttatacagtgttccttagttggggtttgtctgatgatttctcattattatgtcgaagttatccattttgagcaagaataccatagaagtaaattgggtcttgcttggtgcatcatatcaaggggtacagtatgttgatacgtcttataactggtcatgacaaccgtgatcacttggttacagtggtatccttaaagtggtttctgcactttaaagtcactattttttttctctttgtaattaatacatttcatggggaagatacgttgggattatacaaataacgtttttcctcaaacttttgtccactaattttaaagaatcttttgatagatcttgtctgtgacaaaaattattgtggtgtttgcctaatgaagattttttttttattgggggggtgattatttttaatgctactagattttctagagattctaattaagcaagtaaaatcaagagggaaagtaatcgttacaaaaggattcagctttgaaaatgccggttgagagttgtgtgtacttctgtgtatgctgaggatttaataggagggtaaaagtgaagtagatgaactcctagcattcctttttaatactgcccacttaagagaaatttaaatcctaaaggcaccttctaagtttcaaatttaaattttatttttagagctaacacatgagtttctacaaatattggagaaaacgcctaataggttgaagaagattcgaaactggagggtaagagaattgacagggtttaacagaatttcagtcttttatgtaacatttacatagctaaccagtttgaatttttgtggttaaataatctttgcagtattcctgaataattcaacgtatctcaagttacatatactcacatattcaactactgagtccagtggactttgctaaagtacattatacttttaaaaaattttttgcagtgattatgacaaaagtatcctcttcattttacaaatggggaaactgaagcctagacaagttaaattactttctgaagtgctgggctaggatttaacttgtatctgattctaaaatgggtgttttcaattttttatagccttttatgcctctaaggcatttatttactgacaacataaaatcttgaaccccaggtcattttatttccatatgtttaatatataatgtttttaatatataacttttataagacaagaaatttgcattaaattattttgctatatcactgcttcttctgtgttttattttaataggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctataaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtattttcagaaccaaagcaaagggtggtttgttcactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgagtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagacagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccga

SEQ ID NO: 11918 - DNA, 10718 bp, Human
gaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaagacatttaccacaacctggaaatggctggtgacagaaaagtcctcagggccacagcactctctgcggtgggaattcaggtgccttgcctgatggtgacaaggctggttttgcataaacagctctctgaatcacacccagatgtggcttctgacttgagtggacccccatgaagagctgcagagggggctgggaaaagacaagagaatggagaaaatgaggagaaaggaaactacagagtgagatagagaacagatctgacaggtgtgaccacagcagtgtgacatttatgaacagtgtggaaacaacggcaaagcccctgaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacagtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcagctctccagcttcctctctgaaatcccagtcccaaaatccagtttcctggccgcctcctggctcaggtcaggatctggcagaggaggtttctcagccggttatgttggggcctgcttaagggcgggggtgagaaaggtccccaggctactgtggatcctgtgtctgacttcagatccccttttcccacagttatagctccacttttttgggacaggtggggagcaaaagggtgcagaggtcaggtcttgaaatcaccaggggatttccgggtgaggtgggtggtgagaaaggaaacagcaagcagggctctggcagctgctgcagacggcttcacacagggacgcgggctgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccagtgagtctgggagtcggggagagctggctgggagaagagctactgaagccccagggtgccaccctccccgagattccagaagagcaaaggggccggggatgaccccatcgccttctaagcccaacgggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttccacctgtgtccttggtcctcccgggctccctccaccaggacagcccaggtcccgattacagccacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgca

SEQ ID NO: 11919 - DNA, 84761 bp, Human
ctcctgtccctgtctggttctgtcattatcacaggcaggtcacttccataattgcttacctcattgtttaacatagtcccagctcaaacagcctaagatactgggcctggtacatccagaggagagtctggaagtgggtctcttgggaaggggcatgatggagcagttttcccaagtggagtccagcagccccaggagggttgagcatggagtggtcagttgtggagaccttgctgggaagttcctggtgggaggttatcactcctaccctatagggccttcacctgatggaggcctggtacctcgcaggacagatcaaggtagacacagaagccagagtatccttaggctattctgggctcagggaaaataactggcccacccttaattagagcacctaggactgcctgcctatttctgagccttggctttcacatctgaaaaccaaacaaaatcagtcaaaagaacccttgacctgtggcccacccagcagatgctcaacacagacacacggaatgtggaataaaaggagcaaagagaaaacccaggggatggggaagcactggaagggaaaatcattcaccagcaaatgagaacatagtacgaggaggcttgaatcatttctgttaggagagagtgccagccgcctcctccaggaagaaaactctaaagggtcaggcctcagggaaataaaatgatctataccatccatcagttcctccaacattcagtccatccatctaccaatccacccacccatttacccactcacctgctgctcatccatccatccatccatccacctatgcatccatccatccatccatctatgcatccatccatccacccatccacccacccatttacccactcacctgctgctcacccatccatccatccatccatccatccatccatccatccatccacttatgcatccatccatccacttatgcatccatccatccatccatccatccatccatccatccatccacctatgcatccatccatccatccatccatccatccatccatccatccatccatccatttatgcatccatccatccatccatccatccatccatccatctatgcatccatccatccatccatccatccatccatccatccatccatccatccacttatgcatccatccatccatccatccatccatccatccacctatgcatccatccatccatccatctatgcatccatccatccacccatccacccacccatttacccactcacctgctgctcacccatccatccatccatccatccatccacttatgcatccatccatccatccatccatccatccacttatgcatccatccatccatccatccatccatccatccatccatccatccacctatgcatccatccatccatccatccatccatccatccatccatccatccacttatgcatccatccatccatccatccatccatccatccatccatccatccacctatgcatccatccatccatccatccatccaccaatttatcatccactcactgattcattttacagcaaatgcttatgaatggggatgggtgggtgatggttgctttttctgcagtctccctaggccagttgtcccttccaaagaatctcaagggcatgggagaaggtcctggctgatcgtgtcagggacaggaaactactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggtaagcgggtgacgggcgcctggggaggtgccggcggtccagagcccggacagtgtggggtgcgtgggacgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactgattcattcattcagtgtgaattggactgagagcactgccatacgcgggaggcgctctttagcccgcctacctgcgggcccgtcggggtcctgggcagatcaggtgaggccgtgggagtagtgggcaggccagatggggcctcccttagccatgggaggttggtcgtccgcgctctaccctgttgtgtgcgcggtcccgtttgcccccttcctaagctggccactggctggagggtcaaggaaaggagggagagttggctgtgggtgagagtggggtgagggtgcaggaccaccgggattagcttccccgatccgcgtccggcaaagcaacgctgtggattgaattcgctggagcacgtggtgggcatttgcccctggaagaaggtcagtggtggggctgaagtctatggtgggttgcctcagaattgagtttggggactgctttaggaaaactgagcacttaccagtggccagcgccaaattaatcactgtggggagaatgcaaagtaaccaggcgtgtttcacggagcccaggggctgctggagagagaggccctcagctgacccaggaccccggtggacccctgcatagaaccatagtaggtgcgagtggatgcctgctgaatgatacagagggaaaggaaggagcaggctgttagtccagcggtgggtcacggtgggggagagggaagacccagttcccctttaatcctacaggaagagaggactccatgctatggatcaattctagtcatctgaaccttaggcagtgggaggagagtggcagagtgggctttaggcaggagggaggaactatgcagcaaaggaggaactatgccctcttccatttccaatgggcaatgtgaggtattccccctttccccccaagagggcagaggggacaaagccctggctagagacaccctgtcccagctctgcaagccctcacctgggggaaggtaagagtttggagtgccaaggtcttggggagatgaagggaaggaagagatgtgagaggtgcttggggggctttgctggtttggtttggcagctgaagctcatgtgcttcctttctgtagagtgaagccccctccactttttttaatgttagagacagggtctcactctgttgtccaggctggagtgcgatcataactcactacagcctgaactctcataccaaaccttttttttttttttttttttttgagactgagtctcactcttgttgcccatgctggagtgcaatgctcgatctcggctcactgcaacctctgcctcccggattcaagtgattctcctgcctcagcctcccaggtagctgggattacaggcatgtgccaccacacccggctaatttttgtatttttagtaaagatgaggtttcaccatgttggtcagtctggtctcgaactcctgacctcaagtgatccttccgtctcggcctcccaaagtgctagggttacaggcatgagccaccacacccagcctcccataccctttttaaaataaaaatactatatatttaattgcacaaggaatatataaatatattctcaaagcaaaactgtaaacgctacagataaagccaagtcttttgacaccgcctcatcctgatcccttcaaagatataaccaccataattgatttggtgtgtttcctttgcagacctttataaatgcatgtccatatttatattgttttaatagacatatatatagttttccatatactataccctacagtacatatggttcttcatttggctttataatgtctatgaggcatcttggtgagctttccatgctgaaacttacagatcctctgcctatcttttaaaatgctatgtgatcttttgccaaatgggatgtttcatagtttatttatgtcctggatggatgggtgctaaggttgccaccattgttctttctttctttctttgttctctactacagtgcacagccctatatggatgcttttggaaataaatgtctgtgattctttcctagacaagagactgagaagagaatactgaggttgcagggcgaaaatgcattcaaattaaaagacaccaccgaactgccttccagggtggctggacaatttaccctcccgctagcagtgcaagagagtagtaactttcccacatcctaaccgacatttgatcttatcagcattttaatttttctcaatgtgattagtgaaaagggttatatccttgttgccttaatttgcatttctcgcctaccggggaagctgagcatctctctgggctcaggcactaggtcatttcttggcaggagtcagggagtccttggggaagggactacctgcccaacacagtactcctttttgcccctcaagccttctcccacttctgttttttccagtaaaggttcgggaagctcgttattttaaaaaaaaaatcccaaattagggcttgaatttccttgagtttaaaatttttttttttttttttgagatgaagtctccctcagctgcccaggctggagtgcagtggcacgatcttggctcactgcaaccaccctctcccaggttcaagtgattctaccgtctcagcctccctagtagcttggattacaggcacttgccatcatgcctggctaatttttgtattttagtagagatggggtttcataatgttggccaggctggtcttgaactcctgacctcaggagatccatccacctcggcatcccaaagtgctgggattacaggcgtgagccaccgcccccggcctaaatttttttttattttttgggacagtctcactttgtctcccaggctggagtgcagtggcgcaatctcagctcactgcaacctctgcctcctgggttcaagtgattctcctgcctcagcctcctgaatagctgggattataggtgcctgccacctcacccagctaatttttgtatttttagtagagatggggtttcgtcatgttggtcaggctggtctcgagctcctggcctcaagtgatcctcccacctcggcatcccaaagtgctgggattacaggcgtgagccaccgtgcccatcctgaagttcttttttcatctctatttgatttttcccaagacgccatcatttttcgcctggtattctgaggcaggaatgctttcttgctagctggcaccatctgagagttggcctctgatgcttcgtatcactgtcttgtccaattgtgtttttttgtaatatgacccaggattaactggtgcatatctgcagagaaaaatttattcccccatagctccatccttttcatccaggcaccatgtggtggggttgcggggcgggggaagccccagctttcctgtgaactctgtagacttagaaattccccaacatcatgttccttgccagtgctaaggctaaacaagccttcctcccacatccatgtacccccaattccagccagatgtaagcatctttgctctgggttagtgtgcaggctgggaccaggaaggttctcatgaaagtatcttagctggggccgggcgctgtggctcacacctgtaatcccagcactttgggaggccaagacaggcagattacttgaggccaggagttcaagaccagcctggtcaacgtggtgagaccctgtctctactaaaaatacaaaaattagctgggcatggtggcaggcgcctgtaatcccagctactcaggaggctgaggcaggagaatcgcttgaaaccagaaggcggaggttgcagtgagccagcactcccgcctgggtggcagtgagactgtatttaaaaaaaaaaagaggaattttagctggggtgatagaaaagctctatgtgtgactcctccatctagcaatttaactttaaaagcttagctagttactccatacagtgtagtgctaatcgtggaatttcagggagtggcaagagggcaggagagattttctggttttgttttgcaaaagggacatttccagggctgctcaaatcctgcagggaggcaaggacggcgggggggcgggggggggacctggagaggaggggaccctgaaggagtggaaggagggtctggcttgtcttaaagccatcccttcccagggcggcactagtgctctggggtcagggagtcgtgttactcagcttgagagcagtgagtgccggaaggaggggcgtttactgtaagtttctgcttctgctcccactcatatctgacttagactcgtttcttgagcagattgtgattcattctaaggtttttatactccctcatcacccttcttcacatcaggacaatcatcagaaggaaaatggggctgaaggatgactgtgtctggcccgggggagtcctggaggcttgagggtccttggcaatgacagtagatcagcccagcctgggccagcttgtccagccggtgcactgaccctgggtgtggcccatctgggatcacagtcctcatttcacagacaaggattcagtgcagaggcccagaggtaggggagagtcttgcctacagttccaggactggtcggggtagagcccaccacagactagacacgcagaatgtcaaaaaaaggcagctctcggccataccagttctccacttctctctctcccctcccaggtccacccaggggatactggggtgggggtgggggaccttcttccggtatctatggttgaaaaccactgggcattctcgtggccttgctggtggggagggactttttatacatggctcagtctagttactccctgaatgcctaagtcttttggtgacatgcaagtattcatgcatgcatgcatccagcagatctgaaatgagcagctgttctgggtcaggcatggctccagggacttgcattcagcctctgcctgtatgccccccgtgacaggatgcttgctccttgctgaggcagctcacaccatcctgggttagctttggcatttagatgatcttcatgatatgctgaaatctagtttctttttctttctttttttttttttgagatggagtctctctctgtcacccaggctggagtgtagtggtgcgatctcggctcactgcaacctccgcctcccgggttcaagcaattctcctgcctcagcctcccaagtagctgggactacaggtgcatgccaccatgcctggctaattttttgtatttttagtagagatggggtttcaccatgctggccaggctagtctctaactcctgacctcgtgatccacccgcctcggcctttcaaagtgctgggattacaggcatgagccactgcacccggcctttttttttttttttttttttttttttgatggagtttcgctcttgttgcccaggctggagtgcaatggcgctgtctcagctcactgcaacctccatttcccaggttcaagtgattctcctgcctcagcctcccaagtagctgggattacaggtgtgtgccaccacgcctggctaatttttgtatttttattagagacgggatttcaccatgttagccgggctggtctcaaactcctgacctcagacgagcccccccgcctcagcctcccaaagtgctgggaatacaggggtgagccaccacgcctggcctgaaatctagttttgaaaatgagtcacctccctgttcttcagaagcgcctctggcaatgtgaagactgtgactttgggtccccggagtctctcagccagtcacacacctgtcctccaacatttattcctcacgtagcgtgagctcaaggctcctcatctgcctgttctcttcaattcattcattccacaaacacttattgagcaccttctgcatgccaggaagcactccgggtgctgcgagttcatccatgcaccgcatagcagggtctctgccccacggaactgacattccacaggggtgacagtcaacagactgctgctagttgcaatgagaggattagaatcctgtagtgtgagagagacgggcggctccctaagatggggaaaacaggacttgcagacggtaacatacacacggaatgaaaagagggaggcagccagtgggagattagcagaaaagcatccaggcccagggggtaaaagccccaagaggctagaggaacaggaaggaggccggggtggctggagggaagtgagtggagaggggtggttaggagaaggtggcaggaaaggtggtagatcgtgcagacctttgtggactgtggtgaggtttttggcaggggagcaatactgcatgatagatttaaagttccttctgtctgctgtggggggctgggggattggggggagcaggcaggatgggagcaggaagccaggtcattgcattgatccaggggaggggtgagcagaggtgggaatgtgctttttcttcttttcttttctttttttgagacggagtcttgctctgttgcccaggctggagtgcagtggtgtgatctcggctcactgcaagcttcgcctcccaggttcaagccattctctcgccttagcctcccgagtagctgggactacaggcgcccgccaccacgcctggctaattttgtttttgtatttttagtagagacagggtttcaccgtgtcagccaggatggtctgatctcctgacctcgtgatctgcccgcctatgtagagacagggtctcactatgttgcccagtttggtctcaaactcccagggctcaggtgatcctcctgcctgcgcctcctattgctgggattacaggcatgagccactgtgcccagctggaatgtgctttcaagctagaatcaacaggacctgtggatgggtctggtgggagcgcagagggcaggagggaaatcagggatcctgtccgtatttgggagctcagaatctggctgcatggaggtgtcattttgggatgtgggaaaaaacaagcaaaggatagaacaggggttttggagaaaagttctattttgcccatgctcaagtaccagtgggggttgggtgttgaaatgtggagctctctacagagttcaagctgctgatatgaatctctgggtaccagagtcaactgtagaagtcctggtgccacctgggccaaagaccactccccagtagactcaccttacttctattaaccaagcccaagaccccctttttttggcccccacattatctgttcattcgttccaacccaagcctaggctcttttattcagcctggttacagtatatgctagttttcttttgctgctatagcaaattagcacacatttggtggcttagaacaacatgaaggtattgtcttatagccctggtggtcaaaagtctatgacaagtctgtaatcccagcactttggaaggctgaggtgggcagatagttggggccaggagtttgagaccagcctggccaacatggcgaaaccctgtctctgctaaaaatacaaaaattagccaggtgtggcggtgtgtgcctgtagtcccagctactcgcgaggttgaagcacgagaattgcttgaacctgggaggcagaggttgcatcaagctgagatcgcagcactgcactccagcctgggtgacagagcaagattctgtctcaaaaaaagaaaaaagtctatgataaggcagcagagctatttttcttctggatatgctgtagcaaaatgtttccttgcttttttccagtttctagaagctgcctgtgttccttggtccctggccctgcatcactctgaactctccttccatcctcacatttcctctctctcttttttttttgagctcgatctctcggctcactgcaacctccacctcctgggttcaagtgattctcctgcctcagcctcccaagtagctgggaccacaagcacccgccaccacgcccggctaatttttgtatttttagtacagacaggtttcaccatgttggccaggctggcctcgaactcctggcctcaagtgatccacctgccttggcctcccaaagtgctgggattacaagcacgtgccaccatgccagctaatttttgtatttttagtagagatggggtttcaccatgttggccaggatggtttcgaactcctgacctcaagtgatccacccattttggcctcccagagtgctgggactataggcatgagccacctttgagagacagtagagcatttcgttaaaggtatgaacttttttgtcagcctgtcaaggttatcccttgcttctgacactagatggtgacttgagcaagttaagttacctctgtgtgcctcggtttccccatctataaaatgggctaataacagtagctaccttgtattgtagggctggtgtaaggatgacatgagttaatatgtgtcaagtgctgagagcagcttctggacacagtgagtgctgtgcaaataaaggtgagccttattaggtgcctgttgtatgtggggcattatggatacagccatggagatgaaccagttccagtccttgccctcgatggggggcagtgtgggaaggggaatacagaagagagggtggccagtactgcgtaggggactgtctggggcctgcgggagtccagaggagcccatctttacttctgcctgggtcagtaggggaaggagcctccagagtttgcagtgatgaggctctgcaccacagatggtgccattgtccttgccagctttgcccagggctctggaggcagcagaaggggtcagaggttaaacagcacatcagtgctggtggttggggcgagcctggggcctgctttggaagccccacccagcaggttccccttgggttcttgggtcctccagggggctaagaactcctagaggcgtcgcccacagcttcatttcagccatcaactttcttgacggattgctgcctgccaggtacggttcctgctctcagagagtgcgtgcacagataatgtggcctccacacagtttactgaaatggttccaacctgctgagaccaggaaactcctaaaccccaccttcaccttcccagcctgggcaggcacccttcccactcttgattcgggtgagggaggccaggacgcagcggccaggccaagagtttcctctctctccaaacggtctggggggcatgtgccctgccccttccccacacatagtctgggagagggaggtgggcaaggaaacacaccaggctgggcgccaaggctcacgcctgtattcccagcattctgggaggccaaggcaggaggatctcatgagcccaggagtttgagaacagcctgggcaacaaaaaattagccgggcatggtggtacacacctgtggtcccagctactcaggaggctgaggtgagaggatcacgtgagcccaggaggtcaaggctgtagtgagccgtgttcatgatcgcaggactgcactccagccagggtgaccgcaaggccctgtcttaaaaacaaacaaacagacaaacaaaaagtaaatacacaagccccttctgagcaactggcctgaggctggcgcaggaacctaaggcacctccaagaggatcagaaagtcgaatactcccagggagctgggccccgcttccttttccttcaggtccactatatccatctctctctctcttttcttccttccttccttcctttcttcttccttcttcttttcttcttccttccttccctccctccctccttctcttctttctttctccctttccgttcctttccctttcgttttccctttccctttccttttccctttccctttttctttttcttttttttttttcattttcttgacagagtctcactctgtcgcccaggctggagtgcagtggtgagatcgtggctcaatgcaacctctgcctcccgggttcaaacgattctcctgcctcaggatcccgagtagctgggattacaggcgcccaccaccacgcctggctaatttttatgtatttttactagagatggggtttcaccatgttggccaagctggtctcaaacgcctgacctcaaataatctgcctgcctcggcctcccaaagtgctgggacttcaggtgggagccaccgcacccagcccactgcatttttctttgtagctgccattgtcccgtggcggctgttgctgcccgggaacgtacttcagggctgggtgggttttaccttgtctgagttgtagctaaggatgcagctccaacacttgcttcggccctggaatcttcaggatccctgcagtctcaacaattggctcatggagccggcacgggattgctgggaggcaggagggatttcttggtgggaagtgaggatcgaccagttgctaaattcggactcaaggcgtgatcttgctaaaacggactcgctctcctccatcctgtccacctccccaccacattaatgaccctgaaaccctttaatgcttccctagtgccaaaggcaacatgtcccaaagtcaccttctttctttctttttttttttttgagacagaatctcactctgtcacccaggctggagtgcactgatgtgatcttggctcactgcaacctccgcctcccggcttcaagagattctgctacctcagcctcctgagtagctgggattacaggcgtgcaccactacgctaggctaatttttgtagttttagtagagagggggtttcgctgtattggccaggctgttttcaaactcctgacctcaagtgatccgcccgcctcggcctcccaaagtgctgggattacaggcatgagccaccaggcccggcctcaaactcactttctggcaatggcagttctgagaaaaaaggttctatggccaacgaagtgggagaaacattgcagagttttctgactagctcccatacccttccttggagaatcaaatagtaagtaaccacatcaaggttctgagaagccccgtgatctaaaatggaaacctctcgaatggactccagtgattatttgtgtttgtttgtttgtttatttatttatgagacagggtctcactctgttgcccaggctggagtgcagtgttgcaatcatagctcactgtaacctggaattgggggctcaaacaatcctcccaccttagttccttgagtagctgggactacaggcacatgccaccatgcccagctaattaaaaaaaaattttgttaggccgggcacagtggctcatgcctgtaatcccagcactttgggaggccgaggcaggtggatcacttgaggttacgagtttgagacatggtgcaacccaatctctactaaaaatacaaagcttagccaggtgtggtggcacatgcctgtaatcccagctactcgggaggctgaggcaggagaatcgcttgaacctgggaggcagaggttatagtgagccgagattgcaccactacactccagcctgggcgacagagtgagactctgccaaaaaaaaaatttttttttttttttaaagagacagggtcttgctatgttgcccaggctggtcttgaactcctgggcttaagcaatcctcccaccttggcttcccaaagagctgggattacgggtgtgaaccgctgcgcctgtccgtgttctgcctatcatctgttaccatccggtagccccagcatttgatgaaacgctgtttgggaaatgacagtgaagagcttccatactcatctctttttctgactccctgactctctcttctgcctccctcttgcatttttaagttcccttaaattgcactgggctcccctggataatccagaagaatctcccatctgaaagtcagcgggttcacaacctcgatgccatctaccaccctgattcccctttgccatgtaaggagacgtatatgagcacatatgtgaatatatcaccctaggtcctggggacccagtgaggatggtatgattcttgctaactgacagagcaggagcgtcaccatcttggacaagcatcgccgttttaaattctccttgattaaaaaccgcctaaatccagccccaaaacatcagcctaacggctaacgtcagcatgaccataaaccacaaatgacacctccaaccagaaacattccaacacccccatccgactggagacatgccagccctgagataacctcccctctgaccagagacattcccagcatacagtaaaactctcctccacacagaaacattcctagcctgcgaaaagctcccatcccagaacccttaaatacccttagtccataaaaacaatgctgctgaacgaaattggccagaaggccttcttggttttattcttttttttttctttttcttttttttttttttgagatggggtttcactcatcttgcccaggctggagtgcagtggcgtgatctcggctcaccacaacctctgcctcccgggttcaagcgattcttctgcctcagcctcccgagtagctggaattacaggcataagccaccatgcccggctaattttgtatttttagtagagatggggttttaccatgttggtcaggctggtctcaaactcccgacctcaggtgatccacttgccttggcctcccaaagtgctgggattacaagcgtgagctaccgtgcccggcctcagttttattctccaaaataaacctgtctttggtaagccgcttttcatatttttttcttctttcttcaactcttacacaaaaatcatttcaaggtgcttgcctgtccctgagttccttccagccagggactccaggctccaccctctatgctgtttccgtgtccactgtctttgggttttatctccaaccctggggccaggcagcatggggccctgcacactctttctcagctgtgcaggaactggggaaaactcaactcggcacctgcttgcagtgggacaactgtgagaggtgctgcctgtggccagggatggagcctgtggccagggatgggtgtgtttaaagaggtggaggaggaggactttagtttcaggtagtctcttggtctggagctcaagtgagcactgagtgtggagagaggggttcagagtcctacagttaggaggtgactactgagttcggcgtgtggtggtatagtctagtggttgcttaggagcgagggtgtggcggtagacgcatagtcccctaaaacgtccatacattctacattgttaatttgggacagggtctcaccctgtcacccaggctggagtgcagtggcccaaccacggctgaagagattctcccatctcagcctcccgagtcgctgggactacaggtgcattccaccacaaccagctaatttttgtatcttttgtagagacgggtttttctcctttgccgtgttgcccgggctggtctcaaactcctgagctcaagtgatcctcctgcctcagcctcccaaagagctgggattataagtgcgagccacttcgcctggccaaatgtccacacattctaatccttgaaacctgatactatggatcttgagacaggaagatgatcctggattatcagggcgggcccaatctaatcacaggagtccttaaaagcagagaacccttcctggctgtgttagagagagatgatagaggcaaagagagagatgtgatgtgagaaggactcagcccaccattgccggctttgcagatggagtaagggggccatgagccaaaggatgccacagtccctagaagcagggaacagcccttagttggctgtcagcaaagaaacaagacctcagtcctacaaccacaaggaactgaattctgccaacaaccttagtgagcagggaaaccaacagtcccttaaagcttccgctaggcacacagcacatgacctggatgggggtgatcagagagggcttcccagaggaagtggcactcatgagtgaggtctcaaggatgaatgggggtacactggatttagggaccagtgcaggcagggaaacagcacgcacaggctgctgcagggagtggggtgcccgtggggtgccagtggcaaaaagaggctggtaggagagagtaccaggggcttcacaggcaggcaaggagggcagggcttcttgggccactgttaagactttggttttttttttttttaaatatggaccgtttcatgaatttccgtatcatccttatgcaggggccatgctaatttctgtattgctccaattttagtatatgtgctatcgaagcgaacacaagactttgggctttattcatagctgggttggaagccatctgagggtcttcaataggatggaggggaagacagtagatcgtgttttcaaaagatcagtctggtgtctgcactgtgagctgggcgtggtggatggggtagacgagaggagaccctcgggtggtcactgtcaagtccagatggcgggaaggtgaggaagagctggtagatgtgggggtaaaactgcaggttaaacagacagaactagtgataggttgggggccagggagaagcaagcatttcaaaaagcagtcagtctcggccaggcatggtggctcatgcctgtaatcccagcactttgggaggctgaggtgggtggctcatttgaggtcaggagttcgagaccagcctggtcaacatggtgaaaccctgcctctactaaaaatataaaaattagccaggtgtggtgccaagcgcctgcagtcccagctacttgggaggctgaggcaggagaattgcttgaacgcgagaggtagaggttgcagtgagccgagatcgcaccactgcactccagcttgggcgacggagcgagtactctgtcttaaaaaacaaaaacaaaaaaaccctcagtctcatggggagtggggagcagggatctcagagccctgaactacagcacccccccaccccaggcagcagaagctggcggatcagagcacgtgccaaatcctggccctaacactgaccagctgtgtgactttgggcagatttctcgtccttacgtctcagtctcccccatctgtaaaatgggctgacagttgttggctattagaattactttcgctatggaaagcaaaccgttccagcatttgcacttctttctgctcagcttctgctaggtcagcgcatctcaaactccctggggctcttgttaaaatgcagattccaattagggaggtctggggttctgcattttgagaaagttccaaggtggtgcccctgctgctggcccggggcctcaccttgaataacagagcgcacagcggtggagatccccaggagacagggaggggaggggtgcttacctcgctggccctgctcagctctggccccttcggggattttgcatttgatctaactccccgctcaccccacaacttctagactcgtctcccacaggtatggtccggctgagaccaggtggggctttttgaaagtgaactttaactggtcttgtagggaaaaccaaaccaacctgaaaatagacagacctgaaaatggtaaggttttaggccaccctctctttatcttgatgccactaaggtggggcggagggcctccggttgcacagctcattaccttgtggacacctcactttgccttgaacctgcggggaactccacccaaaagccccccctccagtccttgggcttccccctcccactcttcgctttctgatccctccttccctcccaggcaagggcccgagcacatcccagctcccctctctctcttccccagggcagcaggagctgatgagccaggcagggtgggcctggaaattcacagggccagacttctccgggcagcggcagacgccccggcccttgcctccttctccaccgggagctgggacaggtgaagggcctgtgtaaggggaagggggtgccccttcctcgctcagctccacatggaaaatggggccctaagtcctctgctcctccttccaaggggatttgagaggcacaggctggccatcccaccaggttgagatcccacagcccctccgcacagcaagaagactgccctccggtggcaagctatggatttaccgagaattattgctgaaaagaagccaccacctcccagcatttcgtgtccttgagatgctatttacatatgtggctttgtacatctgtgttctcactctctttacatatacttatcactactttatttttatcactactttattttttaattctctatttttttttttttttttgaggcagggtctcactctgttgctcatgctggagtgcaatggcgtgatctcggctcactgcaacctccgcctcctgggttcaagggattctcccgcctcagcctcctgagtagttgggattacaggcatgcaccaccatgcccggcttatttttgtatttttagcagagacggggttttgctacgttggccaggctggtcttgaactcctgacctcaggtgatctgctggcctcagcctcccagagtgctgagattacaggcatgagccaccgtgcccagccaagatgatcccagttttgttggcaacatccaaagcattgtaatcaggagccagtggaacatatgccttcttctctccatccggccgaatcagggtgctgaccttggccacatccatgccatagagctttgtcacagcctgtttgctctggtacttgttggctttaacatccacagtgaatacaagtgtgttgttgtcttctatcttcttcatggcagactctgtggtcagtgggaacttgatagcagagtggtcgagcttgtttctcctgggaacgctctttcgaggatatttgggcttttaatacctatttttatttatttttttgagatggagtttcacccttgttgcctaggctggagtgcaatggtgcgttcttggctcactgcagcctccacctcccagattcaagcgattctcatgcctcagcctcctgagtagctgggattacaggcacccaccaccactcctggctaattttttcgtatttttagtagagacggggtttcgccatgttggccaggctggtctcaaactcctggcctcagctgaccctcctgtctcattctcccaaagtgctgggactacaggcgtgagccaccgtgcccggccctgggatttttttattttaaagatgggtagcctgtggcccagagatgggggagaattggggacacggtgaagctcaaacctctctgcacttagttgctgtgtgaccttgggcaagtggctacacctctctgggctgcagtttcctcatctgtaacatggggtagtgatctggccccaaagagctagcagtgtgtaaaggaggagttgtgtgaaagcaggcacccaaggccagactcgggggagtaatgtgcaataccatgggctccccattctctgcaccccctacccctccattgacccaggtgtgatggcaggagggaagcataagcagccagagccccccaggtgtgccccaggccccagcagagtgagcagggcctgggcccatggtccccatagactccgtagctgtcagtgagattagcaggcaggccgggaggggagaccaaggacaaggacccagaatgttcccacactcagcaggccttgccagtgagccctcacacctccagccagccccaggcccaggctactgaactcacccagtgagatgctgtgggttaggagcacttcgggtgtcctggcaggttcctgcccccctggagaggctcccaggagccctctgggtgacttaagagaggacactctcctctcctactggagggaggagggtgtcctcaaggcccggggctctggattaaataagaagggagacaactcaagcgccatgtgactattgggcaaatatcacgttcatgtattatttcaaattaatatggtgacatgtttcagacatgcaaaaaaaaaaaagaatgatgtaaccaacaccccatttatccaccttccagccacgctgctgctttctgctgcttcctgaacatgccggaagcttcactgctccctcgagtggagagaagagtcaggcagccctttaggccagccaggcctctctcctggggaaaagtggcttctgcttccttccctaaaccaagaaagccccacatcgcaccaggggccacctcctttctgccaggcaccatcttggatgctgaagacatggaaatgctacaaggcttcctccctgcctcttgcctcacttcctgcttcccttctcttgcctcacttcctgcttcccttctcttgcctcacttcctgcttcccttctcttgcctcccttcctgcttcccttcttttcccttttgctccaccctagaagtttcacatcctggatcaccccagaaaagtgcaatggcgttcccctgtcattccatctggaaagacaaaactccttccctggaatctcaacaaagaatttcctctcttgaatcctttcttatgatggtgcttcactttcaaagaacccttgaaacacatggggggcttggtaaaaacatatcttcctgaggccgggccaggtggctcacgcctgtaatcccagcattgtgggaggctgaggcaggaggattacttgacctcaggagtttgagatcaacttgggcaacatagcaagacccagtctctacaaaaaaataaaacattagatgggtgtgggggtgcatgcctgtggccccagctacttgggaggctgaggcgaaagagaggactatttcagcctgggaggctgaggctgcagtgagccatgattgcaccattgcactctagcctgggcaacagagtgagaccctgtctcaaaaaaaaaaaaaacaaaaacaaaacaaaaaaaacccccacaaaaacccacaaaacaaaaaccacgccttcctgaaaagagtgagcctctccgacccctacttcacaccatgtacaagaatgaaacttgaatatgaacgattaaacaatctcatctaggagttaatgtaggagaatatctaagtgacactgagtgggcaaatatttcttaaacaggacaaaaaaaggcattaaccataaaagaaaagattagtatatgtaatttattaaagctaagaatgtctgttcatcaaaagcctccaaaaagaaagtgaaaaggcaagccagaggatgcgagaagatacttgcagtacatataatcaacaaaagccgtgtatctagaatatgtaaagaaccctacacatcaataagaaaagccagacaacccaattaaaaaaaaatggccacaagacctgaataggcatcttacaaaaaagaatgcctaaatggttaataaatgtgggaaaaggtgcccaacaacattacttatcagagaaatgcaaataaaaaccacaatgaggtatcactacagatccaacaagatggctaaacttttaaaaactgataccaccaagtgctgacaaggatgtggagcaattggaatcctcagacactgcagggaagtgcctactagtacgactactttagaagcctggatggagaatctatcagaactgaacatgccttatgccccagcagttccactcctaggtatatagccaacaaaagcgtgtacgtttggacactaaaacgtgtgtacaggaatgttcccagcagcactatcataataaccaaaaagtggaatgtctatcgagagcaggcccggagtggtggctcatacctgtaatcccagcactttgggaggccaaggcgggtggatcatttgaggtcaggaattcaagaccagcctgaccaacatggtgaaactctctctgctaaaaatacaaaaactagctgggcatggtggcacacacctgtagtctcagttacttggcaggctgaggcacaagaatcatttaagcccaggaggtggaggctgcagtgagttgagattgcaccactgcactccaacctgggcaatagagcaagactctgtctcaacaaattaaaaaaaagagagtagactagacaaataaattgtgcatatttgtgtgatgctatactgcaaagcaatggacagaaatgagcaactgttatttgcaacagtgcgaatgattctcacaatataatgctgaattaaagaggccgattgcaggggaatggactgcgtaattctactttatgtaaaatccaaaagcagtcaacactaatagagcgatagaaatcagccttttgggaggagtgtgtgggaggggggatgacggaggagctggggctggcaaggtcccatttgatgagttgggtgctgattgcctggtgcgttcatcttgtaaaaatgcagttggctgtaacttgagatctgtgcacttttttgtacgggtgtgttagacttcaacaaatacgtttaccagaaatttgtattgttgggcccatcccagagacaaggtaggaagcaattatgttaatcccagggcaaggggatggtgactagccccaggtgaaggtggtgatgattatggtatgaaaagggccaggagaatttgctgataggttgtttgagaggagagagtcaagggagacgctaaagtttctggcctgagctggagtagcagggggaagcgtaagggcggtgtgggtttgtggaatcaggagttctcgtcctgatttctctcctatattacaaagctccgtctcaggcctcctgggactggtggggacagagggagtatggatatctgggatccacctggcctcaccagcttttctgacctgccaggatcgacccttcgaggacacctgtcatggaaaccccagccactactatgacaaggctgtcaggaggtgctgttaccgctgccccatgggtgagtgggggcgttgggggtggggagaaggggggaaatttgtcctcaattgatgaccctcttgggggattgatgagtggggaaattggagccaaccgtcatcgtcataattggctacagttttctgcaggtcattcctagtgtcgcggagtccaaggactctctcggaaggctagggctgtagaattgagactgtgtttcttgctgccaccagaatgtccatctccatgagtttttatttttaacgtagagctgccctttattggacacttactatccatgagtccgagacctttatatgcacggcatcatctcattaagtgcttgcaatgatcctttattacactcaatttgcagatgaggctactggggcttggcagggttaagttccagctacttcccttgatgaccagggtcacacagttgggaaatggtggaatgatcagggctggggcccagggctcagagacctcaaagcctgggctgtcaacatcctctgaccacccttcatttctggggcccagaagtcctttgcagttctttcttttctctcttatttttatttttattttttttgagatggagttttgctcttgttgcccaggctggagtgcaatggtgcaatctcggctcactgcaacctccacctcccgggttcaagcgattctcctgactcagcttcccaagtagctgggattaccggcatgcaccaccacacctggctaattttgtatttttagtagagacagggtttcgccatattggccaggctggtctcaaactcctgacctcaggtgatccacccgcctcagcctcccaaagtgctgggattacaggcatgaaccaacgtgcccggcctaatttttttatattaatttaaaatagagacaaagtctcgctatattgcacaggctggtcttgagctcctgggctcaattagtcctcctgcctcagcctcccaaagcactgggattacaggcatgagcctccatgcctggcctctttgccgttcttgactgccccagctcaggacaggtgtttatcctgggacaacctggacaatagatttctctgagaccagtctcccagaccagagctccctttctggaatgttcccccacccccagcaccgtgattgacttctagtcaattaccaggaaatccttctggagctggggtgagtgttgttccttccattttgtagatgatgcttaggcccgaggagataagcagctggaatagggtcatgaggcatttctgcccctgtggttattatcaaaagtcccaaggcaccaccagtggtcttagatgggcggggcaggacataacgatgccctcgtggtctctgacctccaggaacagagattgtcacggggacatcagcctttagctgtgccagcaagggtgggagggagtctgtgtgtgtctggttcatcatcgccacttcttgctttgaggacagcaggccattgcaagtgggcgggcatcgtctggagggcttccgacagtgggggcggaggggcccatccacccagctgtactgtctggagggtggtgacaggttatggccatcagggctattccactggagctgcgcgggaacccaggtcagtcagttcctagacttgtggcctcaactcccccatgagatgcagaccaggctcgtgctcaggccaccaaaggacagagggaaacattcttggaaagaatttgatgtttttgtatttgattttgatttgtatttccaacaatgattcaaagtattcattgtatgggcaaaagtagtgggttggatgctattggactttcttgcttttatttttggtttagtgttgattttgaatgatctattaggtgggtcccctggttttttcagtgcttcactggtcggccatccacccacccatccaagtacctgcccccctcacccacccacccatccaagtacctgcccacccacccatctttttaaccactcaccaacccacccctcccatcccctttccatttttcttcccatctagccactatccatccatccatctgtattagtttgctggggctgccataacaaaatactgtagtctgggtgacctaaacaatagacatttatttcttacagttctggaggcttgaaggtccaagatcaaggtttttggaggatttggtttctggtgagggctgtcttcttggcttgcagatggcagtcttctcatggtgggaagatcgatctctctctctctttctctctctttccccctcttcatatatgccaccaatccccctggattagggccccatccttatgacctcatttaaccttaattatctcctaaaagtcctatctccaaatacagtcacactggggttagggtttcaacacatttaacatatgaactttgtgggggacacaattcagtccatagcaccatcgccttcccatatccctccaattatcctcccattcaccgcccccatccatacacccacccctctcctggccattttctcatctacctttctatccatccatccatccatccatccatccatccatccatccatccatccatccatcatccatccaacaaatttttatttctctctctctctcttttttttttttttttttttgagatagagtctgtctctgtagtccaggctggagtacggtggtgtgatcttggctcactggaacctccgcctcctaggttcaagcaattctcttgcctcagcctcctgagtagctgggattacaggcatgtgccaccacacccagctagtttttgtatttttagtagagatggggtttcaccgtgttggccaggctggtcttcaactcctgacctccagtggtctgcccgccttggcctcataaagtgctgggattacaggcatgagccactgtgccaggcctagtttctgggcctttggacatgcctgtccccatgtgggatgccctcccctccgtccctacctgctgcaattctggaaccccttcctccatgaggccttcccttgctagcctgatggttggtggtggttcccactcagttctctcagggcccgcttgctgtggtttttatcctctggaatggagtggcccacagtgttctatgacttttcatgggacccacaatcccagccacaaggagaaagacacttccttctcatcctcttctggcccctttgactccagcctgaaagggccttgatggggagtgggtggagagaaaaatgacatctcaggtcccaggctccctccacttaaaagctgtgacttaggaagagggggctccctcctccccacttcccctctctaaggcccagtgctggctggggctgaatactccatattggtgtggtgggtggggcattttactggtgttttattgaccttgtgcttccgtgtagccagagaagaaaaaagaaaaacccacaaaaaccccttctttgatctctcggggaaatttcttgacattttgcctgccctgtgcagccagcactcagctgtgtggccgggtttgcttgtgggcgggttggtggaggaaggaagctgagggacctttgagattgaaaaatgtagatgtcatcgaatccctccttgcacccaggcctgtgatgccctctccagcattcctgagagcaggtccccagccctttgcttacatactcttggtgacggggagctcattcactgactcataacaatgaccacgattcataccgatggagcacgctatgtgctggccactgtgctgggccctttaccgaccttaagttccttcaatcctgataagaaatccagagaggaaacttggacaccgaggggttcaggaatttgcacaaggccacatgcgtatcagtggctcagccgggccgtgaacatgaccaccgagtgcagtctcctgagctcttcaactgtagttgatactgaccctcaaggcctcgaatttgggaggcagaagagtttacgagtgaagagctaatgcgggggctacaaagcccttcctgttctccatcttcctggactaccctctctttgtgtgcagactcgctccccacaggaaggggtctctcctgcagatgtttgaggcctgcccaggttcaggggaaggatgtgaggccaggccaagtgttaggtagggagcatggcaggtgtatcccatcttgtcccaggagctgagggttcctccgaaggctgtgaacaggaaggaggaggaggagggggtttgtgggttcccccagcttccgctgcccttgggtaaagctcagctttgtgcatgggcacgcccatttggcatgacagctgctgcccctgccgcctccccctcccccgcccagtccctcttcatcctgggcttcagctgagtgtgctgggctcccctgtgccctctgacactgtcccagcagagccccctcacagcacctcctggccccccactgtccctgtgtgcttgactcacacctctgcattcctcagggtccacttaagtgtaggccctccctgaccccagcctgggccacagagcgagattctatctcgaaaaaaaagagaaataaacatttgttggatggatggagggatggccctccctgaccccaagccagctcagaggtcttggctctgggctcttggtgcctcccatggttccactttcctaacactccttccatgtgtcatgacttgtctatcgtcttcctgcaggatccccagccctgaccccagggcttggcacatagtagagtctcaatttttgaaagaataggtgaatgaatgaatatggctaacttgccccgcatactcttctgtgacagccagccattgcctcacagggccaagcttccattgtccccctggcacctccctctgctgaagtcagaccagcctctctctcctgtccatcccactcgcaggtacatcctagtcttttctttaagcctgaaaaatccaccagggttcttttgtataggaggaagtatgtgggcgtggaagggaggaaatggaaggcagtagaaggaaataggactggcccaatgcagcaagcatttattgagctctgttggatatagggttatttgggggagagaaggacaaggtcctgcctcctgggagcaacccactagtaggggaggtgacatgcttatatatatctgatactccagagggtatctgtgctaagatagtttcaaaggaggaagaatgggagcttacagtgaggaaaagcccctataccactggtctgcatccacccatccatccatccgttcatctacacatccatctacccatccacccatctacccactcatccactcttccctaacccatccatctatccacctatctacctgcccatccacccttccccatccatccatccatccatccatctacccatccacccatctacccactcacctactgttccctaacccattcatctatctacccatctacccacccatccacctttccccatccatctatctacccatccatctacccatccatccatctacccactcatccactcttccctaacccatccatctatccacccatctatccacccatccacctttccccatccatctatctacccatccaaccatctacccactcatccactcttccctaacccatccatctatccacccatctatccacccatccacctttccccatccatctatctacccatccaaccatctacccactcatccactcttccctaacccatccatctatccacccatccacctttccccatccatccatccatccatccacccatccgtctacccatccacccatctactcactcatccactgttcctccacccatccatccatctacccatctacccacccatccacccttcccccatccatccatccatccacccacccactcatccatccacgtacccactcatccatccacccacccactcatccatccacccacccactcatccacctactcgtttatccattcacctatgcactcactcatccatccatccacccacccacccactcatccatttacccacccatccacccactcattcattcattgattcacccaatatgttttgtgtatttgcattctatcagaccctagagattcaaccatgggggggcagctatcatcttgccctcacaaactcaatctcaataagacaaatattataccaatttgagacttttctacctgcttgtaagaaaagggggtgccatagtttgaattcccccagaagtagactgttatgggctgagtcatgcccgtatcccccaaccaattcctatgttgaagtcttaaccccagaatctcagagtgtgaccttattcggagatggggtctttaaaaaggcaattgagttaaaataagttcactaggataggcccaaatccaatatgactggtgcctttataaaaggaaattaggacacagatatacacagagacaagactgtgggaggacatggggaacacagtccatctgtaagtcagagagaaagagctcagaagaaactagccctgcccataccttgattttggacttctggcttcaagagctgacaattaatttctgttgtttaagccaccctgctgtctgtcgtagtttgttatggcagcctgagcagactgatgcacagactttgaggcaatgatctgagtacagttggtgatgcctggaaacaccaatttggaagtagggaagtggcagacggaagggaaggcagcttataaagttgtgttagaaagctagttactgctgtgggcaactggggcttaatccctctgggggcctctgggagccagtgcagaacagctgagggtgagggagctggggtatttatatgccaatgtccatcaaacattggtggaactgctcctggggtggtacatcttggtaggtctggcctgccacaccctggcagagcaggctctgggtgctctgagagggtgattttaaagggacccagagagaggatctgggtggggtcagatgatcaggaaagttccatgagaagatggtatttcagcctgatctggctgggtgtgaagggttcccagtgggtggaagatggagaagccacttagcctgcaggaagaacatttgtgttagtttgctggggctgctgtaacaaagtacctcaggctgagtggcttaaaccagtggtccccaacctttttggcaccagggactggttttgtggaagatgattcttcccatgaaggggggtcagggatggttttgagatgaaactgttccatctcagatcatcaggcattagagtctcatgaggagcatgcaacctagatcccttgcacgtgcagttcacaatagggtttgcgctcctatgagaatctaatgcagttactgatctgataggaggtggggctcaggaggtaatgctcgctcaccgtcactcacctcctgctgtgtggccccgttcctaacaggccatggactggtactggtccccggctggggactggggtcgcctggcttgtggcagcataactccaatcttcacatggcattctccctgtgtgcacatctgtctctgtgtccaaatttccccttttcttatttattttatttcatctgtactgtattgtattgtttcagagacagggttttgctctgtcacccaggctggagtgcagtggcatgatcatagcccactgcaacctctaactcctgggctgaagtgatcctcccacctcagcctttctgagtagctaggagtacaatgtgacatcacacctggctaattttctattgttgtagatggggtcttgccttgttgcccaggctagtctcaaactcctggcctcaagtgatccttccatttcagcctcctaaagtgttgggattacaggcatgagttaccgtgcctgaaaatgtccaattttccccttttcttttatttttcttgtcttttttttttttttttgagacagagtctcactctgtaacccaggctggattgcagtggcgtgatctctgctcactgcaagctccgcctcccgggttcacgccattctcctgcctcagcctcccaagtagctgggactacaggcgcccgccaccacacccggctaatttttttgtatttttaggagagacagggtttcaccatgttagcgaggatggtctcgatctcctgacctcgtgatccgcctgcctcgacctcccaaagtgctgggattataggtgtgagccaccgcgcccgacctctttttattttttttgagacagagtttccctctgttgcccaggctggagtgcagtggtgtaatctcagctcactgcaacctccacctcccaggttcaagtgattttcctgccccagcctcccgagtagctgggattacaggcacatgccaccatgccctgctaatttttgtatttttagtagagacggggtttcgctatgttggccagggtggtcttgaactcctgacctcaggtgatctgcccgcctcggcctcccaaaatgctgggattgcaagcgtgagccaccgcaccggccaagtttccccttttcatgagaacaccagtcagattagattaggcccaccctagcggcttcattttaactggattgcctcttcagagcccctacctccaaataaagtcacatcctgaggtactgggggttaggactccagcatatatatttttttggggagacacaatttaatccataccaacattcaggatgtatgaggggtgttagagaaaagatcaagatacccagactggctgtagtagagagtgcatgaagtgagcaatgtactagaatgccagactgggaagatggagacacagtgtgaggcctgggagtgcaggctggggaatgccgtatgaactaggttgacagaacatgttttaatgaaatatgtgtgaggccctatgataggggaggcattggtgagtggacatagaaagactcatcctcaaggagctgacttttttttttccttgagacagggtcttgcttcgttgtccaggctggggtgcagtggcgctatgcccgctcactgcaacctctgcctcctgggttcaagtgattctcctgcctcagcctcccaggtagctgggattacaggtgtgcaccaccacgcctggctaatttttgcattttcagtagagatgaggtttcaccatgttggtcaggctggtctcaaactcctgacctcaaatgatccgcctgggctgggtgcggtggctcacgcctgtaatcccagcactttggaaggccaaggcgggacggatcatgaggtcaggagatcgagagcatcttggctaacacggtgaaaccccgtctctactaaaaatacaaacaattaaccggtcatggtggtgattgcctgtaatctcagctgaggcaggagaatcacttgaacctgggaggcggaggttgcagtgagctgagatcctgccactgcactccagcctgagcaacagagcaagactttgtctcaaaaaaaaaaaaaaaaaaaaaaatccgcccacctcagcctcccaaagtgctgggattataggcgtgagccaccgcacccgatggagctgacattcttatggggaatttagacactgtgaagattgagctcacaaataaatgtgtgattacaacagttaggtgttgaagggcaaggaaatgagtctttgtttttattggggatcacgaccaaggctctgagacagtgatgctttgatcatgatgtgaaggctgagtgggagttactaggggagaggagcattcggggcagaggaccagcttgtgcaaaggccctggggtggcagaagggagcattgcccctttggggaacagggagatgccagtgtggctagagatcagagggcaagggggacataggtgagccgaacctcactagccatggtaaggacccatcctgggagccatgagaagcctttgaaagttttcagcaaggagtgaaggggtcagatttacctctcagactactggggaactactgaagtgtctgagttaaagagtgacagccatgaagctagtttttttttttttttttgctttttttttttgagacggagtctcactctatcgcccaggctggagtgcagtgacgcgatctcggctcactgcaacctccgcctaccaggttcaagcaattctcctgcctcagcctcctgagtagctgggattacaggagtgtaccaccatgcccggctaatttttgtatttttagtagagacggggtttcaccatgttggccaggctggtcttgaacttatgacctcaaatgatccatgcgcctcggcctccgaaagtgctgggattacaggtttgacccaccgcacccggctcgaagctagtatttttgagaggttcttgcgtgttgttctagggcagaggtgcttaccctggggtccatggactcaaaggtagatttcacagggttcatgaacctgaatggattcaattattttaattagcttctagctaaaattcacttatgaattccgcccattatgaattaaggcaacaaagcacagtggtaattgtagtacacggctttgtcctcagcggaaatcatagatattctcagattatattacagtagctgcagatgttgtgaaatgttgtctgggctcatcattgctttgaaactgtggagttattttaccctattatttaatgagtttacaaagaatcacatgttactgtatctttttttttttttttgagatggagtttcgctcctgttgcccaggctggagtgcaatggcacgatctcggctcactgcaacctccgcctcccgggttcaagtgattctcctgcctcagcctccccagtagctgggattacaggcgcctgccacgacacccagctaatttttgtatttttagtagagacggtgtttcaccacgttggccaggctggtcttgaacccctgaccttatgtgattcacccacctcggcctcccaaagtgttggggttacaggcgtgagccaccgcacccggcctgttactatatgttattttgtttaatgctttgataaccatattccaaggtagttggattcctctgcattcctgcatattttattcatgaattcatgattctgtgcagtgtccacaggcttccttagaatgattaggggcacaagaaatattgggaaccccctggtctattttcattgtaactggcagaagggctcaaataagacaaaagagaaataattggctccctaacagagaagtccatggacaccctacattcagatgtttgaacgatgtcctcaggagcccatttctctccaactctggcttctgctggcttctgagtcacctccttcttaggcaagtcctgcccacaccatgcccacgctcaggctgtgatgacctgggcagctctgggcttaactagccctttcagccaggaatccagtagataaacggaggacatctttctggattgcttttgtgaaactctcagagatgaggcttattggctggcatgcctgggtcatgtgcccatactaaactaatcacagtggtgaggaacatggagtactctgattggcctgcttgggtcatgtggcaatcctgagccaattatattgatgggaagaagtattctgattggcctgcttgggtcatgtgctcatcctggaagcaaggtaggcagcgattgctgggtgacttgtttatctcgaaatcaggctggattagggtcttagtggcaggagtgtccaatctttcggcttccctgggccacattggaagaagaagtgttagtgtggaagaagtgaatttagtctaacactaaggatagtgttttagcttatagctgatgagctaaaaaaaaaaaaaaaaaaatcacacacacgcaaatctcataatgttttaagaaagtttatgagtttgcgttgggcctcattcagagctgtcctgggccgaatgcggctagtcgtgggttggacaagcttggtctagactttcatggtctaaagttatggctctcctaattcctgcagtgagataagacccctgcagagaatgatgacaaccggtgctcatatagtgcttgttgggtgccagggactgctgtagtactttatacatatttatcttcacagtccattcagtcctttcaagaacactaggaggtgggtcctattactaacttaatagtgctaaatatatacacgtactatgtaccctcacacacacacacacacaaatagtgctgacaaggtcattatcacgcaattggcaaatggcagccctagaatcccaggcccagctcttctctataactatgttgcttttccttgcctgctaggggaccttaggcgagggttgcccctcctgggtgtcagtgcttccatccataacacaagaattggactgacagttttcgggggttggaggtggagctgggaggggcgtcagggatgagaggtgtggggcattgggtcataaggcctttgctaagtcagcctggcttggagcttctctgtttcttttcccagggctgttcccgacacagcagtgcccacagaggcctactgactgcaggaagcagtgtgagcctgactactacctggatgaggccgaccgctgtacagcctgcgtgacttgttctcgaggtaagggccttgttctctctccagggcctccttctagggagcatgaggggtcctcagaggagaggtgaagaatctggaaggtggagagcatcatgatttgatgtctgttctctgaattgtcctcctggtgcctcagtttacctctctgcatttgtgatttgatatcagccatgaccttttgcatccatactttcacagagacttaacatgtttcctgaaggagaggactcacatttttttgagtttaatcctcaccacagccctaggggaggatttcttgcttatccttactttacaatgaggaatttgaggatagggaggttaagggcctttccaaagttacaaaactctggtaagtggcagaactggagtttgagttgtggcctgacaccaagagctgtgttcttttcctaagatcacaggacttccaggaaaactgtttcagtatgaccttttattgttagtctcttattatggttagagaatgcagtctgtgtgctatctagtgtttatttttgtgtggatttttttggggggtagggtgggggaaatttgttgagatctttttgtggtctaataaataataaatgatcatgtattttcagagtgttcagtgtatgggtgttttaaaatgtgtattctgtttgttgcgtataaagttctctacatatctattaagttaagcttgttaattgtgttatttaaataatgtgtacccttatttacttttatcacctttatttctgagagatgtgttaaaatcttatctcccagtatacttgttcatctattagattttcattgtgttctttctatttttgcttcatatatgtcaaagctatgttattaggtacataaatgttcatgaatgttatgtttttttggtgggttgggctttttatccacatgaatatacctctccattccttgtaatgccttttcccttaatttcacatttgtttggcattaatattgctattccttcctggaagaagtagcaaaggttaaaaagaaagaaaagtaataataatactgccatttcttctttctttttattagcatttatctggtgtatctttgaatttctaaaagtaatgactgcattttatgaaatgaaaattataaacatttattatttaaaattcaagcaatacaaagagtgtaaggaagaaaacaaacattgccctccccagccctccatctatagataactactattatcattagatggctgacacgcctctacctctctgtataaagatgggtaggttagtaaccagacagcctgtacacacttacaaagaaggaattttaagagaatggcaacatatttatggcattaaaatgataatatttaattttagtcaaaagtatcagaaaaagaaagcgaagtgaaacagaagaatgccaaacctcagtcagattaatgtatcttcagcaaaagatactgcaattcctttaaaaaaaaaaaccctctaaaattaagaaaggaggttatgaaaatcagtaagtggttaataatcatttcagaatctactatctcttgcagtaaaggcaaaatctgcttagtttgagttttggacagtagagaatagattgactccctgtaatgaagaacaaagtaattatttttcccacctcctcatcctcttcctgacttttattccttacacaaattttactttgtcataatctataatgtttatattctcatctgcaaccataagtcccttggcatgttagccttaacattttttattattcatgatgagtttatttggcacagcttctctgttcctgagtttttcactttgattcatcatttgagtgattggattacactgtcaggtggatttttcaagaagggctcgtctttgcaatattctctgttatttcatgtttgaggatgcttgtctgttgcctatatttttgttttcttttttttctttttgagacagagtctgactctgtcgcccaggctggagtgcagtggtgcaatctcggctcactacaacctctacctcctggattcgagcgattctcctgcctcctgagtagctgagattacagggatgcaccaccacgcctggctaatttttgtatttttagaagagatggggtttcatcatgttgcccaggctggtctcaaactcctgacctcaagtgatccagccgccttggcctcctaaagtgttgggattacaggtgtgagtcaccattcccggcccaatttcttatctttaaattttaagacagggtctcactttgttgtccaggctggccttaaactccagggcttaagtgttcctcctgcctcagcctcccgagtagctggggctgcacttgcatgttactgcacccaacttacaatttttttgtgtgtctctgaggatataaattatagtcatgtattgcttattgacaggaatacattctgacaaacgtgtcattaggcaattttgtcgttgtgcaagcatcctagattagtgtacttacacacacctacatgatgtagcctactgcacacctaggttctatggcagatccttttgctcctaagctacaactctgcacagcatgtgactgtcctgaatactgtaggcagctgtgacacaatgtgagtatttgtgtatctaaacatagaaaaggtgcaataaaaatacgacataggccgggcacagtgactcacacctgtaatgccagcactttgggaggccgaggagggtggattacctgaggtcaggagttcgagaccagcctggctaacatggcgaaaccccatctctactaaaaatacaaaaattagctgggcgtggtggcacgtgtctgtagtcccagctactcaagaggctgaagcagaagaattgcttgaacctgggaggcggaggttgcagtgcgccgagatcatgccactgcactccagcctgggtgatagagtgagacaccatctaaaaaaaaaatatgatatgaaagataaaaaaaatggcacacttgtacagggcacttaccgtgaatggagcttgcaggacacgaagttgttctgggtgagtcaatgagtaagtggtgggtgagtgcgaaggcctggggcattactatgcactactgtggactttatcaacactgtacacttaggctatactaaatttataagacacatttttctttcttcaataataaattaaacaactttttcactttataaactttaactttttaaacttttggctcttttgtaataacacttagcttaaagcacaaacacatcgtacagctgtacaaaaatattttctttatagccttattcattacacttttttctactttaaaattttattattttattatttttaacatttttaaattaaaagctgagacgcaaacacctacattatccgaggcctacacagagtcaggatcatcagaatcaccgtcttcctcctccaaatcttgtcccattggcagcgtgcagtgactcacacctgtaatcccagcactttgggaagccgaggtgggcagatcacttgaggtcaagagttcaagaccagcttggccaacatggtgaaaccccatctctactaaaaatataaaaattagccgggcacgttggcatgcgcctgtaatcccagctactcaggtggctgaggcaggagaattgcttgaacccgggaggcggaggttgcagtgagctgagattgtgctactgcactccagcctgggtgacagaatgagactctgtctcaaaaaaaaaaaaaaaagaatcctgtcccattggaaggtcttcaggagcggtaaggtaacatgcatggagtatcgtctcctatgataacaatgccttcttctggatacctgcagaaggacctacctgaggctgtattacagttaacttttgttttaataagtaggagtacactctaaaataatgataaggccggcttggtggctgatgcctgcagtctcagcacttagggaggccaggctgggagaatcacttgaggccaggagtttgagaccagcctgggcaacacagtgagatccccatctctacacaagataaaatacattagctgggtgtggtggcatgcgcctgtagtcccagctactcaggaggctgaggtgggaggatggcttgagcccaggaagttgaggttacagtgagctgtgatcatgccactgcactccagcctgggcaacagagcaagaccctgtttcaaaaaaaaaaaatgataaaaagtatagtacagtaagtacgtaaaccagcaatatagctttctatgatcattatcaagtattacatactatccataattgcatgtgctatgcagcacttttatacaactggcagggcagtaggtttgtttataccaacatctccacaaacatgggagtaacgcacgtgctacgacattgccgtggctatgacatcactaggcaataggaatttttcagctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccatgcctggctaatttttgtattttttttaggagaggcgggatttcaccatgttggccaggctggttttgaactcctgacctcaggttatccgccctcctcggcctcccaaagtgctgggattacaggcgtgagccaccgcgcccggcttccattatgatcttgtgggaccatcatcatgtacgccatccattgttgactgaaatgttgctctgtggtgcgtgaaggtatcatttctaatgttttgttctgttttccctcttttctgcctccttgagtgttagtgctctttgcattcagagctcctcttccttggcgctggttttcctctgatgtttggcgacttctagttctgtgcacatcatatctcatgatgccggtggtctgcgaatggggcttctgaaacccacctctgagggcaatggggctcaggtggggctgcaacagtctctttgcgggaagacgcgtggcctctggctctgtggcatgagtgatgaggagctatccagagcctttcccccttcttcagagagtcccccttggctgcattctgggctgtggtctccttcactctgatcttatctgtcctctgccttccgtatttcggggagttgtcttcgtttctgatctgccaagcttgccccttcttggtctccaggcctgttacacattaattattagttttaccagtgctatttttgttttgttttgttttgtttgagacggagtctcgctcttttgcccaggctggagtgaagtggggccatctcaactcactgcaacctccacttctcgggttcaagtgattttcctgtctcagcctccccagtagcttggattacaggtgtgcaccaccacacctggctaatttttgtatttttagtagagacagggtttcactatgttggccgggctggtctcaaactcctgacctcaggtgatctgcccacctcggcctcccaaagtgctgggattacaagtgtgaaccaccactccccgcctagctgtactttttatgtctgttaaccaacctgtgatttcctgcttttcctgccagcagttgttattatctgtctttttgattcgagtcattctagtggttgtgaagtggtatctcactgtgattttgacttgcatttccctaatggctaacggtgtgggacatttttcatgtgtttattggccagctgtgtatcttctttagagaaatgtctattccagtcctttgtccattaaaaaaattaataaactatttctggctgggtgcagtggctcacgcctgtaatctcagcactttgggaggccgaggcgggtggatcacctgaggtcaggagtttgagaccatcctggccaacgtggtgaaaccccgtctctataaaaatacaaaaaattagttgggcgtggtggtgtgtgcctgtaatcccagctactcaggaggctgaggcaggagaatcacttgaacccaggttgcagtgagccgagattgcgccattgcactccaacctgggtgacagagtgagactctgtcttaaaaaaaaaaaaattaataaactatttcttagagcagttttaggtttacaggaaaattgaacagaaaatacagagttcctatataccctcaacccccttcccaatctcccacagtttcccctattttttgtttgaaacagggtatcactcttttgcccaggctggagtgcagtggtgcaatcacagctcactacagcctcaacctcctgggctcaagcgatcctcccgcctcagcctcccaagtagctgggactacaggcatgtgctaccatgcctggctaatttttgtattttttttttgtagagatgggatttcaccatgttgcccatgttttatagagatgggatttcactatgtcgccatatgagggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtcggttcacctctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagctatctggagagacgccttccttctgttcccctctgtgacccctgtctgtgtcccttagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggtcagtgtccccacccttaactcaggacagagatctatgctgttgctgctgcaccttccgcccaccccagtgcactgttgacttccgacctcccgcttcccggagactgttggacagatcatgtctcctttggcgatgggccagggatgtacccagcacccagcccttctgctgccctcccccaccttgtgttccaggtgcagagagaccctgctgtcccctggcatagacctggctggaggaggtcttgctttggtttgaggctcaaggcagaagttatctgatgccccataaacaagaagggaacctcaagtctctgtcctgggagtttcctagaagattggggttggcttccccctttcaggttcagggcattgggagttagaggtgctgagagatctggccccaggctcaagacttgagaaacttgggtttcttttccaacttaccgtgtgacctcagacaagtttcttacctctctgacttctacttctctgatagtacaaggtgtcagggctgcttttaaccagagaaggggtatgggccacagaacctgtctgggtggagttgggaccatcttccagaagggaggcatgaggagtgggtgggctttggagcacagcacagagtggctgccgcagttgcagactgtatggagccggggagatgggctcagaggcagccctgtgtccactgtccactgaggagaaaagtgccacaaagtgcctgtggtccctcccccaaccaggtccttctctggagtcccatgccctgttgtgcaaacctggggattggcagtcacccccatcgctaccactgcctgccccttttatccttccctcgttccctcatccttcacagccagcccatcctcgagtcctgtagatttggcctccaattatcttccccaccttctcaccccgaataccttctcttatacagcccccatggcagacagccagaatgacccttgcaagaccaaatctgaatctgatcctctctctctctctctctctactcactcactctctctctgtctcacacacacacacacacacacacacacacggatatatacctgaaatgcttcagtatcttcctgttactctaaagataaggacacaaggccaggtgtggtggcttacgcctgtaatcccagcactttgggaggccaaggcaggcagatcacttgaggtcaggagttcaagaccagcctggccaacatggtgaaacctcatctctactaaaaatacaaaaattagccagccctggcagcaggtgccctgtaattccatttactcaggaggctgaggcaggagaaccacttgaacctgggaggcggtggttgcagtgagctgagattgagccattgcactccagcctgggtgacaagagcaagactccgtctcaaaaaaaaaaaaaaaaaaagaaaactccagggactcaccacggtgtccttcaggtcccaaggcccccagttgacctgccttcttctcttcatgtttcagagccttcttacatttattttgtacataatgtccagggcttttagcggttcttggcgggaggatgaggggaaaacgtgtctaagccatcttcccagaatcagagtctcaggatgtgatcccaacacagccccctcctttctcccagcttcagctctcagcaccaagccctcactctctgggctccacctgcgctgcccttcttccaggttggaggacgtgtgtgcttctctgtcccacccgccctctgcacgtgctgttctctctgtcggagacacccttccctccccattcacttagtcaaatcctactcagccctgagctctccaccccacttcctcaagaggccttccctggcctctcactagggaagctggtagcactgtgtcctttgcaaatgtggatacatacctctctctgtctcttggcttgatcaatgtctgtctccctccctggctggaagcttcctgagggcaaagaccatgcccctggtgtccatcaacatctccccactgcctgatcaaatgctaggcatggcacctgctccccatagagattcattgaattaagatatggggacacctgacagggagctccgagctggtgggggggtggagttcaaatctggtcaaattccagggtcgggggagagcgctctgctaaggaatgatggaggcctccacccataagcaggggagagtgctggagtggactgggcagcagatacctaggattttgcaaagatttgcaactgtggggcatgttcccacccgcctctggacctcggtctccccatctctcaaatgaggaggtataactgaaggccttgggggcctctccaaaaaggccaaacttcccaaaagtttccagctcagaaacttctgcatctttgtgaaaaacatcttgagttcagttgttccagccaaggcttcctgctggagggactgtctgggcagtgttcctgagactgccacacagcggcgccagaggcctccctttgctgcccctggaccccagctgcccaatgcagtgcccctggcccgtggcacgtggccacgcacttaaaatgcagctaggggccgggtgcggtggctcacacctgtaattccagcattttgggaggctgaggcaggcggatcacttgaagtcaggagtttgagaccagcctggccaatgtggtgaaacctcgtctctactaaaaatacaaaagttggccaggtgtggtggcgggtgcttgaaatctcaactacttgggaggctgaggcatgagaattgcttgaatccgggaggtggaggttgcagtgagctgagattgtgccactgcactccaacctgggcaacagagttagactctgtttcaaaaaaaaaatccgataaaaaataaaaaaaatgcagatacgtctgcattgagaagtgctgtgtgtacaatatgcactggatttcgaaaacttagtataaacaagaatataattaattattttttatattgattgcctgcaaacatggtaatattttagatatactgggttaaataaatatactatgaaaattaattgcactgatttctttttaccttttaaagtgtggctcccagaatatttgagctggcctgtgtgactcgcatatctctgttggacagcactgttttagaagtgttctaatctcagctgccaaaccctggttaatctctggggtcccctgtggactcacccatggggcagctctccggggttgttgttttttttccagctgtaaaatagaaagcagtttctgcctccagtcagccaagccccacgctaagagccttcactggctgtctctcctgaaattctcacgtctccataagacagacagtattagccccattttccaggtgtggaaatcgaggtccggagatgggaggtaaattgcccgcggagacagagcaggaaatgtctaagcttaggtgtcatcactccaccatgccacagaacacgagaggtcagcattgctcgcgctcacctccacggaaagcttcagagcgaagtcccacacatacaggccaccatttttttattttttttttttttgtgatggagcctcgatctgtcacccagactagagtgcaatggtgtgatctcagctcactgcaacctctgcctcccggattcaagtgattctcctgcctcagcctcctgagtagctgggattacaggtacctgccaccatgcccggctaattttttgtaattttagtagagatggggtttcactatgttgtccaggctggtctcgaactcctgacctcatgatccgcccacctcggcctcccaaagtgttgggattacaggtgtgagccaccgtgcctggcgacatacgggtcaccttctaagtgatgggatgggagtccagatgggtgtaaggacatagcatttaccatatgtcatgcaatgtgatgggcacctcacgtgcactcttctgtttatcctgacgacagcctggtgaagagtgtatgattataatcatttgactgggctgggcacggcagcttatgcctgaaatcccagcactttgggaggctgaggagggtggatcacctgaggtcaggagttcgagaccagcctggccaacatggcgaaaccctgtctctactaaaaattagccgggcgtggttgcaggcacctgtaatcccagctactcaggaggctgaggcaggagaattgcttgaacctgggaggcagaggttgcagtgagctgagattgcatcactgcactccagcctgggcgacagagtaagactctgtctcaaataaataaataaacaagtaaataaaatggactttcctggcacagttaggacatagcaggcaaactgaggggcactggctagacgatgtgtgtgttttcttctccactctgcttctgtccagcattcttcaggactccttggattgcatgtagcaaaatccccaattttttagcacatgtagcttaaaagtctggggatagctctgagaagcttcaggcatggctggatccagggctccatcttgccccatctctcacctctatttccctctctgttggttcatcggcaagatacttacaagcagctctgcccagcgccagtgggaagacagcttccctttcttacatttttaatatccaaaaccaaaacctttaaatcccaaaccagaatctttaaattctacctcacaggcttgggtcacatgtccgtccctgaactggctcatcgtggccagaggaatgcaacggattgattggtccagcctggtctcatggccactcgggaaagggggttcagtcggtcccaacctctaaccacagatgctgagatcagagggagagtaattccccagggaaagataggctgctttactctgaaggggaacgggtgccaggcgggtgccacctccagatgactgctgtgttttccaagggccccatctccgactctggcctgtggtagtgaagggtgtattccgggagactttgggtccccaacactgattctgaaggcactgctgtcccccctgcaggcacggcgcagaagaacacggtctgtgagccggcttccccaggggtcagccctgcctgtgccagcccagagaactgcaaggaaccctccaggtgactccctggctttgcctcctcctcttcccccaagctggctttcagatgaggctgccccaccccacaggacgcccatggtacaactgggctgggggtgtaagcgggattcagcccatggtgtcagcactttggggtgcctctctgccaagcccctcagatcatttgaggccctagggtgtgcccagccctgccctgagcacatgggagacccacagggcttagaaaacacaggccttgctcccaggagcttacagtgggcccgccagaggcagtgggccaagggcctgggaccccatctctgtggaaactgttactcgtgagcacaggcctcccttgccccattggcagaattatcagtcccatctctggcttcttccccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtaatttccccatgaagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgccacctccacctcctgggttcaagcgattctcctgcctcagcctcctgagtagctgggattacaggtgcccaccaccacgcctggctaactttgtatttttagtagagatgggatttcaccatgttggtcaggctggtctcgaactcccgacctcaggtgatccgcccacctcggcctcccaaagtgctgggaggattacaggcgtgagccaccgcgcccaacctagtcccattttattactgaatagccctccatggcgtagatatgccgagctctgtttatccagtttttgaatatttgggttgtttctgccttttgactataatgaagaaagaaaaatacatctttgcgtgtatgtgctttcctttctcttgggttggttttgtaaaaaaaatggatttgtgggacttctaacaattttgggttggagctcttttcctatagttgtaccttctcccgctccatggctttgcttattctctctatgatgtcttttgtttgtttgtttgtggtttgtttttttgaggtgagtcttgctctgtcgcccagactggagtgcagtggcgtgatctcggctcactgcaacctccgcctcctgggttcaagcaattctcctgcctcagcctcccgagtagctgggattacaggcgcctgccaccacatttggctacttttcttttttttagtagagacggggtttcaccatgttggccaggctggtcacaaactcctggcctcaagtaatccacccgcctcagcctcccaaagtgctgggattacagacgtgagccaccgcgcccggcccacaccagtctttaaaagagggaggcaggaggcacccagcccctccctgcccaataccattctgaacaggagttacgctagtgtgctgagctctcagggaagctgttcccaaagttttgagcaggggagtgacagagccatgagacagggttgggggaagctgtggcatggtggcctcaggaggaacagtgggcaggggctggttggggggcaatgagtaccctcctctcgtgtggaatgcacgcagcattcctgtcctctctgagcctcaggactccctctgaaaggctggactgagctgacatgcggagtttgggagctggccacggtgagggatggggggcttcagggttgggtggggagtgaggcctttgccaaggcggcctggcctgcagcttctctgcttctttccccaggtctgtccccaacacagccatgcccagaggggtctggtgattgcagaaagcagtgtgagcccgactactacctggacgaggccggccgctgcacggcctgcgtgagctgttctcgaggtaagggcctcgtccctccccgggcctcagtttacctctctgcatttttgaaccgtgaacttccagtaactactcccccttatgtttgtgggtttttgatgggggtcgcctcttttcagagggcttccattggcatattatttccttccaggaagcgtttgtgaatcacccacctgttccaaactcggctcatcaatgtttgtaactactctgtgattcaagcattgtgatcattccccttttacagaggaggaaacggaggctttgggaagtcagggaacttccaagggctgtgggctggagtttgaacccagacaggtgccaccaggttccaggttctcgtccactccactcgctgcccctatgagccacttattctttttttttttttcccagacagggtctcactccttcacccaagctgcagtacggtggtgggatcatagctccctgcagctgtgacctcccaggatcacatgatccttttgcctcagcctttcaagtggctgggactataggtgcacactaccatgcctggctaattaaaaaaaattttttttcatacagatgggggtctcactatgttgcccaggctgctctcgaactcctggactcaaatggtcctcccaccttggcttcctaaattgctgggattataggcatgagccaccatgcccggcctgcgagctgttttgacaagcacttactgagtgcacagacacagcacgatgcaggtgtggggcttccctgtgcccagcccatcacaacctcccagcgccagcagcaccccgaggggcatgtgggcagggggtgttgctcaggccacaggctgctgtgactgttagaggccctggctattcacggaggccactgggaatgtgtgtctgtctccttgtccagagctgcttttgggcagcaaagcagagtgaagggtcaggggaggccaaaaagaaccacagacactgtttgttgtcattggaggtctctgtcctagttactaaggctgcatagcaaattttcttaaaacttaattgtgaaaacaaatcattctttgtactcacagattctgtgagtcagaattcagacagggcactgcggggacagcttgtctctgctccacaatgtctgaggtcttagctggaaagcccaaaagctgcagatcaggaacttctgaagcttcattcattcacctgccttggggttgatgttggctcctggctgcagccttggttcccttccatgtcggcctcttcgtgtcttacctggggcttcctcatggtctggtggttaggttctaaaggcgaagtctttttctctttttttctttttttgtatttttagtagagacggggtttcaccatgttggccaggctggtcccaaactcctggcctcaagtgatccgccggccttggcctcccaaagtgttggaattacaagcatgagccattgcccccggccataaaagtcttgagagagagagacagacagaaagagagagtgagagagagacagaaagagggagagaaagagtgagagagagaaagagagagacagagagaaagagacagaatgagagggagagagacagagtgagagagagacagaaagagggagagagagagacagaaagagaaagagacggagtgagcgagagagagagagacagaaagacagaaagagagactgagagacagagagagacagagatagagtgtgacagagagaaagacagagaaagagagagagagagacagaaagagagagagagagacagacagaggcagcagccacccctccttttatgacctggccttggaagtcacacagaacttctaccactttctgtttgttgaggcaaccacaaatgtcacttgagaccaagggaaggaaaacagttgtacttcttgacaggtaggtggcaaaggctctggaagggccagaacatcactgcagccatgttttggggaaatacagtctgccacaaccaccatgtggacatatggagaaagaggtgttggctctgggcccagtaattccttcagctctcctaactgaaaccccacgaggcagtggagtggtgtattagtagctaaaggcatgagctctagaacccgagtgccgggttcagatcccgcctctcccacttgatagcctataacctcaagcaggtttcctaacctctctgtgcctcagtttcctctgctgcaaaatgggcatagtattatctatctcagagaaccatgtgagaattgaatacatgattgtaggttaatctgggtagagtgctgagactactgtctcacacatactcagttatcttaagagctataataataatgataatagctgccattgtcccaaatggtttcattcattgctgagctcacacacaccctttgcacaaattccccaaatcctgcccagttcccttgctctggatgttgtaagaagagactgtccagcccttatcattatcatgctgggtctctaagtatcctgctgattgagatctaccctcgcggagaggtcccatttgcctaatctactgatgcagtcgttctgtatttacctctaagtggagcgttgcaaaatattcccgaatacgtacaaatgcattattacacttattaaaaataatacctctaacatggtttttttttgcttttggaggaaaaaaaatctttttttttttttttttttttttttttttaaatagacagagtcttgttctgtcgcccaggctggagtgcagtggcactatcttggctcactgcaacctctgcctcccaggttcaagtgattctcctgcctcagcctcctgagtagctgggattacaggcacgtgccaccaggcatggctaatttttgtatttttagtagagacggggtttcaccatgttggtcaggctggacttgaactcctgaccttgtgatctgcctgcctcggcctcccaaagtgccgggattacagtcgtgagccaccgtgtctggccaaaaaatctttttattattaaaaatttcaaacatattcagatgtagagtgagtcagagatggctgcgtactatcacccagctttaaacggttatggagtcatggccagtcttggctcctctgcacccatgcccgctcaccccgtcccctggaggactttcttttaacagctttagggagagatagtgggcatatggtaaagtgcatagattaaaggatgcaatctgataagttttaacaaatgcatgcagctgagcaaccagccatccccctctaaaagttacctcgggttgcttgtcaccatttcccatcccctgcttatggtcaccatgcaatagcttgcatgtaaatgcgacatacagaataccctcgctttttgcctgccttctttcaccctgcagaattattttgagcatgctgggagagctgctcaacggcatagtcagacgagcatttattttcttgttggatgacccttggacaactgcttctctgtcttcctgggggctctctggaccccctgcccttgccatactgatctttctccgtgatcctcatctgtgtcccttagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccagggtaagcagttcccaccccaggcctcgaccacggggtggagtctgtgcccccactgttgtgcctctccccaccaacagccaggggtggaggcaaatgacctacaccctcggctgttcattaggtcaggtttgggttctggttatcctttgagtagtcagactcagtgaatggaatgataaaatccagttttagcattttggcaagagattctgttgattaaaaaaaaattcttcctgaaattattgggctggtaaaatctttatatttttgagatggagtttcgctcatgttgcccaggctggagtacaatggctcaatctcggctcaccgcaacctgcacctcctgggttcaagcaattctcctgcctcagccttctgagtagctggggttacaagcattcgccaccacagccggctaatgttgtatttttagaagagatgcggtttctccatgttggtcaggctggtctcgaactcccgacctcaggtgatccacccaccttggcctctcaaagtgctgggattacaggcctgagccaccatgcccagccccgggctggtaaaatcttgacctgtttgcaaggctgttttattgacttagagagatgaatatcaagtttctgaagagatttctaacaggacggttggctttaccagtgtgcaggaaactaaaaccctgacagttttttgttgttgttgttttttgttttttaagggctttgagagattttaacaaatctccaggtggtttaaaacagatggaagagtggtgacaaaaccaaggggaatggccaggcgtggtggctcacgcctgtgatcccagcactttgggaggctgaggcaggtggatcaccttgaggtcaggagttcaagaccagcctgaccaacatggcaaaaccccgtctctactaaaaatacacaaattagctgggtgtggtggtgggcaccgtagtcccagctactcaggaggttgaggcaggagaatcgcttgaacccgggaggcataggttgcagtgagccgagattgcaccactgaactccagcctgggcaacagggcgaaactctgcctaaaaaagaaaaaaaaccaagtggagggaaggtcacccaatgtgactctgtgagggctgccagagaagtgaggggtgacttgcttctaggacccccagagaggctctgggcttggaagaggcaggcagatgaagagcgggagggaagttgagaggtgtgaggtgtagtggcctgggactactaaatcttcaaacacaacttcaaaatgtattacaatggcatggcatggccactgaccagtttgcacagatgatgcctgagtttttaatccccagtattgtctttttttttcctctttttttagagatggagtctcgctgtcttgcccaggccgatgtgcagtggtgtaatctcagctcactgcaacctccgtctcccgggttcaggcaattctcctgcctcagcctcccgagtagctgggattacaggtgcccgccaccacacccagctaattttcatatttttagtagagacggggttttgccatgttggccaggctggtctggaactcctgacctcaagtgatctgcccgcctccacctcccaaagtgctgggattacaggtgtgagccaccgtgcctggccaacaattgtcttcttgagtcagaacattgaaggaatatccggggaaagttcgggccactagtggggtgctgtcactctgtttgtaaagccctctttacttgggtatttggaagtgcacctgtcaacaggctagccacaccccatcaccctgaaatggaggctgccagctcacactctccgcccatgggcccagggttccctggccaacttcctactcagggaagagacccattgtgaacaggacatactaacacagcagaagaaactgtccccgctcagtgactggaatattcagtagagtccttaggattttattttgtttgcataaatgtatggggtacaagtgtaattttattacatgcttagattgggtggtgaactcaggacgtttagggtatccctcacccaaatagcatacattgtaccccttaaataatttctcatggtccacctacctatacctcccaccccctcacccttctaagtctctgttgccttttattccactctccagctccgtgtggacacagtatttcactcccacttagaagtgagaacaggcagtatttgtctttctgtgtctgaatgtctgcacttaagaatatggccttcagttccatccatgttgctgcgaaagacttgatttctttccttatgatggctgagtagtattccattgtgtatagatgccacatttatctattggtggatgcagcataaccctccccccccacccttttctttttgagacaaagtctcgctctgttgcccaggctggagtgcagtggtatggtctcggctcacggcaacctctgcctcctgggtttgagctattcttgtgcctcagcctcccaagtagctgggattacaggcgtgcaccaccacacccggctaatttttgtatttttagtagagacggggtttcaccacattggtcaggctggtctcgaactcctgaccccaggtgatctgcctgcctcagcctcccaaagtgctgggattacaggcgtgagccaccgcacccggccaagcataacccttttaaaataaatatgaatgagcaaagatttgtaagaaaaaccagccctacaaaggagaataaaaagatacgaaaccagaaattcttaccacacatgaagctttgataaatccaggaatagaagagtacttagcaacattaaattcgtgtctgcagaaaaattcacgaagtcgttacatccataaggtgggcacagaatgctatgaaaaggaacaatatgggatcagagggcaagaaaaggctttttagaaagtgtgcttgtgatcagcccatcatctctaggttctccattcacctttccatccctgccctgccatcaacgatggctccgcctttctcctctgtagggagcatgcagttaagccttgccagcagagggcgctagagggccatcgcaggaggaaggaggcttctggttgcatttgtttttttgtttgtttgtttgtttcttttctttttttgagacagagtctcactctgtcgcccaggctggagtgcagtgacgcgatcttggcccaccacaacctccacctcccgggttcaagcagttttcctgcctcagcctcctgagtagctgggattacaggcacgcgccaccacgcctggctaatttttgtatttttagtagagacagggtttcaccatgatggtcaggctggtctcgaactcctgacctggtgatccgcctgcctcggcctcgcaaaagtgctgggattaccggcgtgagccactgcgcccggccatttgtttcttcttgctcctgctgcctggcctggtgaccaccttgatgtggctctcccaatgcagacattggcacgtgccaggcctcatgtctgcaaaagtgtcctgactccctgattccctctgtgcatcccccaccagccacaggtctttggcaccccaaagtgctccaggcgtctcccccacagtggcagcctcaatttctctgtgcacctgaccagaagcatagacttcaggtcaaaaggacctaccaagagcaaagcaggattaatggaaattacccacgctacatgtaatagatgcaccaccatgattttatctacctgccggttgatggcatttgggttgtttccagtttagggctattatgaatgaaaacagctgtgaatattctttttttttttttaacatgtatgaatttatcttatatcttttattattatttttattatttttagagacagggtctcactctgtgttccaggctggagtgcagtggcatgatcttggctcactgcagcattgaactcctgggctcgggcgatcctcccacctcagcctcccacagtgctgagattactggcatgagccaccatgactggccgattcttgtacaagtctttgggtggatgtatattttcatttttcatgggtaaatacctaggaggagtggctaggtcattgtgctggtcacatagtcagaatgtttttgaggactagtcaaagctggatacctctggtctgatacaaccccttcgttttacacccagagagaagcacagggccgaagctagaaccagaatgcagggatcccaagggtcagcccagagtacttccactggaagacaccacccacccacctccttcttagttctgaacctagaatttacccagctaaattacagtcacttcagctaaattacaatcaagtttgaaggcagcataaaaacattttcagacataaaaggtccagaaggcttttcttcctatatcctctcctaggaagatatttgaagatgtaattcagctaagtgagggggcaaaaaagaaaaacaacaggaagccatggaatctagagaccagcactccatcctagcagagcaaggaagggaagtcccagaatgatgtggtatagaccagttgagccagatcagagcaggaaaatggaaggaaggctccgaggaagtgttcccaggaatagaagagagaattgtagtaaatttcatgattagtagagttgaaaagcctgaggatatggtgagggcacactgtccttttatcaacaagaaaaagaaaggcaattgaaaactcccgggaaaagaaaaagatgacaagaaatatacagtccaaatatgaagatgaaatttcacctgattttaagcgattgctggatgtacaaaaagagaatctgtttggccttgatgctgagacaattctttaaatggcccaaggactgggtgtttggatttaaagagaagtatatccatctggtaaataatattttttttagttcttaaatggaggctgagtaggcaggttcttttcttctcttccagtaggccattaccagagaacacaggcagaccaactaggggctagacaatgccttctcctcaccttcaaatccaaagaggaggaaaaggggaggatcactgactcagggaggaagaaggaaagttacaagttaggtatagtatattcagagaggggatgagaggcacccaagggatactaggttccccccttctgcacatacaggagggacagcagatctgtcgctggatttcagcaggtgtttcagcagcagctgagaccatgggcctgtctagttacatcaggctgccttggagagcaggcagggggctctctcctcatgatgctgactgggaatagccacagttaatgggtttgagcatcagagctccagtccactcaaagtaagtgttcactgaaacccaatgacctttcaaacactgattcaaatactgattaacgagcatgtaggaaccatcataacacatcgcatcatcttccccatagtctccaggctccagctaattcaggtaagagtccagtgaccttccccaaagaggggggttcctcagaaccctacaatgcaagaaataaattaatcctggctttacttttttgtctatttgaggaaaaatctgagaggcgtcacgaacactttgtagaggggagatgtgggtatgtgtgtggggttgctttgtaccacatcaaaaaggggtgcctccaccagggctctgggggtggagaggtgtagtgactgagcataacccacttctaatgtgggccaaattatcctgccccagaaaagcaggaagctttgaagaaggtgcccagtccccaggcaggaggcagtgccatccagaggagagtgctctgggctggaactcgccatctctgtttcctggctgtagctccagccctgcggctctctccatctgtaaaacaaggtagctgggtcagaccagtggtggccagctatgaactggccttcagagacattccgtctggccagcatagcaatccagccacccttcctaggcactcaagaggaatgaaattatacgttcacacagaggcacgcacaagaatactcacagctgccttgttcgtcatagttcaaactggaaacaacccaaatgtccatcaactagcgaacgggtatgtaaacagtggttcatctgtacaacagaacgccatttggcaacagaaaggaatgaagctgaatgaatatcaaaaacattatgcagagtggaagaagccagaccccaaagagtacatactgcatgattctgtcgacatgaaattctggaacagatacactcctctatagtgacataaagcagatcggtggttgcctggatctggaggtgggggcagagtgagtgaggaggggcactagggaaccttctggagggatgagaatgttctgtattttgattggagttagttacctttgtcagaactcatcaggctgtacacacttagggacattttctttttttatttttacttattaaaaatagagacagggtcttgctatgttgcttaggctggtttcgaactcctgagctcaagtgatctgcctgcttcagcctcccaaagtgctgggattacaggcgggagccaccctaccctgccaggggatactttcttgtatataaatgttgccttaggctgggcatggtggctcacgcctacgatcccagcactttgggaggctgaagcaggcagatcacttgaggtcaggagttcgagaccagcctggtcaacatggtgaaaccctgtttctactaaaaatacaaaaattagctgggcatgttggcaggcacctgtaatcccagctactcaggaggctgaggcaggagaatcacttgaatccgggaggcagaagttgcaatgagctgagatcgtgccactgcactccagtctgggcagcagaggaagactcaatctcaaaaaattaaacataaataaataaataattccttaataaagttgatttaaaagaaaaaaactttaaaaattgaggctgtatttaaacattaggcgatttcagttttctcttaaaagcaaaaggtctagcgtcactgtttcaccttcctgggtgaccacagctgttagagacaagtagcaacttctccactttgttttatttattttgagtctttctctgtcgcccaggctggagtgcagtggcatgatctcagctcactgcagcctccacctcccgggttcaaacgattctcctgcctcagcctcctgagtagctaggattacaggtgtgtgccatcacacctggctaatttttgtgtttttagtagagatggggtttcaccgtgttggtcaggctggtctcgaactcctgacctcaagtggtcctcctgcctcagcctcccaaaatgctgtgattacaggtgtgagccaatgtgcctggccagcttttccactttgatcttttgaaacacaaatctgactgtcttagctcccacggtgttgcctcgctggaagccaccagtccctgctggttaactctttcctggagacaccagcctccttggcgctggttctcagatgttacgtcccctctgcagatatggctgagaaggacaccacctttgaggcgccacccctggggacccagccggactgcaaccccaccccagagaatggcgaggcgcctgccaggtgactcccccaccccttctctctgtttggctgctgcaggagggagctgtccctgccatgcccaggggatgcctgggaggcagctgggctgggggtggaggtggggcctgggctgctcttttgttaaatgtgtgcccatctctttgctgacaccattggaaagccagaaggccttgaaacccagtccctgccctcaaaatgcctggcagagactcggggcagaggatctaggggcccaggctctggttgcgcagtctccagagaaagggaattattcctgaagacccacttccctcttcccatcttcatcactcctgccttgggcttctccccgcagcaccagccccactcagagcttgctggtggactcccaggccagtaagacgctgcccatcccaaccagcgctcccgtcgctctctcctccacggggaagcccgttctggatgcaggtaatggtcccagcccactcacccctactcccagcaggggcttcctcctggggaagtgtggattgggggagccaggagggagcttctcctttgtgggtatggtctgagaagggggattaaggttgaccccaggtttctggcttcttgagttggtgctgtggctctggcacttgctagtgactattcttttctttttgaaacagtctcactctgttgctcaggctggagggcagtggcacccatcttggctcactgcaacctccacctcccaggttcaagagattctcctgtctcagcctcccgagtagctgggtttacaggcgcttgccaccacgcctggctaaatttttttttaatttttagtagagacggggttttgccatgttgtccaggttggtctcaaactcctgacctcaggtgatccacctgcttcagcctcccaaagtgctaggattataggtgtgaaccactgcgcctggctgctagtgactattctttaattcttgtaggcaggaatttttttcacagcttcatcctcgtggcttataattgctactcagaaaataggtctttgttgattgatttcatgactttgactagttgttcgagcctttgagcctcagttgtctcatctatacaatggtaatggcagagaccgtgcagggttataagcagtgtagcattgtagacggcctctgtcagagttagctcttaggctggacgcggtggctcacgcctgtaatcccagcactttgggaggccaaggtgggtggatcacgaggtcaggagtttgagaccagcctggccaacacgatgaaaccacatctctactaaaaatacaaaaattagccaggcgtggtggcgcgcgcctgtaatcccagctactcaggaggctgaggcaggagaatcgcttgaacccgggaggcggaggttgcaaggttgcagtgagccgagattgcaccgctgcactccagcctgagcagcagaatgagaatcagtctcaaacaaaacaaaacaaaacaaaacaaaacaaaacaaaacaaaacaaaacaaacaaaacccccaagagttagctcttagggaaagatgccaggttactcattttaggacttgcagttctagtggctgacacgaggtggcagtagtgctccggccagagtttctgaaagtgcggtcccgtctggcagcattggcaccggctgggaacttgttaggaaagcaaattatgggccccatcccagacctagagaatcagaaactgcactttaacaagatctccagggcactcatgtgcacattaacgtttgagaagcacttaactggcatatactactttttaaacatctaaacatggacttcaataaagtgcaatcactagctctatgatctctgtaagtgacaaaagggaaaaacgaagcgagtttagtaccgaggtgtgaagaagtagatctagataggggttaagagcgtggccctgcagtccccccggcctggcctggcctgggctggggctctgccacttactctcagggtgaccttgggcaacttaacgaactttcgtgagcctcagctcccctcatttttaaactgaaggtagtgacggtgcctagggcatagggttggggatcattcattcagggaacgcttgtggggtgtgtttatgtgcagtggggactccatgcctgccctcatcaagcaggtctagagggttggccgggaggggactgggttcaacctcttccttcccctcactgcttggccctccccaccctgactccggccacaccagcagtgctgccagatgccggtcacaccgggccctcgtccacagtccccaaattttggtctattggacctcaattcctttgttctggctcctagacgcctcaatttctcactctctagacacagtttgcccttctctcagccttcaatagttgatcagcttcctggagccaggcgagggagggctggatgagataagagccttggcttggaaaggacctgttgttgttagccatgatggaagctgtgtcccaggagaaggaggaagtcgtctggggctggggctgtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagagtaagtggctgtgtccttggggccttggggaggacaggttgctctctgccagcctggcctgggttctttccctgcctgctcctgctctctgaggccgccacccccagccttcctcctggtgtcgtttcagagctccacctgtgctacccggtccagacctcccagcccaagctagagcttgtgggtgagtgtccagccgtccaaaggggctgcccgagccagaggaacacagggcagctctgggcccggggcgtgggctccagagactgaacttctaccccagcctcgaagctccctgtctgtggctcctgtcgcattctgtacatctgtagggatgcaatgtgggtgaaaactcatgcgtgtggagaatgcaatgaggtgaagactgtactgggtgtgacgactgtgtggcttgcccagagcagcacctggatggatgctggcatgaacgtttaaaagtctatcttgtctgtcactttttcctccagtacccccagggggcattcctgccagccttgccttcctctctacattctaccctccctttctccctctccctccttctctttctctttcccctctctccccctcttctaccacctggcaagtcagcccaggggcaggaggggaaaggagcacatggggcaagagggaccctggttctgccacttacaagctgtgtgaccccgggtgagttactgaattgtcctgtgtctcagtttcctcatccggaaaatgcagatggtagaatctacttcagaggcttggcctgtggattcgtcgaggtcgggctgttaagcgcatcgtggagtacctgcctgcagtcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttgggagctggaaccctcctcacctgtccaggcagggtcgtctatacagcgtgtgtcttctagctctcacctggggcagggggctcccagctatcttgtgccaagcaccttctctctcctgggcagccccttcaaggcaggccagggtcttcctcagcactgcatggcatggattgggtgcctgctctgtgctgggctctgatgggggaatcgtctgagccttcgtttctgatttgcaaggtgggctcccatacaggcttcctgtactcccccagtgatgacctttgttctgcaaggaggaggcagggctcagcaaggtggacggctggcccagggccacacagcctggcagtggcacagccagcctcaggcactggtcctaggggttttggtttgtaaagggctcagccctgtcccctcttccttccccctgccagctctgtccaccatcgcaatgcctacccaagagccacgtgctcagcctaaggccaggccctggcccgtcccctgatctccccaggacccttgcagaggcccttgcataggctgactgttgacttgggcacaaaaacacagtccactgaggcatgttttgaatttgacgagtttcacaagcaagcactgtggtccctgtgcaaggggggtttttgtgttttgatagtttcaagcctgtttccatgacctgtcaggctgagtgtctcattgaaaccggcgtttgctttcttgacatttttctagtattagaatttccattgccgtcagtttattttttttcttcaaacctctgtgagagcagttttgttacagaagaaaaaaagaaagaaagaaagaaaacaccttcccctaagaagccaggtctacaaagaactgagccctgagactcaatggtggacatcttatctcaggtcgtttttgaccctctagcttctggtgggaccttggggtctgggttccgaggctcaagatggacagaaagtgaagccaagacaggcaagctcacagggcaccgggtgagaatggaccgagctggccggatgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctcttggttcctttgagcagtgagcacatcagggatctgtggtccgtgcaggtgcgatgagaggcccaccaaccagccctcgagtggatcaaccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagccgtaggacggggattttatcgtggttgttgagatgtttgtaaaaagatttttcacccttggcaccattgacatttgggaatggatggttctttgctgtggagcgctatcctataggacgttgtacagcccctctagatgccagtaaccttccctacttgggacaaccaaaaatgtctctagacattgccatgtggcccctggggaaaacctcctggttgagaaccactggtctaaaattctttttttttttttttttttttgagacagagtctcgctctgtcacccaggctggagtgcactggtgccatctgggttcactgcaacctccgcctcacgggttcaagtgattctcctgcctcagcctcctgagtagctgggattacaggctcctgccaccatgcctggctaattttggtatttttagtagagacggggtttcaccgtgttggccaggctggtctcaaactcctgacctcatgatccgcctgcctcggcctcccaaagtgctgggtttgcaggcatgagccaccatgcctggccttaaaattcttttaatccttcatttttatgagcacttgagtcaatttctattattccagggagatttaggttgaaagaaattctttttttgttttgaaacagtttcaaacttatagaaatggtataagtatgaagaattcattttgacctgaaccatttgagagtaactgactgactggatgtctctcaccccgaaaacttcagtgtgtgtttcagacagacaagggtgtattttacacgatgtggtaaggatcgtcagaattggaattcacactgatacatgacccacaatgaattctcaggccctgttgaagtttctttatttgtcccaataatgtcctttatagcagaggactccagctcagggccacgtgttacatttgcttgtctggtttctcgagtctccttctgtccggatccgttccccaggcgtttctttcacttactgggaagagcgcaggctggtgatttcatggatgctccttgctttgggtttgtctggtgttttctcccgagtggattcaggtcatgcatcttgggctggaaggtcccaggaatgatgctggcctcttctctctcagggcgtcctgccaggtttcgatgtctccctttcctggtgctgtgtactttgagcgctcgacggaggtgatgtcctgccgggcctctccactgtgacgtctccatttgctcctcggtcattactaagtctttaggggcgttacttgagactatgtcaatagcccattcttcagcagaccttcattttctctatttatttgtttatttttttgagacagggtctggctctgtcacccaggctggagtgcagtagtgtgatctcggcttactgcaacccccgcctcctgggttcaagcaattctcctgcttcagcctcccaagtggctgggattacaggcgtgtgccacacaatgcctggctcattttttgtattttcagtagagacagagtttcaccatgttggccaggctggtctcgaactcctggcctcaagtggtcctcccgcctcggcctcccaaagttcagggatgacaggcgtgagctgccaccgcgcccagcccagaacttaattttcttcacttacatatttatatctgtatggattcatggggccctgttctgttcaatgggttgtaatctcttaccatcattttttattttggtgctcaaatggtcccagatgaggtcagggagagcccctttaagctggctcttgtgtgctttggtgtatcctcatcctgtgctttgagcacgtcccttattctgagatgttcccagcttaacttgtgtgctcctgccccggccctggaatcagctgcctctccaaggagcccggggtttgcatctcggggtacctgttgccaaagcctagctgaacctctgtgccaaattccccccttgggcctgttctgcttcccacagcactggggaatcacaggccagagaggggaggggactaaaagtggagaataacagggatggaagggaccgagagctttacatcgcatgtgagaacgcacgtgctccgtgagcgtgggcttcagagcagcctgtgacaccgtgcacttgtgcaagggggcctgctgctgcccagcatggtcctggacttgtgtccctgggggtaccagacaggcttacaagaagacagtggttattccaaaaggcaaggaaaccaacaaataagactagcagatagaatcaacatttttaggggaagagcagttatgaaatctgacctctgtacttggcaagatttgttctgggtctttatcaaaatcctcatgggttgtaacacggctcttgtcaatgtcagagccttccagattccgcctttttacctctgtgattttacacttgtttgggagagtcggtattgaactctgactttccattcagtgtgacggagtgcagagccatgttacttaccatcctgggcttttcctgaacctgctgtgtgctcaacagcatcctggacaccttctttttaaaatattttaatttttaaaaattctaagtaggccaggtgtagtggctcacacctgtaatcccagcactttgggaggccaaggtgggtggatcacctgaggtcgagagttcaagaccagcctggccaacaagacaaaaccccatctctactaaaaataaaaaaattagccaggcatggtggcacacacctgtaatcccagctactcgggaggctgaggcaggagaatttcttgaacctgggaggtggaggttgcagtgagctgagattgcaccactgcactccaggctgagcaacagagcgagcctccgtctcaaaacaaacaaacaaacaaacaaaaaaacattctaagtggccttcatttttaagttttttgttttttgttttggagacagggtgtcactctggagtgccatggtacaatcatggctcactgcagccttgacctcctgggttcaagtgatccctcagcctccccagtagctgggactacagatacacaccaccacgcccagctaacttttctattttttgtagagaccaggtctccctttgttgtgcaggctggtctctaactcctgagctcaagtgatctgcccacctcggcctcccaaagtgcttggattataggcgagagccactgtgcccagctagtcctcattttttttttgaggcagagtctcgctctgttgcccaggttggagtgcaatggcgcaatctcagctcactgcaacctctgcttcccgggttccagcaattctcctgcctcagcctcccgagtagctgggattataggcgcgcgccaccatgcccagctaatttttgtatttttagtagagatggggtttcaccaggttggccaggctggtctggaactcctggcatcgtgatttgcccacctcagcctcccaaaatactgggattacaggcatgagccaccacgcccagtctcatttttaaaaatagttttagatgtacagaaaattggagaagacagcacaggagttcccacatgccccacacccagtttcctctgtgattagcatcttaagccagcatcgttcatttgtcgaaatatgtgaaccattattgacacaggattacaaacgaaagcccacactgtgttcagggttcccttgcattgcctaaggttccaggatcccatccaggagccacgtcacattcagtcatcatgtcgccttaggctactctggcctgtggccgtttctcagatcttgtttctcaagaccagtttccctgatggccttggcagtttttgagtattgatcaggtgttttgcgggacgcctgtctcctgggatctgtctgatgtcttccccatgattagactggagttatgcattgggggaagaagaccacagaggtgaaacgtcatgctcatcacatcaaatcttggctgggcgcagtggctcatgcctgtaatcccagcactttgggaggccaagcctggcagatcacctgaggtcaggagtttgagaccagcctggccaacatggtgaaaccctgtctctaccgaaaatacaaaaattagccgggtgtcatgacacgcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaatcaacctgatttaccactgggcaccttcacttttgatatctcttttaatcttctcaacaagccccaaagttgatgtgattcatcccattttccagctgggaggacagaggctcggagaagggaagtaatattgtgctgagtttcaccgccaaggaggcccctgctccagggtggctaagcggcctcattgtttttgacatttggctggttttcaatttgagggttattataaacccgctgctgtgctcggcctttttgttttctttcgggttatttcctgagggtgtgttccctcaagagggatgactgggtaaagagtgtgaggtttttgttgccagatggctctttagaaaaatggaaccagcctgcagggtatgggcagctctgcgatcccgttcacccacttccccttcaaggccgagttgtgtcatttttatttattttgttttgttactttgtcacactttttttttttttattctgttggccacccccagtgacttggtaccaaagaacagttggctgcttgtaaaactcaaaatcactctggagggaccatgatttagtttcactgacgtcattgaaaagaatgtgcctcggccgggtgcggtggctcacgcctgtaatcccagcactttgggaggccgaggcgggtggatcacgaggtcaagagatcgagaccagcctggccaacatggtgaaaccccgtctctactaaaaatacaaaaattagctgagcatggtggtgcgtgcctgtaatcccagctactcgggaggctgaggcaggagaatcgcttgaacccaggaggcggaggttgcagtgagccgagatcgcgctgctgcacttcaccctggcgacagagttagactccatctcaaaaaaaaaaaaaaaaaaaaattacccctggccgggcaaggtggctcatgcctgtaatcccagcacttcgagaggccgaggcgggcagatcacctgaggtcaggagttggagaccaacctggccaacatggtgaaaccttgtttctactaaaaatacaaaaattagccgggcgtggtggcacatgtcggtaatcccagctacttgtgagaattgcttaaacctgtgaggcagaggttgcagtgagccaagatcgtgccactgcactccagcctgggtgacagagtgagactctgtctcaaaaaaagaaaaaattacccctaagagtgtttcccaaactcacctagtgtccacacagcgtgttcaaatggtcagtcttgcgtatactttatcctacttgttgactgagcactggtgagcatatctgtgaggactcagggctggtggctctccagagctgctgaagtcagagatgtgtgcaggaggcggcgtggctgacatacgggcatcttggtggcagatttgtctagccagggatgtgtgcctgacaacagcatattccagatctccgtaggtagcgttctcaggagtggttaaaagctgggcatccctggaggatggtctgctctgggaactgacttgctccaggatgagctagatgcccggatgccctctcacctttctcagatggccagtgagccaaggttaaatgttaaatgtcaatatgtgcttgggcgtgacctggcccctgtttaatatgggagaacaatgggagtggagggtagaggtttgagatgagaagatagaggttgtgcgttgagaatcattgtatcagcacctcctgagcctacaaaaggatgggattgaaggaaatgagatggcccgagagcagttgtcctcctcgaaggctgccacctgggtgctttcaggcacaagaaagagaaaatcgaagtccagctggagtcagaagggctccacagcagactggcttcgggcgtgtcccaggcagggtccaggtggcatctgcaggatccatcatcctgtctccatgacctgccttgaggtcctccatgtgggttttgcctggtattccagagaattcggggctctccacaccctggagacagtaaggtgggcgcagcagccacagacgagcctctgacccagtggaagcctcctgggctctggttgggcctgtgcttctcgtgaaccaatccttgcatgtgcgcgggggtgggggttgggagagtggttcagtgtgttcattggtttagtcattaggaatgagagtggcagccaggtgtggtggctcacgcctgtaatcccagcactttgcaaggccaaggcgggcaggtcaggaggtcaggagtttgagaccggcctggccaacgtggtgaaaccccgtctctactgaaaatacaaaaaaaatagctggggttggtggcacgagcctataatcccagctattcgggaggctgaggcatgagaatcacttgaacccaggaggcggaggttacattgagccgagatcatgccactgcactctagcctgggcgacagagtgagactccatctcaaaaaaaaaaaaaaaaaaaaggaatgagagtggccaggggatagaggtggtcccctgtcctccatctgccactggagaagtgagcctccttgccttgagctggggtgggcactgactctgaaacccatcgagggctctccagactgaggacctgacccctgggctgagttcagcaccacctgtgatccaggaggaccatttgccaatagttggggcgggtggggccgggggctgccagactccttggtgaagttgctgctcttgctttttgcagattccagacccaggaggagctcaacggtaagtacccctcccttgcccccacctcagcttcgtgcccctaaatctgactccttccctaacagatctgaagttttgagagctgctgggggaagggagagggaggggacggactggccattcccctcccacagtgcccagggtgcaggcccgtcctgcaagttcaggctgagtctgacccaccacagggacctctgtgcacagaggcctcgcctggggcctcagccaggccttggctaaggatggagagccccaccctcatagcagcctccagctcctggctcagcctgccgggaatttccagaagggcctgcacacagtggatttggtttgggccacttttgggtaccaggtctggtcaggaggaagactgtgttcattttccccttttctttactcttccatgaatctcatcctccaagctggatgacagagcaggtggctatggtccattcctttttttttttttccccatctgtcagttcttccattactttcttttaattcaagcattcatacattaagaagggtttctatcctttcatttttcaatataatatacacaaccataatgctagttcagtttcaaattatgggggatcacattcgaatatgcttggatgtgacaagtggctgttacaatactgagaaatttcatgaaagaggtattcaacaatttgtaaggtaatcaaatatgtttttgctgcataggccaatgcattaatagtaacttgttttaaaatgcagtcttttggccggatatgatggctcacacttaaaatcccagcattttgggaggctgaggcaggcggatcacctgaggtcaggagttcgagaccagccttgccaacatagtgaaaccccgtctctactaaaactacaaaaagtatccaggtgtagtggcacacgcctgtagtcccagctactcaggaggctgaggcaggagaatcgcttgagcctgggggacagaggttgcagggagccgagattgcaccactgctctcccagcccgggtaacagagtgagactccatctgaaaaaaaaaaaaaaaaaaggcagtcttttagccttcatattattatgaaagagtattcaagagtatgtattaaggttggtgccatttgccattaaaagtaatggcaaacctggtttaacccttctgataggtagttgtggatgttggggttgagaacagaataatctttgtctggagtgacaccacactctagaatttccactttgaaaaatactcagttctttttttttttttttttttaatttttttagtatttattgatcattcttgggtgtttctcagagagggggatttggcagggtcataggacaatagtggagggaaggtcagcagataaacatgtgaacaaaggtctctggttttcctaggcagagggccctgccgccttctgcagtgtttgtgtccctgggtacttgagattagggagtggtgatgactcttagcgagtgaagaatactcagttctaagctgtggttcctggtagaacaaactttatttttctagctcagcagtgatctggaagctgaggaatctcagcgccttttaaaagttattatgtggttttgttttaaaaagctcctgttttgggaaagtagaatttatgggtataacatatgttcattatttgtacataaaataaaaccatttaaaaagtaaaaaataataataataataatggcaaagacgtgattacttttgcaccaatctaaaagatacgccctctgtgccttgagaatcattgcgtcagcacgggcatccctgcctcctctgaattactcacactcactccattttgaaggcatcaggacatttcatgaggccacttctttgcccttacctgtaaaaatcaaaaactaaactgacactttcctcatgacatagctgtttttttgtttttttttgttttttttttgttttttttttagcatttagaaaatatttattaataatatacatgaatttagattatatagtatagaggtcaccgggcttgtcacttgaactaacagtagtctgtttttagaatgcttgagtgtgatcataaaagactactttccaggatgtcggggctggggagctggaggggctgctccaggaggtgggggacctggagctggtacttacagacttgggtgcttatgagtgtgggttatggaccagatgccagggttcaaatcctagctcagatacttattgatggtataaccctgggccaattactcgactcctctgtgcctcagtttcctcatctgtaaaatggggagtgggctgttacccacctcatacagtggttgtgaggattaacatatgtcaaggactttaggacagggccaacggacgtggcgagcaccctgtgagtcgctgactgttacccctactatttagtacaaattaaaagcaacagacttcacccagaaagctgagaagcccggggcagctcatggcagcttttaaagcagaaagggagactcactggggtctgtagagatgaaaaaaaaaaggggcctcccagttcagagactggtggggaggttgggggtaccctgcagcagcacccattcccgtcccacagcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattggtgagtcagcctgttttgggaggtcccctgcagcccaggggcagatgggagatgaatacggggccctgggccctggaagggacctggagaccctggagttgaaaggcccaggaaaggagaggcatagattcttcaccccaactgaagtttctgtaagtagggacagcgagggtacttacctcgtaggccattgtgcggattcatgagccagtgtgcatgagatgcctgctgttactcataaaaaacgaacaccaccccagcccccaacaccgagcacccgaggggacaggaggaagacgtgccagtggtcacaggacctgccacttgtctggcgcattccgggcactgtgtaggtgccatctcttcatctctgatggtctcaccaccttctttggatggtgtctttctccccattttacagttggggagaccgtggctcagagggtgaagtgattttccccattgcatggctactaagtggcacagctggaactcgtcccgcatctgctgggccttgaagcccgtggtttgtccacgttaccacccaccctctgcagaagcaggaggacagatggggcccagatgttcagagcttcccaacggcagctgctgccagcctggacagacattggctttggcctcctgtgggcctccctgcctcctctcttgcttctcatcaccttggtacggcattttccccaaaatgtatacctgaccctattgcactcctgccgagaagcctccagcagcttcccattccctatgggatgaattccagcattcttattccagcactcaaggctgacagcaagttgtagctccccgaccagactcacctaccttctgaccccacagtctgtccctccccctcatggcagtctcccaaatttacagacccctctgtcacttctgagcttctcaatgggagctaccccctcgcctgaaatagccaactccactgccttgaatccagttaattctggatatcctggggaccctgcttatttgccccttcctccaggaagccttctgtgccctctccaccatgctatgctccctaagaacccaggcctcccctacccggtgtcctagcacccagtggtgtgactgcgtgtttatagccttcctccacctccacctggctttgtgctccctgtgggcagggccttggtggaccccacctctgtcgcttctggaagggtaactggcactgggataatactgaagagtcatttgtaattgtcctgtgcatttctatggcagacagtggtggccagaactcttcagggcagtcatcttctctttttattttttcagcctcctgagtagctgggattatgggcgagtgtcatcatgcctggctaattttttgtatttttagtagagatggggtttcactctgttggccaggctggtctggaactcctggcctcaaggtgatctgcctgccttggcctcccaaagtactgggattataggcatgagccaccatgcccagcctgggcagtcttttgtaacaaactgaagcttttgaaatggtagcttttagtaagttttatttgaaaagtatgtattttgggaaataccatcaaaggcttcttcagaattcctaagaagtcctaactggaacttctgagtccacactgagtacagtgcctggaatcccaggggtggggttcagagggtgtttgatggggaggagaaggaagtaccaggctcccaggcagctggctcaggtgtgggctgccctcccctggcatggcctgcaggccttgctggtgagtggatcgggggccacctccgccatggtggaaagggaaggccttggaggttctcttgggcacccaagacacaggcaacccccttgtcctcctaatgccagcccagggtagcgttcccccttcccatccagttcccaagaggggtcacactggggtctgtacatcgtccctcttcccctgggaaccaggcaagggaagaacccctttccccccaacttcctcacctgccctccccacatagccaagatgaattccctggactctggagctctggggagggggcaggaaatccatgcagcccttggaagccacccccacagcctggggagtaggcagcctgtgatgggggcagagccagagcggggcagacccctcatggccggctctgaagtttccagacccctctttcacttccgagctcagtgggagctgcttcctcacccagagcagccaattccaccgctttgaatccagttaattccagatttcctggggactcctgcccatttccctgaggaatgtgaggggaccagcctgtccccagctgtggctccttctccctaatccagcacccccaccctcacttccctcccacctgaccccacccgcctctcatcttctctgcccatccccctctgggccttctctcccctcctggggtctcctctctcaccacccccggcccccatcttttgcccagccctctatagggctcctagggctgggagcccacaagcctgatggaggtgtggggagtgctgaggccctgctctgttttggggtctgtgggggcgcccagcccatagcctgtcccgcactctgggccttctcctcttgctgccgtttggcgcacttctctctttcctgggggtgttcaaaaccagaatagaagaaccagcgtcatgcaatagggttgagggtgtgggggactcgagaacctttttggggttcctgaatccgaggggtataactgcattacccagaaaggcaggggtccctgcacccccaccccaccccagctctcaagttccctcttgagcttccccattctggcctccagagtccagcgcagaacagctgggagccagcccaccctgagccagacaccatcagctgggcggaggccaggcttccccactccccagctcctcgggccactgaacctgagcccccatgtcccctctatcagaaggccacaccagaagcccccacatcagactgtggcgaggaccggccctccgtccaagctcccaccatgtgctcacagcacagccatgcacgctgcaggcaggagaccggctgtgagcagtaagccccgaaattcacggcctgagccaggctgtctcaatcatgggctgccgagacctattgagggggccgggttttctgcaggatgtgacaggctggctgagtttgcccggaccgaggggactcccaggacacgggacttgcagtagtagaaccaggaatgttcccgggcaagctggacaagttggtcaccccgggttttggctgcaggcacacagataggagcagaaagggccaccaggcggagtgggtggtttttttttgggggatttctcctaactacgtggcgaccttgggcaggtcatttaacctctccaggcttcagattcttacctgtaaatgggaatcttgatggggtccgccttgcaggagggctggggacccaggagtgggggtgtggaaactgctcagctctgctgtttctgctcgtgctctggttacccacggctttgcctgtttttgtccacagtttgctttctgtcccaccctgtcctcttcttccctacccatccgcagagatgtgctgagaaaatcctaagtacaagtgggctggttcttaactcctcaaggcccagctcctagctgttctatttcctctgagcccccaggatgcctgtaaggtacatcagagaggctgtgccatcagcctgaagccacccggcaggtgtaccagcactgggcctcggcccttctctgcctctttgctcccatcctggctggtgctctggcctccctcgctcacccatccttttgccttgcagagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaggctgaggacatgatcatcgaaattgagagtatgttattaatagaacccctgagcagaagtggctttgggagtctcccagcagggcagggattcccactgaacccccaggcactaaggtggccagtctctggtagattggatacttctggggccgggagcccacttcctgctggggcagtccttcttgttgctggaagattttccttatcactcgaggcaaattctttctccatgtaattgccgctccctggtccaaaggctgccctttgaggacactcaaagccactgtcggccagttgcggtgcctcacccctgtaatcccagcacactgggaggccgaggcgagtggatcacctgaggtcaggagttcaagactagcctggccaacatggtaaaaccccgtctctgctaaaaatataaaaattagtcgggtgtggtggcgggcacctgtaatcccagctactcaggaggctgaggcaggagaatcgcttgaacctgggaggtggaggttgcagcagtgagccgagatcgtgccactgcactccagcctgggtgacaagaatgagactccgtctcaaaaaaaaaaaaaaaaaaatgccactgttgtcacaaggctccctttaggtattcgaagaaaggtttctgggcctccccatggccttcctccctctgggctgggccgggcagccccatagctttggagaagggattctccaaggaacagcgtgagtgcccaagccctgggaggcagggggaggaccacaggtatctgggatccctgggaggcagggtgaggaccacaggtatctgggagtgttgggcttcagtgtctgagctgggaggagcccagcctgcctccctgggcacagctttgtggcactttagggccagcctccaccccaggcagccagcctgaggcctcctctgactgtctcctgtgcgaggtggagaacacccacagccacagacagaccctgtccaccccatccccaagactccagcccacacccacacatcagcccagccattgaaccagccatgcactcagtccaggagccagggtggatttccccatcctgcccagcgatgagcggaccccttctattctctggctgtgctcacgtccaggttggcagatggacagagctccctgctactcaaggtagcaattctcaggctgtgacgacacccccacacacctcttcctaaacatttgcgatcagagagggacagcaagtggtaagtatcagatggaagctgttgccttcaaagaaaagccattgtttcccaaggcacttttgtaggtggtaaaaaccattctacagttcacagaatctccacggctcgggtcagtccctaaaacggaacgaggggacctccctagagcgtctctcgctccatcacgacctcaccctccaacagtgaggtgtaaaagacccaaggctgggtcttggtcatctttgtcccatggtcactgggcactgattggttgggctaagtagaaatgaaaacctgtgtggggatgagaggcggctctccagccacagttcctcgggtgccttctctcttccccccacttcctcgatcctctgcagtgggggggcaagtgtggggtgggggttgcttgggccagaatatgtggggacatcagattcacagccacggcccaagagaaaagcttagtcaaggcgagactgttcagcttcaaggggggctccttgggctgaaggagaagctgctgaggacacctcaggcccctgcaccctccaccaggcccctctgccaggcacctcctcctaagccagcaccccatgctggccaaacaccctggaacccttgcccctggctgacccaggggagcaggtgttcaatgttggggccatgggtgtgagccaggcacagggcagagaggcttgcctgccattctctgcagc

SEQ ID NO: 11920 - DNA, 45539 bp, Human
  misc_feature (1)...(45539): n = A,T,C or G
atcttttttgttctttagatctctcagtatattcctgtgcccaagccaggctgtttttattactgtggctttacaatatgttttgatagctggtgggcaaatctgtattattttataatcaggaaaactcacaaaggagtgtgtgtgtgtgtctgtgtgtgtgtgtgttcttgcatgtggaaggtggatgaggaaatgcctttgaatgactaggtctactttggaagctgcaaaggagtttgacacagtgcctggagcagagtttccagaaaagcttggaaaaataaaaggagaattggagactacagggctctcaaaggaggctgatgctcacacttacaaggtctgtaggttgatgcaagcagagaggaaagctggcatggactgatctctgttatttttatacactagcactaactgcctttcaaggcccattaggcctggaaaccttttcccagcccctgggaagtcactggggatgctaaggttagtcattcacccactggggctatctaactgagctcaggtccgggtgcactgccagcagctgtttgtgtacttacagccccctgggtgcagacggacccccagctgccagccatatgccttatgtttcattgtcccacagctttcaaagaaaacaagtcttttaattcagcaagtattcactgaatgtctgacacccccagtgcagaccctgtcccaatcccccaatgggtccacctctatccaactctgggtgaatgaccatggtgctcttgcgcgcgggcacacacacacacacacacacacacacacacacacacacacaggcacacacacataactcaggcttggggcccacctctctgggctcagaggtatcaaagcaggggcattcctatcttaaggacttcttgtcttaggggctttggccccacctgcacaggacagaaaattagtggatttctaggagaaagcaggctatggcagggtatagccagggactcagctcttccttccagacatgcaggaaccataaggagggatggtcaaacagggcctgcttaggcctcttgctgggatcactccaagggtctctggggtcactcagaggagccgggaggctgcctgctgctgtacactgagacagactcctggggtgtttggatcacggcagcccacatgctgcctttttgttatcttttctgttttgcctcttccgggctgtacttgtcttgagtttttggccttatgacatccatattaaatggggtagggcagagcattgctcagtaaacagcaagaatggccctgggcatggccaaggcagttctgctaagtgtgaaagggaatgtgcctgccatactttgtgctttaggcccaagtgacctaggggccagcctgcctactggcctcactcccaacattacaggtgtttgactctactccaccccgtggagagacggagcacaggagccacccaccggggaccacataaggtcatgcacacccacagagtgcccagtccctgcctggccttgtccccattttccctccacctagggttggggtgacaatggaggtaactagaagacagatcaaaaggttcttggtcttgacacagatgcaagaaggaggcagataatagacacctcccttccccctcgcccacataggctccggtgggttctcagggcaaggcctggctccctcctctccgacttcaggtacaggtgagtgtggagggaactgaaagaggaaaggtgaagtgctgtttggcttcgacctggagggggacagaaggctctctgggcaggcagggccggtcttttggcaagaggcgcgctctctctcccttccccttccatcgagggctgggtgtgaaggtgagagcaatcagaaaagaaggtgaagaggtacttggccttgacacggacggggggggcggtccaggccgaggccgccccgcccccgccccgctatacccggcgccgcctcccggcgtctgagctgacacctccttagcgctggccgcgggccgcctctgcggcagcgctagtcgccttctccgaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacggtagccccaaatccttgggcggctgggaggtggtccctgtcatgcccacgacgggtgggcgcgtctttaccgacagcctgcatggatccgcagatgtgctgggcgcttagatgcctgcggctatgcagagacgcagtccagagaggtgaccccagatcctggtgggggctggatcccagggccccgacatccctttgcaatttccagccagcagctaaagactcccttcccggggctttagagaggctccaggctcgcgatccatgaacacacaaaaaccttccttgctcatgttctgaaaaaaagccccgcctcagctttgtgaatgttaataatagggggaagatttgttctctcttgggtgtgtgtacaggtggaacaatctgcagaaaaagaccttttttcggaaaaccttttcagtttgaagtttcagcaaatccatttttcatttccttgcatttggggagatgacatgaaatttaagctccagctttggggctgtctctgaagttctggggttcggcttacctttcccgggatgaggttttgatttggaggaagtaaaatgggttttgtcttaacctgggctcgttctttaaacttgtgaggccggggcggtggacttactgacatcctgtattctctcacctgcagctaggagaaaagatgttcactgtgctgacccgccaaccatgtgagcaagcaggttagtatctctcagcaggtagcaagcgtggttttgccaaatcgcaagagaaccccagcttcggcctacagtttttcatccatatcccctgcaaatgattgtttaactttattggtttgagactcagtactcagctgggtttcaacaccggcattcctcaaataaaagtaatgcttttcatcaaagccacacaaaacaaggactaacatgcatgtttcacttaaatggtttttccggtttgtataatccattaatttggcccttgtggtttcccttagctagctgtgtgtaacgtttgctttagaatactgtattgttgattttgtgatcaattgtacagtacttggatctttcctgtattcccatccaaatgttgctggcacagtgcctacaacacccccacccctcactgtgagtcagtgttgttatggttgatactgcaggcacaagtgcaggattttctcacactggaaggcacacacacacagacacacacacacacacacacacacacacacacacacacacttctaagcttgccccgcctgcctctagagcactttttggagttgctcatgtggaagcccagaaggctctggcttctccaagctcaggtaggtaccttgcaattaccatgtttgtccagccctaatgacagcacagctctaggctgcatttcctaaatgagtaagacctggtctcatccattttgctttgtaataagcttttctgcaaggacaagagtttgcttaaggtaatcatagctttttacttgaaaactgctgaaacacagaagacttaggaggccagccacgtagctgtggtcaggaaactgcatacatatcacacactcctcccccatggatagacattctttagtcatgcccctaaattgggtattcttgtcttccaaaaggatatgattttaggatagtaagggcaatctatatgaacttttatttttgtaaagggacattgcacttgaggagctgttttcctttgatctttaggttttcccccaaaacactttgaaatgttaacacagattgtaacgtcactcatacagactaacctgttacattccttccaaaggacaagtttaacttggcagattaaatttctaccccattttgttagagggaaaaaatcccttaaacttctataactaacactgacaaatgcattctttgaaagctaatgcaaaagtttgcctctgtggattaactggttcctgtacttttatttggaatcacagaaaagtgatacaggacctctttacatgctctgcaggtcaactccatggcagttggctctcctttccattgctattacccacaattctgtaatgagtaaccttgtgtctaagtcattttacacatgtggagctagttctgtgggataacttcccaaaagagtgattgtgagtcagatggcatgcttatttgcagttttcataaatattgacaagttgccctccattgatgctgtaccagtttacactttcaatgacaaggtaggaggattaaggtgttaagtgaccaactttgacaccaagaagtgtctgtgactgcagctacactgcaggggaatcagttgagatggaaagagttagctgttctgagccatgaagacctactgcgtgactgccctcctgtagcaaatgttgtgatgtgactgaatttgggggctgaatctaattatatcgtgggcgcatagacatgccctgttattcttctgggaaaatggcttacagaaataatggaggggtaaagcataggttataatgatctaggaataatgttctggaataagacaggatctatccaattgctgttcaattgatcttcctataatgatgaaaatgttatatggctgcactgtccaatatagtagccactagcccacatgtggttattgaacactggaaatgtggctagtaagattgagagactgcatttttttattttaattaatttacatttagatagccaattgattagatatatattggaattcgatgaatctagtgatctttctattagtgttcatcatatttcaaccatttggttgtcatttatgttgatgtcccaatagttttaccaagactattattattatttttttagagacaaggtctcactctgtcaccaggctggagtatagcggcacagctcactgcagccttgagctcctgggatcaaaggatcctccaacttcaacctcctgagtagcttgggctacaggtgtgcaccacatgtacagttgatttttttcattttttgtagagacggggtctcactatgtggctcaggctggcatctaacgcctggcctcaagcatcttcccatctcagcctcccaaagctgggattacaggcataagccactatacccagcccaagattattatttagtcagtattttcattgaatgtctttttatctttttaaaaaattaggtataacttctattcagtgaaatggatagatcttaagtcgtgcccctaagttgggtgttcttgccttctaaaagtatgtttttagaatagtaagggcaatttataagtttataatgtttttttaaaaggaaattatacctaagacactgatttgctttcattttcaagttttctccaaaggactttgaaaggtttgatgagttttgacaaatgcacacatccatatactccacactctgtatagcgcattgccattaccccaagaaagtgcccacatattccttctcagtgaatccctgccccaacttctgccccctggcaatcactattctgattcctgttaccttcctacttttgaacttcaaataaatgaaatcatttcagtatagtatagtactaatttttttatttttattttattttattgagacaaggtcttattctgtcacccaggctggtgtgtagtagtttgatctcaactcattgcaacctccacctcctggcttcaagcaattctcccacctcagtctcccgagtagctgggactacaggcgcatatgatcacacctggctaatttttgtatttcttggtagagacatggtttcaccatattggccaggctggtcttgaactcctgacctcaagtgatccacccacttcggcctcccaaagtgctgggattacaggggtcagccatctgcccagcctaatttctttttctttaactgagattatttttaaatgaaatattctatgagattatttttaagtgaaatattctatcacctggtttaattttttaaaaatagattttttgaatctccattaaaactaatgttagctgggcgtggtggctcacacctgtaatcccagcactttgggagaccgagacaggcagatcacttgagcccaggagttcgagaccagcctggccaacatggtgaaaccctgtctctattaaaaatacaaaaattggctgccgtggtagcaggcacctgtaatctcagctattcaggaggcagaggcagaagaatcgcttgaacctgggagttggaagctgcagtgagccaagatcacggcacagcactctaacctgggcgatagagtgagactccatctcaaaaaaaaaaaaaaagaaaagaaaaagaaaaaagtaaaacaaatgttattgtaattcatctcagggataaccaaaatatcagaaaactagaccatgcataccctccctgcaacactgttttagtacacaatttgtgaggaagggcaaataggtattgtttgtgcttccccaaaactggggagaaggggagcttatttgctactccatcttagaagtgtgggtctcgctaacaccagagaaggtggtttatgcacctgattatggggccagtccatcaattctacaaagaataccagtgcctggtttttacctccccctcaagtgtcttctgggtcttctcattttaggcctcaaggccctctaccgaactccaaccatcattgccttggtggtcttgcttgtgagtattgtggtacttgtgagtatcactgtcatccagatccacaagcaagaggtcctccctccaggactgaaggtaagtgtgaagggactggcaacaaagggaagaaatgagcataaaggggaagaaatcaattattccaaaaccatgagttagaagagcagaaaatcctttccccccatctctggctgaagccaggagaagttagtgtaagacgcaagggagaaggtctggacatgctgggtttgtgatatttgaggctacaaattgagggtagtgactgacaccttctccaaggactgtgtagtcttgctttgacttctgacttcaaagctaaaatttgtaaccaagagttgcagatagctatcaaagatttaccagttcagccaggtgcggtggctcacgcctgtaaggcactttgggaggctgaggcaggtggattgcttgagtccacgagttcgagactagcttgggcaacatggtgaaacccatctctatcaaaaaaaaaaaaaaaaaatttaccggttagtgcactttccattttgaccagtttatctgttctcccaaccacacaaccctgataatgagtaaagaccgaggctgagcacagtggctcatgtctgtaattccagcacttcgagaggccgaggaagaaggattgcttgagcccaggagttcaagaccaacctgggcaatatagagagactccatctctaccaaaaagaaatttttccaaaaaaaggaaaaaagaagtcaagaccaggagacccaggcacctcttctagcctaggctgagtgaacaaaaaatcaagaacttgagaaggtctccttgagctctatttgtgctgctactcttgagtctagaacatgtgctgtgttccttccaacacttccctcaacaacacccccccggcaaaaaaaaaaaaaaaattactcaggaccttgtgcttagtcccagaggcccctcttagttctcaacaagtccatccccaaatgatctttaggctcagaatcataatatatccccaggcttggctctgagggtgcccttggagacaggaggtgattccatgagaggctgacaagggaaagatgaagcaagttgatgagtccttcaatcattttgggtaggggtcagcaaacatttctcataaagggtcaaatagtatatattttaggctttgaggtccatttatagtctctgttttataactcttctttgttttttgactcattaagaatgtacaaacccttcttagctgtgccatagggaccaggtaattcagccatgttctttgaatctcatttaacatttacacttgacctcacaagtcttttccatatcttcctgctgttagtgactattcaaaggtaatatttgaaatacatagacatttttaaaagaaaagaaactaatattgttttggactctaaggatgggtttgagctaacattctaaggcagcttttctaaaagattagagtaaaatctccattagataatataatagcatttggttccttgataggatattttatttaagaatctcagccctcatgaataatgtgaattaaaaattaaaaaaaaaccttatgcaatcacccaataatgagaagaaagcaaattacccagttgtccaaagatattagctgaggcctaaaagaaggtgttttcccaagctccaggcactgccttctacaaactactgtatataaaattgggactttgggaggccgaggcgggcggatcacgaggtcaggagattgagaccgtcctggctaacgtggtgaaaccccatctctactaaaaatacaaaaaattagctgggcgtggtggtgggcgcctgtagtcccagctagctactcaggaggctgaggcaggagaatggcgtgaacccgggaggtggaggttgcagtgagctgagatagtgccaactgcattccagcctgggcaacagagcgagactctgtctcaaaaaaaaaaaaaaaaaaaaaaaaaaggaactgcaactaagagtaatatattttttattttttattttattgttattattttgtgagacggagtcgtgctccgtcacctaggctggaatgcagtggcatgatcttggctcgccccaacctctgcctccacagttcaagtgattctactgcctcagcctcccaagtagctaggatcacaggtgcccaccaccatgcccagctaattttttcttgctgtatttttagtacagatagggtttcaccgtgttgaccaggctagtcttgaactcctgacctcaggtgatccacccacctcagcctcccagagtggtgggattataagcatgagccaccgtgcccagccgcaactaagagtaatatctctttacactttgtatagtgctattcagttaagtcagcgcttttccctcattacatcacttagttcttatgccaaccatagaaggtggacaaagcgagcaccatgactgccattttgaaagtgagaaaatacaggtttggtcagtgaatgacaggtccagaactgaaacctggtcccttctgttcccaaggccagggctctcttcactgcctcccacttctccctgaccctgagttctgaatggagatcccaaatggagggaagggattggcctcagataagagaacacttcctgctttgcacaggatggaaaggtagggaggatgcatgcagatgtgggaaggtttgttgaattgaaggagaggagttaagcctagtaccacccttagaccctgatagctgggctgcctgccctgggccccacatttcagaaggaccagctctagttgcacttcaggcttatctctctctatgacccaaacgaatgtgtttacccagagcccatgtttccccttctagaacacactgtggtgcccaagacttcagaatctagggtcttcgtggacctccagaaggtggacatcaccaatggtctgaggggtggccaagaggcagctgcttacagggagtgtaaacagagcatagctgtgtggtctgaactgtccacacacaggtgcatgggctctttattctgtgagaacaggtttgggaaagggacagggcagaagcctctattcataaaattttgtctctaatcctacaaatgttagaaatgggctggttaaggcagttgccagctgatggcttctacttgttctggacagtaacaggcaagtcctctgttcaaaatggagagacatggaggaatcagatggaagactagtaaaatgagtagataaaaatagatccctgggcagtctagagggcactgttgaaggagaaaaccacacatgttgaatgctactgtcttaggttgggctctccaagtcaaagacatacgtgcaagtagatcatctggggatgatcccaggaaacactggtgagggactagggaactgagatgggtcaggcagccaagagagggcctgctatgcagcaggtcggcactgtgggcaactgggactcagtcctgcttgagaccctgtgagctggtacagagaactcaaagttgtcccatatcaaggggcatacaggcatgtgcctcccagatatcccagtcaagggcatatttattcaccagcttccatcagtcattagctgagaggctgctccctggatgttaactctctagtccttctggcatattttgtgatcaggtagactcgggccactagttaagccttcaggcaggtggaagatggatagttctacatcacagtagtaaggcctgaggggatgtgggcagagaattgtcagtgactactccatgtaaataatattgttattatccctgtattgcagatgagaaaacaggaaaagaaagggcaaatagcttcccatagttacacagattgaaaatagcagaactggtgtaaaggaaagaaaagagaacagacaacagtggccttaaacaagggtttggaggaaccaggagacacaccctccaccaatcagcaggcagttcaaagaggggattttaaatctcttctgaatcttggtaacagaccctagccaccattgcaagggacaggaaattgtaaaacacaggaagatgagctcggaaggtccattctgcttaattgggtggattaaatgtgagaaaagacagatgttctgggccagttgaaccagaaacggaatgacagctttggaagagagtgttccacatgcagtttttctcaggatatggagagatctctctttttttgttttgaagaggattgcaggtgatgaagttgagcaaatatgagggattttaaattatttgttatgtttatttttttataccatgagccctgttttgctttcgtgtgcagctgacagttggttctaaagggccagctctacaacagcctgtctggagggctctgaaatgttacagaggactctcatgcaaggtcgtatctggctattaaatctaaccttggcttgcctaaccctggtttatgtgaggttatggtcagaactattaaaatgcagtcaaggggcgaaaatgtctgagtctcttgtgttactggtctgacttgctccacaagcttgaagagtaaacatgatgccatcacttgtaattttcactcggcccccagtcccccgctttatcatcatgaagtccaataccttcctcttgaggcttcaccctccctacccctaatcataaccatccaagaactttagagcttctcagtccaatgatcaatactattgtactgcctcttgcagccatgtgatgtcactgttgaagatgggttctgcacagtctaaaggttttaaggatgggcttttccactgtgacctgctcagcccacattagttccccatactgggtccaagatcataagccattttagtctacactcccatgctcagccattactctccaaagcaaaaccactggcccagtctgtgttgaaatcattcccttttaaccctcattgagccttgctcatcagcctggatttctggtgccttgtagcccaccctggtctacttcttggagagtaagagttggataattagtttctttttttttttttttttttttttcagaaagcctcggtctccttatgcaaatgggtcctctcctccagccagatctgcacaccccttaactaagactttactttcaagggactttttgtttaaataagaaagtctgcaatgcacctgattactgaacagtcatgccattacacttggtttccttggagctcagtgaaaacatcatggctatgattactgaacagtcatgccattacacttggtttccttggagctcagtgaaaacatcatggctatgagtacaggttttagagtccgttagactcaggcttgatcccaggtctgtgatcttgggcatttacttactactgtaagcctcggtttgcccatgtgtcgaatggtatgatatgatatgatatgatatgataacatatgtcttatacaggcaataacacaaagcactttctgcagtgcctagaataagtgcaggacaaggcttattactactactatttattatcatagtaataatgataataataataaacaaatctaagaaagttgaccttatgcttctgctttcgctattgctttagacagatcacacaatccttaagtgttggaccaaggagactggccctttcagttaacattaattgcattcactgttagatacagagtaatttaaccagtttccttattctatacatttctaaactgaaagactgcttcctttcagttaatccactgtgtcttcagatccacatttgagccatggttttttctgacactgcattagacagaggattacttactactttttatccgaacatcaccttgccagctgaactgaaattcattcccatcccctctcccccaaaagaatcacactgagtttcactgtttaggcaaaagagctctgaaaactggttaaagaccatttttcccacttttgaaaatgtcagtgaatgatggtagggctagatccgtgtgagtcggtagaggtgggcctatatcagcaggtgccggagggacagccatttctccagtctcacagagcaaagtctggctgctgcagaccctggtgaaagctggatcccagttggagttacaaatgagaatggatactcttctctctgatcttggcccagcagccctgagcttcagaaacacaggaaaaacatgcaccctttttgaagggttggaataaagatttgaggaaaggaaggtgacagtttttctcctattctctctctcctcttgttttatggttcagcaccaggcgtggcagggcgggctggagtggtggtgatcaggtcaggagcaggggggaggaaagaaagcagaccaagaatatagaggcctggacctctttagtttagtgcctggtttccttcttgccttcagtttcaacctgtactttaatctccctgtgagtcgctgcctgtgacagattatgaacaatgccacccttgttccccatgagggatgtcaggtcaggatcctgatcaacattcatcatactgaagggctgagattaagaggctgtccaagttcacataccagtgaacacagatgttctatttcaaaataatggagaggctatgattcaggagctggagcaactttttaaaaatatggtcccatttcaaacaaaacaagcatttgtaatatagataataaaaagttggaaacctcctaaatgtataggatcaggaaattggttaaattactctgtacctaaaagtgaatacaatgaatgtatgaaaatggtgatatcaatctgtttctactgtcaggaagacatgttcatgatatacttttaagaaaagagcattgcatggccagatgcggtagctcatccctgtaataccagcagcattttgggaggcggaggtgggtgaatcacttgagcccaggagttcgagaccaggctgggaaacatggcgaaaccctgtctttacaaaaaatataaaaattagccaggtgtgatggtgcacacctgtaatcccagctactcgaaaagctggggctgagaatcgattgagcctgagaagttgaggctgcagtgagtcgttggtggcaccactgcatatatacaatgatatatgtatatatccagatacatatatacatatattgttagaaaagatacaacaagggctaacgcaatagttggatttgagggatgctttgttttcttttctgtttttcttgttttgtgattttatttgtttcttttgcttgactggcttttctatatatgctaatagcctgtatttacgagtagccattaagcattaggcatatagccttctatttacttctgcaagtaagtcctctaaagatgagggaacccagaaaggttaggcaacttacccagtccagcatcataaaatcgagaatccatctgagtcagcttgcctccagacccaacttcatcatcttctgtgggacaggctaggttaacccaaaggtggtgcggtgggagacttcaggccaccctgaaggcctctggatgccctaggatgactctgagcacaaacagatacggggcttaggtatgcattgctaattccaaattctataggctactaatacatgctctttcctggtcaggtttggtccagagcctgggctgggccaaacctgcaggtgaaactttctagtgcctgctcaagttggacaaattggtccaggactctcagcctactctcctgcacacagccagccccagcactgcccagcaacacctgcctcttcatttgttgacatacacattgccaaagtgtgatcaatatgtcaatattatttttttattttgctttttttctccttaattatgaatactttaattctgagcactgatacaggtattaacatgcctcagccgggcacggtggctcacgcctgtaatcccagcactttgggaggccgaggcgggtggatcacttgaggtcgggagtttgagaccagcctgcccaacatggtgaaaccttatctctactaaaaacacaaaaatccatcacatggcggccgtcgagcatgctaatcagaggtttccaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagttgtatgcaagatcatcatgaagtacaattctcaaccttggctgagtgttggactcacctggggcttttaaaacctgttgatgcctgaggtccactctcagagattctgatttaattggtatggggtgtagacttggcattgggggattttttaagctctccaggtgattctaatgcattgcaaagtgataattatttcctagaacctgccctacctttcctcattcccttccctcacaatccaaggagacaaaattggtttggagaaaataatttttcttattgattagcccttccctaagcgaagcagtgtggattaaggtactcagggttctcagtggcccactgagaaagcagtcctcagaggagtcccgcccattctgactctccctttccctttttattcagtatggtattgtgctggatgccgggtcttcaagaaccacagtctacgtgtatcaatggccagcagaaaaagagaataataccggagtggtcagtcaaaccttcaaatgtagtgtgaaaggtaaggactgaagtgtgtctgggagtcacaatgggcagcaaggtagagttctaagtgttttggaggcctggagaggtcctgagatgttgcttggaggcagggaatgagcattggactgggagtcaggaaataggagatcgtgtgctagtgctgctactcatcagtggaataaacttgctctagtcacttcccttctctgggcctcagtgttttatctgtatacatggaaaggggtggcgtcaagaactgtgaatggtctgagattttaccctgccatattttcatgggtgctggaagacacaagactcctgggtcagaaataaaggacaatttgttactcacaggagtagcccagagtatcagcattttcttatactggttctgattcccaatttgcccaggatgatggaaagacggacagatagtatgcactcatgcaataggttctgtcataggaaaggaaatctgggattttagggaagcatttataatgggcagtgagcatgcctgccttttgctgtggagggaaacacaagggacacatggatagctgtcttccagcagtgataaggagtagtcctgtgtattgatggcgaggcagacagagaatgacaatatgtaaacaaatggacatggctctgttccagtaaagctttatttatggacactgaaattttgaatttcatataattctcatatcatgaaatgtaattcttcctgtaaattttttcccaccattaaaaaatgtaaaaactctcttagctcacaggctgtacaaaaaaaaggtggtatactggatttggcccatggggtgccaacccctgaaatggagtattatcagcaatgataattaatgatccgccatgcagctccctgtcttttccacaacatattctgagttttatattaactgtttccttgttctttatagttttgtcttatgtatgtagtgtttctgttttttaaaacaaaattaaacatgtatttatataaatggaatcaacatattttatgccgtatttgctttgttcactaacaacattgggtttttaagattcatctgcactgatatgagtaactatcttgttcatttcctttcctttttttttttcttttttttttttttttttttgagacagagtctcactctgttgcccaggctggagtgcagtggcataatcttggctcactgcaatctctgcctcctgggttcaagcgattctcctgcctccacctcccaagtagccgggattacaggtgcctgccaccacgcctggctaatttttgtatttttagtatagatggggtttcaccatgttggccaggctggcttcgaactcctgacctcaagtgatccacctgcctcggcctcccaaagtgctgggattacaggtgtgagccaccgtgctcggcctcatttttccttgttgatgggcatttgtattttcttggttattaataaaacttaatatctttccatatatttataggcatttctgttttctgtgaaatgcatgttcatgtcttttgttcatttttctattgaattgttgaatttttcttactaattcattgaaattctttataaatattctaaatatgaattctttgccattattattatcatattattgctaataccgtctcacagtttgtagtttgtctttttagtttctttgcgatgtgtcttgatgaaaagaagttcttgattcttatgtaaatacaaccatcaatattcctttttgtggcttgctcttttgtatgttttatttaagaaatccttttctatcttgaggtcatacagacctttttctatgaaaagtgttataattttgccttttacaattaagtaattagtccaagtaattgagcctagttagggagtgtgtatatgtgtaagcctttttcaaagccacttatcttcctcgttcgagcattaggatcttcagttggcctgtagcctcccaaccagggtgttctgaatgtgcccagtgtatccttgagcccacaggacaacaggttagagactccagacctgtcctcccagcccgagcagcctcctttgtttccctccgtgagctgccaaaacattgtaagttcatggggatcatggcattgaaaaacttggaaagcagagttagtctttctcaccgggagaccaagagtcttctttggctaatcagagtgaattctgatcatctgccctccgaggagggcagccaggagcttgcctaccctgatgcacaggtgttccaggttaggctctccagaagcagatgtagagacagattatggagtgcaaggtggttattagagatgcactattatagcagaaagtgggcagagagaagtactggacaaaaaaagagaagtcaaacttcaactcaggcctgatgaagcttcagctgatccgttatgctgcactgggttgaaatggtgtaaagtggcttggctgtaataccccctgttgctgccactctgggatgtttgccaccctggaaagagcaagatcttgagcaaggcagctctctgcagctcaggcagaccctgaagaagctgacagctgggacaataagtctatttgaaggggtatattgcacggcacggttttggattcaccacataagggacttggatattttcctttaatttttttttttttttttgagatagggtctcattctgtctcccaggctggagtgcagtggcacaatcatggctcgctgcagcctagacttcctgggttcaagcagtcttcctatctcagcctcctgagtagctgggactacagacattgccaccacatctggctaattttattttttgtagagatggggtctcactatgttgcccaggctggtcttgaacttctgggctcaagccatcctcctgcctcagcctcccaaagtgctgagattacaggtgtgagccactgcacccagcggatattttctgagtattgcttgcttgttatccacaagatgcaggcagctgtagccttgctctgacctcaaccagcgatcctctatctgctcaggtaatgcctgagccatttcctcaccttcaaccatgaaatagggcagcaggctgctcctttcaaagacagagactatgtgctccaaggaaagagaagatagtgtaggatcgagattgagacttcacctcatccctactgtgtgaaccctggaaagttatctaacctgagtcttgacttcctcatctctaaagtaaaaaacataataatagttatacctaccctacaggagtgatttgaagactaaatgacataatgttgtaaaagaaatgcctggcatacagtaagtgctcaataagcattaactgttattcatggggcaccacaatcagagctcctggtggatcctcttgccacttgttactctgtcccacagttacaagatctctgtctttagacccaggagggcaattcaaccaagttagtcctgatggccttacaactgtggggaaaaataagacttacatggggaggtgttatggcagtccctcaggggaagggttccttggcccaccctggatggcatatgtgatttgaggaggcacagagtcatggaggccacagcatatccataaatggatcttcccttctttgatcacagtagcctcagggatctatatatactctgaatgaacagaagaccacaaactaaagctcaaattacagagttgaaggtcagcaagtgtcatcccctcaaaggcttgtggcttctccaaggataatttgggtttctgcttcctccattgcaaacttcccaggactcccctgtcttggccaaacagaagggggtgatgaatgcttgctcacccagcagggattcccagatgcctaggccctcagaaatttctttctggttggtatcaacccccagttgctactgttttccatgagttcattgcctttgctggcggtttctgtgctggtgtctgtacctctggctgcttgtggtgaagccacctcctggaggtgctgggttctctgcatgcgtctcatctcatctgcagtactcatgcctgctgctgcctttccccacaagggacattcataatgtctttcctttaaaccagtgactaaaaattacttaagctccactagagcctaaacttaactatctcctccattaaaatccctcaaagagttgcatcagaaaccaggccaccatagtattaaaaaaacatcctttgcctctgggtgcagtggctcatgcctgtaatcccagcactttgggaggtgaggcgggtggatcacctgaggcaaagagtttgagaccagcctggccaacatgatgaaactccatctctactaagaatacaaaaattagccgggcttggtggtgggcgcctataatcccagcttctcgggaggctgaggcaggagaattgcttgaacccagaaggcagaagttgcagtgagtggaaatcatgccactgcactccagcctgggtgacagagcgagacttcatttcaaaaaaaaaaaatcatttgccaatagttggccggagctcaagctgaggtgcgtgtctttggcttctgtttcccctcaagtaagttttgtgccgtctgtttaaccctctctccccatattgaaatagcaatttcagtgctcctctcatgggaccaagtatccaagtccaagcagcttagaagcctgtgaatcctatctccttttccctctagaaggcttaatggaccttatgcaaacaggctgtctggtgacatactcccaaggtttcaccattctatctcgcctctcaccagccgctaaccagagaccagctccttgcagattatattttgtttatcccagattggactagccaatctccttactacagagatgtatagtggtttgaaagtctcattgattgattgatttaataaatatgtattaggtgcctgctgtttgatacgaactgttcttggcaccaggaattcagaaataaacaatatatacaaaatctgtggttatgtgttatgagacttgcattccaatgaggaagatagacaaaaaaataaacgggcatataacgagtgtcaggcagacatgatgtgaagagaaatcaggcagggcaggaaaaagagagtgatcatgctgttttgaacaggattgtcagggaagtatgaagaatatgacagctaggcagagacaaaagtgatatgagacaatgggccatgtaaatgtgtgggggaagaacatgctgagcagaggcatggcaagggaaaaggccaagcatggaagctgctcagcattttccaggaaaagccaaggggccagtgtggctggaagaaagatgagaaatgagactgaagctagagccaaggcctgctccttggagggacttgaggtgtcctaagggtttgactgtgacacaaatgaagtttcttcaaagtatattgggaagccattagaagattctaactagggaactaatacgatatgacttctgtttttaacggatcactcagttgatatagaacacgtagtcaggggctaagattggaagcaaggacaccagttaagtgctgttaaatcagtacgggtgagagattaggtgatggtcaatttgcccttgactagtgcttctcaacacaaggtgaatttgtctcccgggaaacattttgcaatgtctggagatcttttcgattgtcatgactgggtccgtggtgctactagcatctagtgtatagaagacatttctcatctttcttccagccacactggccccttggcttttcctagaaaatgctgagcagcttccacacttggccttttcccttgccattctacaatgttctaagcattgtacaatgcacagaacagcctccacaacaaagaattatctaccccaaaatgtcagtagcaccaaggttaagaaaccttggtttacgatggttctggggaagggggtgagaagtgcttagatttgcgaggtattttgaaggtaggaccaacatgattttatgatggacttgatgtgaggcatctgagttcataatgcatgagcaagagtttggatatgagcaactgtgtgcatcacaacaccatttactgagattggggaacactgggagtggagcatattgggggcagggcaaagcttaaagagtttggttttgggcatattaagttggagatggctataaatcatctgagtcaggggaggcaaactttttctgtaaagagctacacgataaatattttagacttgtgggtcatatggtctctgtcgtaactgctcaactctgcccctttagcatgaaaacagccatagacaacaggtagatgaattagcatgtttgcatttcaaaaaaaaaaaactttacttgtggacactgacattttaatttcttataattttcatatgtcatgaaatgctgttcttcattttatttttttccaactacttgaaaatataaaaattattcttcacttgcaatccatacaaaaacaggtatggggtcaaatagcttgctcattcctgatctatacagtgatgtggagttgtcagataggcaagtcgggagttcgggggagggggaggatgaagaaataaagctgagtgtcatcagaatacagacgatatccagccccagctcatctaaggagtgaatagatactgaagaaaagagatctgaggacttagccttacacactccagtactgagaggttggggagaggaagaggatccagcaaaagaacttaggaggaatgacagccagtgaggggagaagaaggtcagaacccaaatccaaggtagttgaagaaagaggaagtgcgcaattaggtgaaaagtgatggggagcttataatctaagaagttagacagacatgatatgcccccagtgcggtgatgtacactaggaaaaacctagcacacctaggaagtgctcttgccaaaaaatcaaatctgaatctgatcacatttctagaaattaactcccagtttataaaaaacacagaagacaaaggaacatgttcaaggacacctcacggatccaatcagcgaaatccaaaataagagacctactccattaaaatgatttctttaataaataaatggcaagataaaaggggggcaggaaaactgttacagaatgagaatcttaaaaaacatccaaatgcacatacaaggtatggactttggtttctgcatcacactataaagaaaaagttattctgggaaatttgaacactgacaggtctttaataatattaagaacttttttaggagtgatttttttcttaggtatcatggttatatttttcagagttcttccctcttaaaaacatatactaaagtgtttgtagatgaattaacataatgcctgggattttctttacaataattcctagagatggaaaaaagaaagcatataaatgaaaataagatgggctgtgtattgattaactgttgaagctgaatgatcagtatatggggattcatttcactagtttcacagtaaagaattaagactaatgtgagcactgacctgtgatgttcagcatagttttgttgtttttgttggctttattggcattttggagagaaaaacctgttaactaacctatctcataggaatatgcctgagagcttaatctcacattttatttactgagagaattgtgtgtctttttaaaaataactttctaattacaaaataatatattttcattgtgtgaaaatcagaaaacacaggtaaataaaatggaaccaggcacaatggtgtgcacctatattcccagctactcaggaggctaaggcagaaggatcacttgagcctaggagtttgagaccagcctgggcaacatagcaagaccccatctttatttaaaagtagaaaaggaagtaagatcatccataatccttcccaccagaggggaacatttttctttttttaggattaatatatttttatattaaaaattattcatacaggctgggtgcagtggctcactcctgtaatcccagcactttgggaggccaagtggatcagctgaagtcaggagtttgagaccagcctggccaacatggtgaaaccccatctctactaaaaatacaaaattagccgggtctgttggtgcatacctgtagtcccagctactcgggaggctgaggcaggagaatcacttgaacctgggaggcggaggctgtagtgagccgagatcatgccattgcactccagcctggacaacaagagcaaaaactccgtctaaaaaaaaaattatatatacatacgtatataaacatatatatttatttaattgttgttattgttattagtgtttcttacagctacttcagttctgaactcctgagatcaagccactgagttcatcaagcccacggcttatggtgctgtcatttgtctgttgtaggaggtcattgccccaggagggaaaattacattagaggctctgtccttggccaaggttgagaaagcctgtccttgcttctctagcactgtcgatgaaatccacgtctgtgcatcttaatggacacatccaagcaaaacttgtaattacaatgctcaggtttttttattggtttgtggtagttggaagatgggtgggaaaggttaagaaagggcagctgaaggaggcagtggctctatcaattccaaagaaggaagtttccagagggaccatattctctccatcttccttgtctgtcctatactttgtcttccttaaagtagacttatttaaactcagagcctggactgggagaacaaattaagttatgttcatgcaatggcatgcaatgcaactgtaaaaagaaatgaagaatatttatatactgctatggagtggccactaggaagtattgttgaatgcaaagaaaaaaaaagtggagaaaagtatatatagtaaattaccatttatctaaaagttggggtgattaaaaatatatatttgcttattttaaacaaacattggttaaactttttttaaaaaagaaactacttacaggaagaggagacaaggagagaatctagatgtctctgaatatacctagttttgtagatctaattttagaactacttaattattttagtaactataaaacaaaatcgttttttaaaaagtaattcctaaaactcaaaagtaaaatgcaacaggccagtcatggtgtctcacacctgtaatcccagcactttgggaggctgaagcgggtggatcacttgaggccaggagttcgagaccagcctggccaacatggcaaaactctgtctctacaaaaaatacaaaaattagccaggcacggtggcacgtgcctgtaatcccagctacttcggaggctgaggcacaagaatcgcttgaatctggcagacagaggttgtagtgagccgagatcacaccaactgcactgcagtctgggtgacacagtgagactccatctcagaaaaaaaaaaaaaaagagaaaaagatatcactatttgcaacccctaatgaaataatggagctaaaccattatcattgatgataacagcacaaaaagagaaacaaccagatactgtgcctcctattgtaagtccacactaatccctatatattttttttaaatttcaaacctgatctgatcaagcctctacattcagttaaccatttatagaaatacaagggaccaagtaagatgttaattgaactatgagggtacaatcgacaaactctagactgtggaaattcttcaggacgaagaaattgcaagtaaaatttttaataattaggagaaaaatagaaagggaaggcagaactaatagacagaaagagacttaagattgcactgtaccgaatttattgggatcctgactcatacaaatgagaagagggtgatggatgaaggaagaaggagggatgaagaggaggagtaggaagagaaagagacacagaggatgagaatgagaacgaatatggaggcaatgggaaccatgactggatagttaatgatattaagaaattatttttttggcaaggcatggtggctcatgcctgtaatcccagcactgtgggaggtcgaggcaggtggatcacctgaggtcaggagttcgagaccagcctggacaacatggtgaaaccgtgtctctataaaaaaaccaaaaattagccaggcgtggtggtgcacgcctgtaattccagctactcatgaaactgaggcaggagaatcacttgaacctgggaggtggaggttgtagtgagccgagatcgtgccactgtactccaggctgggcgacagaacaagactctgtctcagaaaaaaaaaaaaagaaaaaaagaaaagaaaaagaaattatttttaatttgtacaggtataataattcaactgtagttagggctttttcaaagaatgtttactttttgtgacacatactgaaatatgggaattaaatgacacatctgcattttgctttgtgggaagcaagtggaagattgtatggatgaaataagagtcgatcattgttgaagctgggagatagatgcatgagtttcaatatactattctctctacttttatttatatttgaaatttttataatgaaaacatttttttaaagtaggccctggcttactttttatacaattgtaattcattcttttagaggttgcaagtatactgatcagtgtgaccatacgggacttaccacatccagctgttttcgaccccctaccaaaccccaataattttcaaagccaatttgttttttatttaaaagttgtatcactgcgattggttcctggaaatgctgacagatgctgactgcttgcttttcaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggtaaaggctaagtggcacaaaggagcccatttgaccaaaataaccaagaatatgttgaatcttgccaagaatgtaactctatttctgggaacaaccctcgccccccaaaaagaagcccacattctgccataaatttgggctttaaaggttgggaaacttttagtttttattttaatacccagaaagaaacagttctaaaattgtttccctctcccttggtgattttactgagaactttgaaaaagagagaggtcatatgaaatctgctcatgggatataactctagttctttgaaaagtagttgttttgacagttggcatttgacacctgtgaacaaccagctaagtttggtagtaagtacaacccatagctatgtagcttccgcttgtgtacaaaataccactgaaatctgctttaaaacaatggcatgtctgcacctcaaatcagtcaaagcttttggagttgttatgaaacaagcatctaatttcactcactcaaattagttccttctaaatttgtagtcatggcttttagcccagttgcattgtttttgaatgtcttttctcttttttctccattatagcatttccttgaccttgaaatttcaaaaaaaaattccaaaaagaaacaccaaacttaaatctactcagagtaaaggctactactccaagtgttggaataaggttttatcacaagaaaacaacactcattctgcttcagagccactttatctacgattccaagcacgcaaaattatctatgtctgagcattaataaaaaaagaacaaacagagctcctttaacatgataatgaaaagaaatcatgatgtgctctccattagactgggccttttccttatagtctcataattcttgtttctaatctgatttcctggttgaccacattgaatgtggaaggaagtcagatttctctgctcactcttggaatctgcagtgtatttccaaattatttcatttacgtgtaatagaaatgatctaaaaactccttccttttgctttttctttcttataaaaacagttcttccaaaaaggatggaactgaaaccatgtaatctcagagaacacagaaaggcagcccctttacaggctattaattccatggacctaaaatcctcatctgctatagtggatgcttccttaacacgacatgtgtggagctacttatagaaaagccagctgcaggatgtgctcatgaagttttcaatttggagactgaatgcttagagcttagtttgtgaaatccttctgctttcagtctattcaattcccattttcagactgaatttcctatttcagaatacattaggatgctgtttactctccctgggacttgacttcaggtaataagtttcagaacaggacctgagcaataccaacaatatgaatgtgataagtgactacaatcagggagaaatactggttcaattccattaaatgtctgtaaaagttactctaaaatatctttgctttaccagtagtgtttgtacatatgtaaacttcttggttgaactggctctgaacttatgacttaagtagacttctagtactctaaaaacaaaaacaaaacaaacaaacaaacaaaacagctcttaagaaactgactttttcttggttgcttcccctccctcccccagtctttcagtgagaaataattaaaaggctctgcaatttacagctcatgacaaaaaccatggaacagaaagctcacctcttaggaaaaaatgaatgtctcctttgaataaattaagtactaactctttcttgtaaaactgttttctaatgatgatctatttcttctgagaaactagctgatattttaattactagacaagtaaaatagaaaagaaaacaattaatgagaattagctgggatgagaattgatgaaactgggaaaactctgaattattttccaagcagtgataattggccacggaattggaatggatcctgcttatagccttgctctttcttcttcctgagccaagagtcagccagtgcccctggctttctacccatggatgaaagatgaaataatctcccaagtgagctttctttcatagggtaaaatggcagcagatggacgccataacattctgtcaccagggatagaatgctgtgttgccactcctctaagagtcagcacaccaatggtttttcaatccagtgacagccatgatgactgtcatatcccttcatgctgaagccctcccaaagagtgaagcaaaaacagctaaaaactcaatgttcttcctttcccccttcctactaagctccctttccgtctggtcagatgagggttccttcatatggtgcctccaagagattatttatgccactcttatgacttcatcaatcccctttcctctgctgatctaagacagagcaatggcagttaaataggaggctcttttgatacatgaacagatgagatgggtggggagaacaaattgtacttatgctgaaagcaattttcctgcttggcagtttgacaggtaacaagtgcatcctgccttcacagttgccccagaaggcttcaacttgcaaaagggattgtggtgtacagcacacatctggaaaatcattcatccccaccagcagggagacggtgaagtttgcattttcacctgagtgagactatgtattttaagactgtattgtctgggcactcagacttgtttgttctgtgccttgtacaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggaggtgtgtgcaaacaaatgcatggtttttaatcttactgtttatcctatcccctgtgagtgatagcctaagtagaggtacatgccatcagggatatctgccctgtatcactcctaccatgtaacgcattagggaaatacctatgagacaatagctaagaaagacatatatagctggggagaaaacatggtcataaacaggactaaatgctagggagggagggaatcttgtcactttactagcttgtaagaaattgaagggggtgggatctaaatttaacactaggctatgggtctttgggagggcagttgaagaataacccttcagagaggctccatgaccatctgaaatgtacaaagccctcaggaagtctgtatccctaagtccccagagacaggaggaggtcttcactctgtgttcccaggtctcctcacagtccaatccctgcactccctgctcccttggtgcagaggaaagttgactccaagagacaactgccatgttacagggggcacaaaacaggagttactcagagcatatccagcccaagacctattttgttcaccttcaaatgtattttaaatttttaaataattaccaacaattaacatttgggaaatttcacataaaaatccatacttctagcttcttctgacctcctcactcctcccaaaaatcggaggaactggtcacagtagactcacattcctgcacggtaacaggaacagagtgtaaatcatggactctccagtttgccacagacccaccagtccctattatacacctaatctacttcactcatttattacttacctatgttacctgcccagttcctgtaagcattttaattcaccacctctaaaagaaaaggaaagaattggcctcacatgctccctctgtcctacttcttagtaataggagacgaggcttgggtggagaactctgggcaaacagagatggtgcctttggctttctttctcacttccttttcccactgtgcagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcaggtacttgagtcgggggtagggggtggcaggtgttctcttgagggtttgagctgaggggagaatgccctgccttctggggtctgtcctctccacttcaattgaaaggtagatggaaataacagcattttccaatttactcctgggggtccaagtccctttcctctctgtctctttcttcccctccgtctccctctcatgttgcccacttccagtaaatttgagtaagaagtctagggaagttccagagcttcagttgttttgtaaatgactcaagacctggaatccctttatggacacaaactgttttaaaccaggagctaaataagcctgagaattttgagactcccctgggtgtagacaaaataatattagtggtcacaagagaaatgtgtgctgaagggggagagggcagagcccttcccaggctcagcctccttttagatgggtctatattaggcagacttgatacccttatatggcagaactttagagcaaccacattccatcatgttgatcagtaattcatttgataagtgttccagggcccagaaggctaattcaggcatcagctagaaagctattgctaatattaaactcaacattatgcagtgtgtgttcatgagggcactaactccacaggtgagaccccagacccaaacaccagtgctcaggggacatcaatcttagccatggctgggtggctgagaggatgggccttgactgcctagaggggtatgaggaaatcagaagccacagatcctggcttcttatgggactcaaaggcaggggaatcagcctatgaacaaaatggacacaacttcagtaggttaacccacgttcgtccaacctactctgataactgaagacaggaacagactctatcctgcagaggagttgaagggatcacaaaagtgcatcttcagcaggactcacaacttcagacccctgcatttacccagtgttcatgcagggtaggttgtgggaactcagcttccagttctggcccctcccccaaacatctccccaatcctcccagaaatggctgaggccccaggacacatgcatgggacatttattgtcaggagagtctgagcactgcctggaaaggacagatgtgagaaccctgcagacagccctcaactacccttctgtagtaatccatgctcacactactataaagaaatacctgaaactgggtaatttataaagaaaagaggtttgtttaattggttcatggttctgtgagctgtacaggtttctgcttctagggaggcttcaggaaacttaaaatcatagtagaaggcgaagcggaagcaagcccttcttacatgggggaataggaggaagagagagagtgaagcggaaggtgccatacaattttaaacaaccagatctcctgacaactcactcactatcatgagaacagcaagggggaaatccacccccatgccccaatcacctcccaccaggcccctcctccaacactgggattacaattttacatgagacaaagccaaaccatgtcaccttccatggctcccatcccaacttccacctccctgcccagtcagccaaaccaaaccctacaggtaactcaatcaaccctccctatcaggggatctcaatactcaccactcatccccacttgctcatcaaagtagttcaaccaacatgcttctttctttctgggagagaagctctggaaaatcctcttttctccagctccttttacctctagcaatgcctaatgtcctttgctccagctctgaccctagcaggggtagaatgtggaggctcaggtgaaatcctcctttttccagggtgagtgaggatcagagaggctaatcttttaaatttggctggccctatggaatgtgtgtgtttctgtctgtctgcgtgcctctgtgtgtttttgtactcatacaatgtttactaaagaatgattatctatgtatccagcagtccacagagaagaagtaaatacttcacctttctgaggtctgatttaggcttgagaatgccagtctccaaatgtgagcccagcactggccatggagaagtgagcacccagcctctcacagtcagctcacagggacagggacacatgtcttcaatttgcatggtaacctctagatgcctgatagggtggctctgccctcagaggcttctgactcatgcaagaggagagacccagatgagatgaggattactgacaaattcatgtcaagactcacctgaccaacagtttcataggtcaaatatgtattgccaagccctgacttggaaggttcacacaaattattgcattgtaaacactgactgagtaaattccatcagtctggatcttgtttcctcatctgtaatataaggaactacgtagtgtggtgagaatgatagctggatatgtactttgcaagttactttcttatcaataagtctccagtcaccttagagctgaagtctcactctgacaacatgttagatattaggaatgtgcattcactttctatctttccctttttaagtaagaaatttttcttctgtttttaatgtaatatatgttcagtgaaaaacatttaggagatgcacaccaaaaactataaaggatttatttaaaaacagaattaaccactattaacatactattgcattttcttccattttttaaatgtatgaatgtgtaaaaacttggcttcatatggtatatataattttatatttaccttttattttacctaaccatatattatgatcattttcctgtgttgttaatgtccttttaaaatacgattttttatgagagcataatattccaagtgccataacttaaaaagaaaaaaaattgaccattcgattatgaaagaaagtacattcttattgtaaaaatttaaaaccatagaaagagtgttaaagtcaaaatgaaagatcctccttccaatcccatttactgaatgccatcactggtcaaagcttaatatgttgttcttctacactttccaggtcagtatattaacttattttctttactatttactatcccataatttatcaatcataccctccctcatggacatcaggctatgtcctgttttgttgctacaacaataatataataagccttcttactcatataatcttagcgattttatttctgtaggacaggttcaaaggacaggtgtatttttttatttaaatgaacaaataggtaatcttccaacaaaattagaaccattcagattaccacccatgttgtgatgactttttgaaataagcttcaggaattccaaaacattctaataataagtacttagataatgaggatctgtttctggattttctgttctatacattcatttttctattttggggccaatatcatgttgttctacttgcaaaagtctatttttctactctcagaggtttattttgaacttcaaagtcatttgaagcagtaacaaaaaaggaagttttttgttgagattgtgattgcaatcacattgattcatatattaatttggttaaaatgtgcttattagtgacatcaacaatttctatccagaattatacaatgtatttccatttatttaattcttggcttgtatccttcaataaaatgtatagttttcatcattggttctgtacctctgttgttaaatgtattttctttgtgtatattttttaagctttctatcactatcaagaatagtttctatcattgttttttccagttttaaccagttttactctaagatcagattatgctgtagttttctagtggacttttctccctcgagcccattgactgactttttcatgacagtgccctgcaaacactaagctcggtgaagactgttgaatgttgaatgcctgaacttggcacattggcaaattatacttaaagaatgccataacaaaaattcaaacacacaaaaaaagaaaagaactaatacttactaagcttttcctatgtactaagtcagaaataatttatgttatcttgtttcttctctgggccaagccagaaataatttatagttttaatcattttaaaagtataaatctcccttcagactatactagaaaagaaaaaaagtacaaatcagatttggaagtagatactaaatagccaattgattagtttgatttttttttcttttttctttttttctttttttttttggagatggagtcttgctctgtcacccaggctggagtgcagtggtgtgatcttggctcactgcaagctctgcctctcgggttcacgccattctcctacctcagcctcccgagtagctgggactacaggtgcccgccaccatgcccagctaattttttctatttttttttagtagagatggggtttcactgtgttagccaggatggcctcgatctcctgacctcgtgatccgcccgccttggcctcccaaagtgctggaattacacgtgtgagccaccacgccccgcatattttttctttcaaccaatatttcagccatagggtgacccaagtatgatatgctatagattatatgtaacaatttttgaaaatcatagatttttttcataccatagaggcagaaaggggcctgtttgcctccttctcagtcatatgaagatttttctggaaaacactcatttgggttatatttgatgaatattaagcttttataggatttttgcagaatcttgtcactgacctttgttaaataattgcattacttgaatatgtacctcagtttcctcatcagtaaaatgaaagggttgggctaaatgtctgagtcaagattttactgtagggtggccaggtgcagtggctcacacctgtaatcctagcactttgggaggctaaggcaggagaatctcttgtgcccaggagtttgagaccaacctgggtaacacagggagaccccacctctacaaaacaaaaaataataataattaattattttaaattttttttttttttttgagacggagtcttgctttgtcacccaggctggagtgtaatggtgcaatctcggtttgctgcaacctccgcctcccgggttcaagtggttctcctgcctcagcctcctgagtagctgggactacaggtgcgtgccaccacgcctggctaatttttgtatttttaggaaagacggggtttcaccatgttgcccaggctggtctcaaactcctgacctcaaatgatctgcctgcctcagcctcctaaagtgctgggattacagatgtgagccatcacacccagccaaaagaaaagattttactgtaggggaagcagtatgccttagtggcttaagttgaacatagttcaaatccaattccttagaaaagagagttcataaattgaatcaacaacattcaggactttagcataaaatagagtattttgcaccagtagattaaagattgaatagtcatatggaaaaagtaaagccaagtctctgagtctttaaatcaaataaatttcaatggataaaagatttatatgtgacaaggatatttgtttgtaatggcaaaatgattgggaaccacctcaatgttcatctagatgatattccttaaataaagtatggtttatttgtacagtggaatactatgcagctactaaaaaaataggccactgtataagtacaatgaatggaaagatctcaaagatatataattttaagtgagaaaagcaacgggtagaatggggtatataaagtgctaccatttatggctttaaaaaaagaaaagcatgggagaaaatatatatatttgcatgtgcatgccagatctttggaaggatacacaaaaactggcaatagtgattgtttccagaaaaaggcctgatggctgcaagtggatgagaaggagacttcactttcatatgtttatttgtaccttttggattattttgctagatggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgatagaatttgcaaaagggaaatacttggctctccacaaaaaaagtggtttctaataccttactctttttttttttttttacttagagattttattattattattattattatactttaagttttagggtacatgtgcacaatgtgcaggttagttacatatgtatacatgtaccatgctggtgtgctgcacccattaactcgtcatttagcattaggtatatctcctaatgctatccttcccccctccccccaccccacaacagtccccagagtgtgatgttccccttcctgtgtccatgtgttctcattgttcaattcccatctatgagtgagaacatgtggtgtttggttttttgtccttgcgatagtttactgagaatgatgattttcaatttcatccatgtccctacaaaggacatgaactcatcatgttttatggcttcatagtattccatggtgtatatgtgccatattttcttaatccagtctatcactattggacatttgggttgattccaagtctttgctattgtgaatagtgccgcaataaacatacgtgtctaacaccttactcttatacctacagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggtaagagcaaaaccttctgaaagattcctttccccattgaatattcatttctcacttttctgtttctcctctgctgacttgttagccaccttcttattcctcacccataaacctttctattataccccattctgagaactaattttcttctgtattacttatttccaggcttttgcaggattctactacacagccagtgctttaaatctttcaggtagcttttccctggacaccttcaactccagcacctggaatttctgctcacagaattggagtcaggtcagtatttaaagagaagggatcaatgtcagtacaaaaaaatatggtagaatctattctatgtgtgtgtattctgaatttagcctttatgctcttctatttccatcacatctgtaaaataaaaggaataagggaatctactcccacacctgtggtgtgaattaatgttataactacatgcacaatggttagaacaatatttggcatataataagcactcaatgagtttaaagattagtatattgtgatattatatagggatattttcataattatattgtgtgattatatgattgtattataaagtattttctattatgaaattatgggtgataagattctttaaaacatgacttttaacccaaggtgttcattttaaaacatacctgcctgccctgcctctcagatgttttaaacctttcagctcccactgctgctccccaaatttgatgaggtatatgcccgctcttactgcttctcagccaactacatctaccacttgtttgtgaacggttacaaattcacagaggagacttggccccaaatacactttgaaaaagaagtaagttaagcacaaatcattttctcttcttcttcccaacagagaggtttgtatgtgtgtgtggaacaaatgtagaaggtaaaagggtattaatgagttaaactcactgggtggaagctgatcagactgatcccttgtgagtttcccagaagaggtcatggagaatttagaagagttgctcatgggtatacattctcctggaaaagactggaagccaagggccaatggactaggcggtcctggagggcagagacctgtcttggtatcttcatattcccagcactctgcacaaggaatagagcctagaaggtacttagtaaatgttggttgaattcataaataaatatgttaaggatatgagacttttcatcctgaaaagaagctttaaatgtaacagttttttaaagaggatagtaactaattcttctccattttattcagatatcagagtaagatacaggccttagggcctgatggatttgcattagcattaaataaatattttctctttgaatgaacctgaagtcattatatttactgacaaagatttgggggatggggaagatattcttagctcagggtttaatatatttaaaaatatgtatatttatagatatctataaatacatacatatatatatatgatggtcaagtgaccagaatggtccaaagctggaatcacagctgtcacctggtgacaggtgaaaggacctccataccttgtttttaggcagggctaagccttgtgaatatgttcagccagcactatgttccccaggttccagagaattttctcatttcaggaatagctgatatgaagcctgaaggatgtctggagtcagcctgttcaataccagcttcagcaataattagattaaaccaatcaatatcctgcattaggcctctgactatctacttttacataaataaaattgagtcatctacaaaaaaataaggatgtctggagacataaggactgttggtagcatgtactctctaagctttgcttctaataaatctaattaccagtaaagtatattataagaatggagaatgactttccatttgaatgccagtttgagttgacataatattctaagttaaaagttccctttttttaattataaagaattttgtgtccagccaaattagtatttaaatgtgaagatgtaggctgggcacggtggctcacacctgtaatcccagcgctttgggaggccgaggcaggcggatcacctgaggtcaggagtttgagaccagcctgaccaacatggagaaaccctgtctctactaaaaatacgaaattagctgggcatgttggtgcatgcctgtaatcccagctactcagaggctgaggcaggagaatcacttgcacctgggaggtgaaggttgccgtgagccgagatcacgccattgcactccagcctgggcaacaacagcaaaactccatctcaaaaaataaaaataaaaataaataaataaaaatgtgaaggtgtaaaaagacttgagaagatttgctgcacagaagacttacaatgaaaatatttttggtggaagtaataaaataagaagagaaataaatccaggagatgttacaaaaacactggaagtaagaataaatgatgttgtggcttaaaatttacattaaaaaagccgggtgctgtggctcatgcctgtaattccagcactttgggaggccgaggcaggtgaatcatttgaggtcaggagttcgagaccagcctggccaacatggcaaaaccatgtctctactaaacatacaaaaaattagctgggtatggtggcatgtgcctgtactcccagccactcaggaggctgaggcaggagaattgcttgaaactgggaggtggaggttgcagtgagccgagatctcaccatttcactttagcctgggcgaaagagcaagactctgtctcaaaaaaaaaaaaaaaattatattaaaaaaaacagaaaacgaacactaaagaaaagtatttaaaaaaaactccattcatatgactcaagtatagaaaatatccacatgataagggtgtggtaaggagttataagatacagggacataagagtaacctaaaattctcttcttgtcaaaggaaacacagagatatctttttctttttcttttcttttttttttttttttttttgagacggagtctcgctctgtcgcctaggctggagtgcaatggtgtgatcttggctcactgcagcctccgcctcctgggctcaaacaattctcctgcctcagcctcctgagtagctgggattacaggcacccaccatcatgcctggctaatttttgtatttttgtagagacagggtttcaccatgttggccaggctggtcttgaactcctgacctcaggtgatcccgcctcggcctcccaaagtgctgggattataggcgtgagccaccatgactggccacagatatcatttttaaggcaggaaagaagaaaaaatatatatagaaaaatagcactaattgaaaatttaaaagtaagatattagaaagaagtgtaaatatattaataatcacaataattataaatggactaaacctaccagttaaaagagagatgtcaaattgaatttttagaaatcaagcaggtgccatttataagagaaacatggttcaagcataaagacatggaaagatagaaagataattttgttaaattatcaaacactacccaaaagaaagctggtataactatttagtatctggcaaagcagtctttaagaccaagagcctcattctagacacagagggttacaacataatgataaaatgttcaattcactatgaagattgcaaaggtgaaacatttatacacctaataaaacaccctaaaaacatgtaaagcaaaaatagatagaactaccagaataaattgacagtcagcttcccatttgggctgattttctattcttaggaactggtcctgggatcagtaaaccactcattagcctctttctctagccacaaacactcctgtgctcctggacaacaggaacactttcactgttattaactgtgccgtcttcactcttggctgtgacaagattgtgagaatttgttcttttgactatttcttctgcagcgctggaggtgagatttccccaagcctttgtggctacagtgtggtgtcttaacttgggcaagtcctttgacctctttgggccacaatttcccatgggagctttgtgaggttgatagcagtatgactccggtatgtgattgcagccttgagccttgccctgagcgctgagccatctcctctactccacaggtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttgacttgcaaggggtgtgtgtgtgttaacttccatatggtactctttctcctaaggaccctaggtgatatttatgagagaaatttttttccctagcaaattaagaaacccattcattaatatcacctttattccagagagttcaaagtgcttttactttgataaacctttgactgcttgagattattgagtcaagcatttctgtaccttatttgaaattctaagcctctgtgagtccacaacctgacactcaaatcttggttctcatccagaacggctactcctatcccaaactgtacctttgctcccgccatcctctctactatattatagatcctcctcccacccatccaaatcatgtatgtttctcaaggtccagttccttcatataagtcttccacaaagctttccttgcacacacatactatgctctatctcctggaccactttttcaaaaccagccacgtaagtcctcatattgttatttatcttggcatatgtgtacagcttatttctaaaagacagagtaggctacttaagggcaaagcctattgtacatcactcctcatttattcaacagacatctaaaaacacctattatggctgataccttttacgtgtgattttggatttggacatatgctatgaacatagtatttattcatatttgttgattgaggttgtttccatgagtgactaagaaatgggcaataaactatagagatagcagggaaaaaacagcatccaaatcaccaagagtttgcaagaaaaaaaatttgtatgtgcaagaaagagagccaaagctccatgaaggcaaatcctagtcaacatttctaactcatttgggaagttagaataaactgaggtacttcaggttttctgacacacaccgaagaatttttgactgggtgcagtagctcacacctgtaatctcagccttttgggagtagctgaggcaggagggattccttgagcccagaagttcgagagcagcctgggaaacgtggcaaaacctcttctctccaaaaaatacaaaaattagccagaagttgtgggcacacctggagtcccagctacttgggaggttgaggtaagaggattgcttgagcctgggaggtggaggttgcagtgagccgagatcatgccgctgcactccagcctgggtaacagagcaaaactatctctctctctctctctctctctctctctcacacacacacacacacacacacacacacaagaatttttatagatagaccattgtgaaatctgcagttcaagtggcatatctagcactgttactgtggtgaacagaatactccttccccctctggtgttactccaattatgtggttacattgtcacatggcaaaaggattttgcagatgtaattacaaatcagttgaccttaaaatggagagcttatccaggtaggtctaacctcaccacatgagctctttaaaggcagagcattttctccagaagacgaagtcagagattcaaagcatgagaagaattccacatgcagttgccggcttggggatggagggcgccgtgtgcaaaggccctaagtgcagcctctagaaactaacagcaatccctggctgcatcagcaaaaaaccaggaacctcagccctacagctgcaaggagctggattctgccaacaacctgaatgaacttggaagcatattttcccccagagctttcagataagagtccaggtcagatcatatcttgatttcagcctactgagaccctaagtggagaacccagttgagcccactctgacttctgacctacaaaactataaagtaacaaaaagatgacgtttaaagccactaaatttgtggcaatttgttacacagtcacagtaaactaatacaactatagaaccccaaaccccaaagctccaaccaaagcaagtcttttgatttgaaatatgtgaagataaaagtgatgagtagcacaaatagtgtctattcctaatcacagctatgtaaaa

SEQ ID NO: 11921 - DNA, 53442 bp, Human
gagattacaggcgtgggccaccgccccggctgtaaaccttttttttgagacaagagttttgctcttgttgcctaggctggagtgcaatggcgcaatctcggctcaccacaacctctgcctcccgggttcaagcaattctcctgcctcagcctccccagtaacagactataggtgcgtgccaccatgccaggctaatttttgtatttttggtagagacagagtttcaccatgctagccaggctggtcttgaactcctggcctcaggtgatccacccgccttggtctcccaaagtgttgagatttacaggcatgagccaccgcccccggctgtaaaattttttttttttttttttgagacagagttttgctcttgttgcccaggctggagtgcaatggcacgatctcggctcaccgcaacctccacctcccagttcaagcgattctcctgcctcagcctcccgagtagctgggattacaggcacacaccaccatccctggctaattttgtatttttagtagagacagggtttctccatgttggtcaggctggcgtaaaccttattatacataccatctgccagcatgatcatggctttttcttttctttttttttgagatggagtttcgctcttgtttcccaggctggagtgcaatagcacgatctcggcccaccgcagcctccacctcccaggttcaagcaattctcctgcctcagcctcccgagtagctgggaatccaggcatgcgccaccatgcccggctacttttgtaattttagtagacacggggtttctccattttggtcaggctagtctcgaacttccaacctcaggtgatccgcccgcctcggcctaccaaagtactgggattacaggcgtgagccaccacgcctggccgatcatagctttttctgagtgtatttctggtatactttcacactcccgtgagtccataggcggaatcgccatatattgaagagtttatctctgatgtaaaatctataaagttaccattaattttgtatgtgtaaggttctgaaaaagcacactgttgataagctgcagaaaagagagtagggcatcttctgtcacaggctgtatatttggaatttattctagaaattggtaactttataatatgaaagtcagtccaagactcctcatttgaacataggcttacagattaatgtatgaacataaaaatttgactataacaagattattaatgtatgcgtagtaccttagttatagtactttatagtttcttttattggtttttgggttttttgatggtttttttgagatagggtcttactcttaaccatgctggagtacagtggcaggatcatggctcattacagcttcgacctcctggacttaagtgatcctcccacctcagcctctggcatagctgggactgtaggcatgcaccaccatgcctggctaattttgtattttttgtagagacagggttttgccatgttgcctaggctggtcttgaactcctgagctcaggtgatcctcctgccttggcctcccaaagtgctgggattacaggcatgagtcgccacacttggcctagtttattttattgtattatatatattttttattgactaagtttgattttgtagataaagctgttgtgacatgaatatggctcagggaaatgccaagatttcatactctggtagaggtggatatagagtctacattcttctgaatcccctcattttctaccaaagaactggatgttgttactgtcatctgctggtgagcaacaactgatagtacagatagtagagtaggaagttgctatttagtagtttatctggtagcatttccttccacagttactggtaggtgcctttactatgaagttccaggaattattactaaataaattttccttgtttcattgtttagaacactaatgcttttaaacttggaataagccacttcatgttttgttgacttggttttgtaattctttttctgtccagttttccttgttcctggtcaacaaagaaatgtggagtgtcttggctgaatcctcatacagacaagatcattatggtgctgttaggtaggacttgtatccagatgtaaggtaatatctccactagcttaaatttataaatgtatttcaaatgttcctgaatggtggttttctttttttcctgaatttaattctctgttttttgccaagtgatgttaattttgtccaacaagccatatataaaatttagaactattatgtatcaaaatagatagaatttctggctggtcatggtggttcatgcctgtaatcctaacactttgggaggccaaggcagacggattgcttaagcccaggagttcaagaccagtctggacaacatggcaaaaccctgtctttacaaaaaatacaaaaattagctgggtgtggtggccatgtacctgtagttccagctactcaggaggctgagttcagaggatcacctgagcccagggagatcatggctgcagtgagccgtgccactgtattccagcctgagcaatggtgtgactgtttctcaaaaaaaaaagggggggcggggggtgggtagtacttctgcttttttcttctagtaggtccaaaactgggtttactttataaattcatctataactttattcgggtttaccttagaggccatgtttcccttcataaatcattcttgagatcaccttatagcagatggtactttataggtggatcagtctaagtgaacaactttagattttgtttctacatagcctttagaatcctgaataaatatattattatccaaactgtttcttatgggagttactttctttttttttttttttgagaggtagtcttgctctgtcgcccaggctggagtgcagtggcacaatcttgtctcacttcaactctgcctcccaggttcaagcaattctcctgcctcagcctcccgagtagctgggattacagatgcctgccaccatgcccggctaatttttgtattttagtagagacagggtttcacccccatgttggccaggccggtcttgaactcctcacttcaagtgatctgcctgcctcggcttcccaaagtgctgagattacaggcttgagccaccacacctggccaggagttactttcatcctgcttttttattgcatgtgctgcaaatatagaattctactaaattgacattttctcgtgatattaagactagttcacatctctgcaggggcattttaagaaatcctggcggtcaaggatttaatcttatcacttttagataaatttttaaaaatttaaaacattcaatgttttacttatatacaagatatgttaccacagataattatttgtttatttatttgttaatgaatgacagggtctcactatgtcacccaggctggagtgcagtggtgcaatcatgactcactgcagccttaaccttctggggtcaagcaattctcccatgtcagtctcctgagtagctaggagcacaggcttgtgccaccatgcccagctaacttttttttgtggggggggggagtaaagactggatctcactctgttgctactgggctcaaatggttctcctacctcaggcccccaaagtgctggaattatagttgtgagccactatgcttggccatatatttttgaaatggggttttgttatgttgtccaggctgaacttaagctcctgagctcaagagatcctcctacttcagcttcccaagtagttgggactacaggcgtgcaccactatgcctacaaataatcattaactactgttcctttatttgcaaaatatcccatttttattagttgtccatcccaacagagccacagactaaaagttctctaagaaaacttacctggactgggcacagtgactcacatctataatcctagcattttgggaggccgaggtaggaggattgcttgagcctaggattttgagaccggcctggacaacataacaagaccctgtctctattttttaaaaaaagcaatgaaaaattacctaagttttaggcccacttgtctgcatttttatgtcatggatctgtcaaatgttcattcatttaagaaacatttaatgaataccaactgtataacagcctgtctgataacttcatgggtacagtaaggaacaagagaaggcccttgccctcaaattgtttacagtcagatgtataaagctctgacctggatgttgatctctgagaatatacaaccttattgtcacccatacacaaacacttaacagtaaacagtaccaagcagggattgataaaggagagatggtgtagaccaggggtgttcaatcttttggcttccttgggctacattggaagaagaagaattgtcttgggtcacacataaaatatactaacactaatgatggctgatgagcttaaaaaaaaatcacaaaaaaagatctcataatattttaagaaagtttacaaatttgtgttgggctgcattcaaaaccatcctgggctacatgcggcccatgggctgtgggttttgactaagcttggcccaaaccctaggtgctatagaatttggaggcatttaagactgtcgtagtcagggaaagtttatagaaggagatggactgaaaggagagggaagttcctctgggaagttagaacaatgtgagcacaattcagagtatgcttaaaatagggagtagtttaactctagcattggttcctaaagtgtggtccacagaccggtaacatcagcttcacctggtaacttattagaactacagtttcacaggccccacctgagacctactgattcagaaatactggcaatgaggcccagcagtctatgccctccaggtggttctgatgcgtgctaaagtttcagaaccactagactagagcagagggttattgtatggaacaagtaggcaaaacactctaaaaaggtaggctgggaactcattgtgaatgacttagaatgtcagacagggagtttgtcttttatcctgcagactagaggccccagcttgtgacttgagggctggacttggctcatagaatgtgtttcgtttggcctgaatggtaggtttttgggggtttttaaatggaattagttgtcatcatttaaaaatcagcagattttacaaagaaatctgtgctttcagcttaccttgaaaaatcagaagacctggcagtatggagcctacattccattatggtagcagttggtgggaatagcaagaagctgcccctttagatgggacacatgctctccagtttactgcaatccccaccggttccttttgtcttacacacacctttactcatttatatttcctgcctggtgcctgtaggtgtttgagtttgtaacttctgttgtggacagtgggacattaatgaaaattttgagaagcagagtgatgagatttatgtatttgttaatttatttaacaaacattaattaaacatatatgccagattgtactctgttaagtaatcagtgttcaaagatgaatgagtcccagctgggaccggtggctcatgcctataatcccagcactttaggaggcgaagtctggtggatcacttgaggtcaggagttcaagaccagcctggccaacataatgaaacccccccctctctactaaaaataaaaaattagccggggatggtggtgggcacgtgtaatcccagctacttgggaggctgaggtgggagaattgcttgaacccaggaggcggaggttgcagtgagccgagatcatgccattgcactccagcctggatgacagagtgagactccatctcaaaaaaataaaaataaataaaatacatgtttactttggagaccttatagttagaatttataacatgggttgcgtgagtcaaatccataattcaaatcctgtcttgaatgtgtaatcttcagatttatgttgcataggtaagtttaacttttttgttcctgagggaatagaaaataatatataaactcaaattcttaagtgattctttcacctcagcctcccaaagtgctgggagtataggcatgagccaccaagcccccatctgcttggtcccttttaaccacatactcgtgcatgtaatagtaagtagccactcattgatcatactgtggaacatatggctgacattttaacagcaaaaaaagacctcacatctcggctcactgcaacctcgacttcccatattcaagcaatcctcctgtctcagcctcccaagtagctgggactacaggcacatgccaccacacctggctaattttttttatattttgtagagatggagtttcgccacattgcccaggttggtcacaaactcctgagctcaagctgtctgcctgccttgacttcccaaaatgctaggattataggcgtgagttgctgcgcccagtctgtgtactttacttatgaattagctccttggtcattgccttctccacctttacacacacatatacaccagcttctagagggagtgtgacttgcttctcttgctgttggtgactttttaaatgagctggatgtgtggtaaagtggctgaggttgtagtttgagtgagaagaaagtgtaggggagcagaaagagctgaagggcattagactacaactcaggagatgagcttggtgatctgggttccaaagcctgaaaagattagaaatgaaaatgtggaagagataactgagtcaaaagtaggcatactgacagcagagaaaaagaggaaactgttcttataattattcatgtccatcttacacaggttgaaaaagtgatataataaaggaaccaaggagaaaattcagaaggaaagaaaaaattggtaagtaacatatataagtaatacttcactttttcataggtcagatttctgcaaattctgctttgttgttcctagctgagagctcacagtagatggaaaagggtccataaggcactgaaagagctgtcacaaagtgcagtacccttattctgttggagaggtcttcatttgcttatgttgacatgaaattctaataattatggcttcctgatttacatcctacaacagatttaaaaagaaaattaggaggtaatggtggtttattgaaggagctgggcacatgacagtactgatcagtgaaaatatatagcatgatgtcagaaaaaactagctcaaaaaggatagcaatctgggaccatttggtgacagaagggcaaacagtcctgtagacctactgtagcccttggaggcatctcaggtttacaggaaaatataactgataatcataatcatgactttgaactataaataaaagtggttttccctgtaggaaattatataattcacaatggaaacactttttattttttttttttgagatagagtttcgctcttgttgcccaggctggagtgcaatggcttgatcacggcttactgcaacctctgcctcctgggttcaagcgattctcctgcctcagcctcccgagtagttgggattacaagcatggggcaccatgcctgactaattttgtatttttagtagagacagggtttctccatgttggtcaggctggtctcaaactcccgacctcaggtgatctgcccaccttggcctcccaaagtgctgggattacaggcgtgagccactgcgcctggccgaaaacacttttaccaaacactaagtgttatagtggagccaggtgcagtggctcacacttgtaatcccttgagaggtttgggacttgggaggctgaggctggtggatcatttgaggccaggagtttgagactgtcctgggcaacatagcgagactcctttctctataaaaaaattgaaaacacggctgggtgcggtggcttacgcctgtaatcccagcactttgagaggccgaggcaggcggatcacgagatcaggagatcgagaccatcctggctaacacggtgaaaccctgtctccctaaaaatacaaaaaattagctgggcgtggtggcgggcacctgtagtccctgctactcaggaggctgtggcaggagaatggcttgaacccaggaggtggagcttgcaatgagccgagatcatgccactgcactccatccagcctgagcgacagagcgagactccgtctcaaaaaaaaaaaatcgaaaacatgcaaaaattatctgggtgcagtggttcatgcctgaagtcccagccctctgggaggttgaggcaggaggattgcaggagtttaaggccgcagtgagctgtgattgctccactgcagcctgggtgacagagcaagaccttgtcaataaaattaaatttttttaaaaaccccaagtttttttggtatttagaaggaaagcattttaaagccacatttggtgggggaaagacaaatttgggaaaatgtaattatggggaacccctattccttcctttatacatgaaactatcattgtaatatttttatctttggcatgtttttcattttgatttaacatgtttgaagcagtagctatttttcagttgataacaagaaagggaaaatgtttttattctcttcccacagttaaaatccaatataaacggtgcccagtggcactgatcctagtggcagttactcttctgtaaatagtgcctcccacaatggatatgggtttggaggcagacagagcttatcacctcagattttcattctgatttttcattggggcaatatgaaccccctcctgaatgacagtatcttcttatctaaaggactttgattcttaatgaatgggcaagaaaagaccttctggtttgtgaagaaaaagaggcaacaatagcaacagctttcctccaagtgattattgtagcgaagtcaagcctgaaacaatggagaatgaagttatgcctgactcattttgttattacacccaaatgagttcattgtacagaatgggcctttttgacacgtgtctaatgatattttgatgcaaatgaaataatacacataaaaaatgacctgtttacaggaaagactgatgtatttgttgataactaccagtgacatcaattctcatttctttattggcagttacagtatttgaatttagggttagaccttaaaggatatatccagccaggcatggtggtataagcctataattccagctactcagaaggctgaggcaggaggatcactagaactcaggagtttgagaccagtctgggcacaagaagaccctgtcttaagaaagaaaaaataaaagtctaggccaggcgcagtggctcatgcctgtaatcccagcactttgggaggccgaggcgggtggatcatgaggtcaggagatcgagaccctcctggctaacactgtgaaaccccgtctctactaaaaatacacaaaaagttagccgggcatggtggcaggcacccatcgtcctagctacttgggaggctgaggcaggagaatggtggcgtgaacctgcgggaggcggaggttgcagtgagccaagatcgtgccactgcactccagcctgggcgacagagcgagactccgtctcaaaaaaaaaaaaagaaaaaagaaaaaataaataataaaaaataaaaggctatatcatttgacaagccgtctgatcagtgaatctgttctggaaacatgatcagatttggagcaaagacccttccctccctaccagtttgagacagctcatattgttggaacttaattctgttcaatccctcccccaggaggttccatgctcactggtcttattatatgtaagtctttgacaatgatctaagaaaagctgagttaaaaaattttttttttctttgtctgggggtggtggcttatgcttgtaatcccagcactttggaaggctaaggtggacgcatcacttgaggtcaggagttcaaaaccagtgtggccaacatagtgaaaccccatctttactaaaaaatacaaaaaaattagctgagcatggtggcgggtgcctataatcccagcttctggagaggctgaggcaggataatcacttgaacctgggaggtgcaggttgcagtgagccaagatcacaccagtgcactccagcctcagtgacagagtgagactccatctcaaaaaaaaaaaaaaaatttttttttttcaacacaaggtctcactctgtcaccgaggctggagtacagtggtgcaatcacagctcacggcagcttcaaactcctgggctcaagcgatcctcctgcctcaccctcccgagtagctgagactacaggtatgtgtcaccatgctcagctcaaaagctgacttttaaataaacctttttattagttttattgacttgaaaaatattgctataaaatttttctatggttttcaaatctgttccagttgtcagtcttgtcccttttcaccaaatacctcttcagtacctaatttttttttttccaaggtggagtcttgctctgtcacctagactggagtgcagtggcgtgatctcagctcactgcaacctctgcctcttgggttcaagcaatttcttctgccacggcctcctgagtagctgagactacaggcatgcgccagcatgcccagctaattttttatatttttagtagagacggggtttcaccgtgttagccaggatggtcttgatttcctgacctcgtgatccgccctccttgacctcccaaagtgctgggattacaggcgtgagccaccgcgcccggccatacctaatttttttctaagagacaggatcttgctatgttagcttggctggccttgaacttctaggctcaagtgatcctcctgagtagctgggactacaggtgtgtgccaccatgcccagctagtacctaattgttaatgctacctgatatgattggaagtttttttctgtatgtagcataaagtttctattctgccaatacaagtattttctttcattctgtatctttgttgatttagtgtttaatttcagatttattatttaattcttaactgatatgtatcttcaaaacaaatacagtgactcatttattttcttcctactctttcttaactatatctgacttttagttgaataataggtggggtagctcaggcctgtaatcctaatgctttgggagactgaggtgggaggatctcatgaagccaggggtttgagaccagcctgggcaacatagcaagactccatctctataaaaaatttgaaaattcactgggcatggtggctcattcctgtagtctagctagtcaggaggctaaggcaagaggatcatttgagctcaggaggtgaaggttgcagtgagctgtgtctgcaccactgcacttgagcctaggtgataaagcaagacatcttctcatttaaaaaaaaaaaaaaaagggccgggtgtggtggctcacacctgtaatatcagcactttgggaggccgaggcgggcggatcacgaggtcaggagatcgagaccatcctggctaacacagtgaaaccccgtctctgctaaaaatacaaaaaattagccgggcgtggcggcgggcacctgtagtcccagctactcgggaggctgaggcaggagaatggtgtgaacccgggaagcggagcttgcagtgagccgagattgtgccactgcactcctgcctgggcagcagagcgagactccgtctcaaaaaaaaaaaaaaaaaggcttggcgaggtggctaatgcctgtaatcccagcactttgggagtccaaggtaggtggatcacctgagatgatcaccagcctgactaacatggagaaaccccgctttgtctctactaaaaatacaaaatttgctgggcttggtggtgtatgcctgtaatcccagctactttggaggctgaggcaggagaatctcttgaacctgggaggcagaggttgtggtgagccaagatcatgccattgcactccagcctggggaacaagagtaaaactccatctcaaaaaaaacaaaaaggtatttaaatttcttttcacctttagaaacaagaagtacattgtgtgagttgtagtttttctgactttaattcttttccttaagtaaaatattaggactataacagaagatggaagttaaaagtcaagtcagcattgttgttcattttgtttgtttatttgttttgttttttatttatttttttgaaatggagtcctgctctgtctcccaggctggagtgcagtggcatgatctcagcttaccgcaacctctgcctcctgggttctagcgatcctcctacctcagcctcccaagtagctgggattacaggcgtgcaccacacacccagctaatttttgtatttttagtagagatggggattcaccatgttggccagactggtcttgaactcctgacctcaggtgatccactcccctcagcctcccgaagtgctgggattacaggcgtgagccaccgcacctggccagttgttcatttttaagagttaatagcagccgatgtgatggctcacacctgtaatcctagcatgttgagaggccaaggtggaggattgcttgaggccaggagtttgagagcaatctgacaaacatagtgaaaccctgcctatatttcttttctttttttttgagaccgagtcttgctctctcacccaggcaggcatgagccaccacgcctggtttatttctttttttctttttttctttttttcttttttttttttttttgagactgagtctcaccctatcgcccaggctggagtgcaatggtgcgatctcagctcactgcaacctccatctcccgggttcaagcaattctcctgcctcagcctcccgagtagctgggattacaggcatgtcccatcatgcccagctaacctggcttatttctatatattatttttttctaagaataaacaaatgaacaaaaacagttaatatcattggaataacatgcaggtcctaaaataagaagtatgtaagatgtgtttattgaaatatatatatggtatactggaaaaaaaaccccacaaaatattacacaaatactggttacagcttacagtagccagcctccaagatgccccccagtgatgctcacctcctaatattcatgcctttgtgtagtccccttttacagttcgtcagggttggtctgtatgagcattagaatatagggatatgatagtgtatgacttccaaaacaaagtcataaaagacattactgcttctgccctgctcttcttggattgactgctctggaggaagccagccactgggttataaagacattcaagcagccctatggaggatctacacggggagctactgagacttcctgcccacagctggcatcaacttgccaaccattgagtgagccatcttggaggtgggtcttccaggcctagtcaagccttcagattgactgcagccccagcctacatcttgactgcaatctcatgagagcctcagagccaaaactgtctaattaaaccactctcagagtcccaaaccacagaaataatgagataggccgggcgcaatggctcacacctgtaatctcagcactttgggaggccaacgcaggtggatcacctgaggtcaggagtttgagcctggccaatatggcgaaaccccgtctctactagaaatacaaaaattagccgggtgtggtggggggtgcctgtagtcccagctacttcggaggctgtgacaggagaatcacttgaacccaggaggcagaggttgcagtgagccaagatcacgccactgcactgcaacctgggcaacagagggagactctgtctcaaaaaaataaaaaagggatgagataataaatatttttattgcttaatacatgtatttatttacttaattaatttattttttgagacagggtcttgctctgtcacccatgctggagtgcagtggcatgattctagctcactgcagcttcgaactcctgggcttaagtgatccttctgcctcagcctcccaagtagctgggactgcaagtgtgcactgccatgcctggctaattttttcattaaaaaaaaattttttttaatagggttttgctgtgttgcccaggctggtctcaaactcctgggctccagtgatcctcctgccttagcctcccaagtgttgggatttacaggcatgaggcaccatgcccagccaattttttttttctttttttctttttctttttttttgattcttcagctaagacagcagaagagatgatttatcgtatggttgttatactcggccacaagtaaacacagaaatagtccagaatgtcccaggtccagggcagaggaccaacatgggcagttttggttatgagcaaggtgggtctcagaggtgatcagcgatcagagggcggtgaagttctggatccattgagacaagctctacacaatagcatgcagtcccacaacttgtaccagcatccccagcatctggcattccatgtttctgctcctgtgtggcctccacggtgcaacaagctagcggtttacttggacctctgcctcatctttcttcttttgtgcttcagactgcacattcgctttttcctccacttagctctcatgatgcagaggtttccaagaaaatggcgctaaggccgagagaaaccctagcccatttctattgtcagtttttattgaattccaccttggacgctcttctaggttcttgggttacaccagtaaacaaaaagatttctgctcttgaggagcttatattctatcagaggaacacagacaataaatatcagtaagctttccagtatgttagaatgtgataagtggtgtggaaaaaagaaaagtggatcagagtaaggggagttgagaaagcaggtagaggtgggagcatgtgaaggtgagaggttatagtattaagtagatctcaataagaaagtgatttttaaacaagtatttgaaggagttgcaggaattcatcaagtggatatataggaaaagaatttctaggcagtggggacagcttagagcgaaggccctaaggcaggggcatgagtgaataagcgcagaggtcagtgttgggggagagtaaggtgaaaactattagtagatggggtcagagatgtagtggggatggaagcagaaggctattttcaggaccttgtttctctgaaatggggagccagtgctggattttgcataaaacagagacatactctaatttatattaaaggatgactttggttgtttgttaaaaggagacaaactccaggggagtgaggataaaagcaggaagatctgttaggacaatattagcaaatcacatgaaagatgatagtggcttgggcgaaggtggtagcaatggaagtggtcagaaatggtcggattctggaaatgtattcaacagcaggaaattaagatcttcaaaatctcttgattagctgggcacagtggctcaaccctgttatcccagctattcaggaggctgaggctagaggattgcatgaggccaggagttcaagaccagcctgggtaacatagtgagactccatctctacataaataaataaataagctcttgattttatgtaagaaggtcagactgctgtaagactttcacatcctgatggaagtctcactttccagcctcatctcagaccattctctgctctacactcgcctccccactcccatatctgtcttttccaagagccctgttagataatccttcttgggtggcctactagttaagactgtggctctggaattaaaccatctgggtttgatttctggctcatttcatttaactacgatgtggtcttaagatacttagtttctctaagctcagttttctcatttataaaatgggaatcttaataatagcacctaactcacagagcagtaatgtgagattaaatgagctaatctatgtagaatacttaacatcatgcttggcatctactaagatctccgtaaatattggttactatttttttaaaatctcagattatgtttctttgaccacaatctttatcctctgcattaaatgctaaccctcttcttctatatcctctttcactagttttctactttttatttctcaaattcatataaaaaattcttgaggacattggcttttaattattattatttgagacagggtctcactctgtcgcctaggctggagtacagtggtgccgtgcaatcacagttcacctcagcctccacttctcaggctcaaatgatcctcatacctcagcctcctgaatagttgagactacaggtgtgtaccaccatgcctggctttttttttttttttttttttttttgagatgaggtcttgctctctcgccaggctggagtgtagtggcatgatctcggctcactgcaacctccgcctcccaggttcaagcgattctcctgcctcagcctcccgagtagctcggactacaggtgcccgccaccatgcctggctaatttttttctttttttttgggatggagtcttgctctgttgcccaggctggagtgcagtggtgcaatctcggctcactgcaagctcggcctcccaggttcacgtcattctcctgcctaaccctcccgagtagctgggactataggcacccgccatcacacccagctaattttttgtatttttagtagagacgggatttcaccgtgttaaccaggatggtctcgatctcttgacctcgtgatccgcttgccttggcctcccaaagtgctgggattacaggcatgagccactgcgcccagacacaccctgctaattttttaatattttgtagagatagcatttcactatgttgcccaggctagtctcaaactcttggggtcaagcaatcctcccactttggcctcccaaagtgctaggattacaggcatgagtcatcatacctggcctcgctatttttaatttttatacggatagggtctcactgtgttgtccaagctggacttgcactccttggctgaagtgaccctctttcctcagcctcctgagtacctgggactatggtcacgtgccactccatatggctcttgaggaaatttttaaatgaaatcaaacgatacttttcctatcatctttttctaatctctctggtctttatacacatctggtctctattatttctgtagttatttctgtccatttttcatgattgcttacatgtcatttcattttttttgttgttgttttgagacaggttcttgctctgttgcccaggctggagtgcagtggcatgatctcggctccctgcagcctcgcctcccaggttcaagcaattctcccacctcagcctcctgagtagctgggattacaggcacaccaccacgcctggacaatttttgtatttttagtagagatggggtttcaccatattggccaggctggtcctgaactcttgacctcaggtgatccaccctcctcggcctcccaaagtgttgggattacaggcgtgagccactgtgcccagccatttcttttatatatgcttatatatatattttttaaattgagacggggttcagtcttgtcacccaggctggagtacagtggtgcgatctcaactcacagcaacctccacctcccagggggctcaagcaatcctcccacctcagcctcccaaatagctgggactacaggtgcattccaccatgcctgactagtttttgtatttttggtggagatgaggtttcatcatgttgcccaggctggtctcgaactcctgagctcaagcaatctgcctgccttggcctcccaaagtgctaggattacagacgtgagccactgtgcctggtctcaaatgtcttttcttgatgcgtttccaaatcctctagggagttagtcctgtgtttttgttcctttaccttttttttttttttttttgagatggagtctcgctctgtcgcccaggctggagtgcagtgacgcgacctcggctaactgcaacctccgccccctgggttcaagtgattctcctgcctcagacccctgaatagctgggattacaggtgcatgccaccatgcctggctaatttttaaatttttggtagagatggggtttcatcatgttggtcaggctggtctggaactcctgacctcatgatccgcccgccttggcctccccaagtgctgggattacaggtgtaagctactgcgcccggccctttacctttttttttgagacggagtctcgccctgttgcccagtctagagtgcagtggcttgatcttggctcactgcaacctccgcctgccaggttcaagcaattctcctgcctcaccctcctgagtagctgggattacaggcacgcgccactgcgcctggctaatttttgtatatttagtagagacggttttaccatgttggtcagtctggtctcaaactcctgacctcatgatccgcccaccttggcctcccaaagtgctgggattacaggagtgagccaccgtgcccggcctacctttgttttttttgggggggtggggggcagagtcttactctgtcacccaggctggggtgcaatcctgtgatcttggctcactgcaacctctgcgtcctgagttcaagcaattctcgttcctcagtctcctgagtagttgggattacaggcgcatgccaccacacctggctaatttttgtatttttagtagatatggggtttcaccacgttggccaggctggtcacgaactcctaacttgaggtaatccacccactttggcctcccaaagtgctgggattacaggcgtgagctactgcgcctagcttctttaccatttttatgcttagtttaaaaagttacggttatttttatatatgtctgccacctctgccagactcagcatcttgaataaaaagatctgttttcctcacctttacttttctggcacctagcagttagtaggcatcagtaagcattagtagaattaagcaattgagtggtcctgacaaggctcctgactgcagtccttacatgtaactaccagattcgtatttggatactccctagttcaatatcttcagtggcttcctatcacctgcagagtaaagtccaaactccttagctgagtatttggtgtcctctactatgtgacctcaatctatctcttcaactttattttctactatagttggtcaaactgatccattcactgttcctcaggggcccccatcccttttccacatccgtgtcttgattcatggttttattcctgaaaagcactccttgcctgtcctaattcatttccctcctcaggaccctcctcagatacgacctttttcacagagccttctccatcatcccagctttgaagtttcagagcatagtaactgtgctgcttgacacattttcactttatagaggtaatttatggacatgtattttttttttccaacttagtatagtttcttagggtttcttaaagtttctaagatgatttatctttgtgtgctgtacttgtaagcagcagtaagaaattgctaatttctggaatggctgtcactgtcggttactacaggttgaatgaaggggacaaacgcagaaatgaagacaaagacaaaaggatctgtttcgaaagaaggggtcagggagctccttgcttctagtgagcaaaggcagccctgagcttctaccgcccttcgtatttattagatagaaagagcagggagggagaggtaacagttggtcagctgctagatttatcacaggtacacataattgctttctttgtacaacaggcttcagatgctcctatagataattgcaaggaacactgcgctgggggtgtgactgccctcagcaccccttctggtggcagacgcagtttgtcagttttccaacatcctgctttcatgagaacagttttctgtttgctcatataacctccaatggcatactgagttggtcacgaccctcattctttctgcctgtaacacatggccaaatgaatgaatgaatataggaacaaataggcttcacatgccctatccatggtctagtttggaggggaattgggagttggacatgtaatacctaggccgtagtggaacactgggaaagggggtactccttgccctattgcttctgcctgcatattccattagcctaattgtaccaagtccatttgggattcaattactggtgtccagcatgttccaggcctaatattaatacctgtctttggtaatacaaaagataccatgcaccacccaccttagacatccttcagatagcaaggtgtgtcagggctgtggccctttgtattataagttatatcctcaaataaggcattgctcactttgctgcagcctgtcctgaacttagcttattagacctaccttggttttgcttggcttggcttacttatgcactgggtggtttaactatattggttccatagttcagcttactgtttaaaaatttcattctagttacattttaaacttgccttatgtttaatttttaacttgttaaggctagctttgctgtggagctcagatgaattgtcagtgggagcttttacatttcactctttttggaccttttggtggacctttctaatcacctatccaattttccactgttgtgagatactgtattattttatccaagtcaatcaataatgatatttgcttagggagtcaacagaaagacataactaacaatcaatctcactatgggaaaggaaaacaagtccactccttttgaaatctgattctctgcttccagagccattttccctcactctggctgtctttattctggtacacctctatattccagctgtaccaagctgttaatacttgaagttctcagaatcctccttgtgtcattttcccaggataattcctacctctcatccctcaagaagcttcccagtcccatcccaccttcacctttccccttccaagccaagtttcttgtcccttatgtctgttcctagagcactttgtgtgcatttctgtcagagaacttatcacagtacattacagtcgttggtttgcttgtctgggttttgttagtttgttttttgagacaggttcttgctctgtagcccaggctggaatgcagtgatataatcatggttcatgcagccttgacctcttaggctcaagcgatcctcccaccttagccttctgagtagctgggactacaggtgcatgccaccatgcccagataatttttttatttttgtagagacagagcttcactgtgttgcccaaggtggtcttgaaatcctgacctcaagtaatcctcctgcctcgaccttccaaagtgctaagattacagacaagagccactgtgcccagccctgttttctccagtaagctgaaatttcttctatatcggattcctctgtatatatcaagaatctagcacagtgcctggtatatattagatactcagtacatgcttattaactagacaggtgaatgcccaggtttctaaagttttttttttttttttttaagagaccaagttatgttccatccaggtttctaaattctgtgtcagggatggaaggtattgagaagtgctattaacttttctatttggctaacaaaaacacagaaatgagttgctgagcagcttccgccctatgagcgataatcctactagttggaagttaactatgataaaagtagatgaacgaattgtgtactcagagaaaaagagagtaagggaggagggaaggatagagaagggagtgagttagcaaaatgccacactgttagttgcaaactggcacaaaggtgaatgcggttcatgaggctcgcttgattaagaagagctgaaacaggagcaaagagcaaaaggcaacctgcagcgaaagcaaggactcagggaaccggcagacacaagcaggtgagcacatgaatggggcccaggtcctctgggattgtggtctctcaggcttccggggacatggaagaagggaagccagagtgtgacgttctgggaaagctgagtggggaggattcatgtgtactccaggtataaagagacacaaaagaccatagaaggagatggagatagtgacaaacactggctggcaccagagtctcaacaaaaagaattggaaacagggctttgttggggggtgaataagagatagtgagcaagagaaaatgagaagaccaactgtgaaaggagtagatttaaatgtactgacgtatacatacctccctagtctacaaaaagtacgcctatctgcactattttgagtagcatataaaacttgacacatttggataaatgtcacctttatataacaaatgtggggaaaaccttcactgaagcttggaattgtgatttttttcaggggctgggtaattttttggaaagcagtcagctattattattattattattattattattattatttgagatagagtctctctctatcactgaggctggagtgcagtggcacacttaacaggcgtgagccactgtgcccgatcagctgttacatttttattaaatgggtgagatctagtgcctgagttactgtattattgtttatccctttggagtattcattcaacatctactgtgtgctcacaccaccattccagcaccaggaacacataaaaaacaaaacagataaaaattcctgcttacgggccagccaaggtggctcatgcctataatcctagcattttgggaggctgaggcgggtggatcacttgagaccagaagtttgagaacagcctggccaacatggcaaaaccctgtctctattaaaaatacaaaattagccaggcgcggcggcacatgcttgtaatcctggctgcttgggaggctgaggcatgagaatcgcttgaacccgggaggcggaggttgcagtgaggtgagattgcacaactgcactccagcctgggtgatagagcaagactctgtatttaaaaaaaaaaaaaaaaattctgcctggctatgtatagttcacatagtgggtaaaggtggcaggaaacaggaaatatgaaaataaacaaaagtaaattatataatgtgttagatggtaaaaagtcctgtggagaaaaataaacagaaaaggaagataggaaaacatgatgtggtcagatgggttataattttaaataaggtagacaaggaaggtctcactgagaagctgacatatttgagcaaagattttaacatagtgaacgagcaagctgtgcagactcgggttctgtaaaataggatgtcattctataaatgtaagactttttttttttttttgagatggagtctcgctctgtcgcccaggctggagtgctggtgcaatcttatctcattgcaacctccgcctcccgggttcaagcgattctcctgactcagcctcccaagtagttgggattacaggtgcctgccaccacgcctggctaatttttgtgtttttagtagagatggggtgtcaccatgttgaccagtctggtttcgaactcctgacctcatgatccacccacctcggcctcccaaagtgctggattacaggcgtgagccactgcacctggcacattagttattttaaaatggcttacattgctcggtgcggaggcttgtgcctgttatcccaggactttgggaggctgaggcgagtggatcacctgaggtcaggagttcgaaaccagcctggccaacatggtgaaaccccatctttactaaaaatacaaaaaattagccaggtgtggtggtatgcgcctgtaatcctagcttctagggaggctgaggcaagagactttcttgattccaggaggcagaggttgcagtgagccaagattgcaccattgcactccagcctgggcaacagagtgaaactccatctcaaaataaataaataaagtttaaaaaaataagacaatgcctaatgccattttaaaataactaatcttaaaagtgcgattgcaagtggtttagaatgtagttactgagagctgaaaggggcattctatttgttcatcctttgctttctctaaaatctattgtttggttttacactgaacaactagtatgactctgcagggttttttgtttgtttttttttttttgttttttcgtgaaaacagatacctaggatgttttttttcacctttgaaatctctggaagaaaaacaaatatttacttaatagaaatagaagctggagaagtttttcaaaaactacaatgatatattaatacaaaatttgggtgacccctgaagaaactgcagtcacacagaggaaggaaagctgctgcctagaatgccattaattcactttctgagggaaaagagggacccagagttggacaaagcaaggatctgttaacactcagagactctgaagagttgtttctgtttcgagttatttagtttgatctacatgtctagctcatttgctgtaaaagaatcagccagagtgtgaacctggccaggcagctatcctgtatcagtggttgatttcctgggatgaagtttcctttgtttgggattgtaaaaggtcaaacaattttgtctgttcctctcctaaccaatagctcttattcttaactacaggatagaagttcaaccttgaatagtgttctaacggatggttccagctctgctttggtagtacctaagaccaaatctagttattttaaatattttatttattgagacagggtctcactctgtacctaggctgaagtgcagtagtgcagtcacagctcactgaacctcaacttcccgggatccagagatcctcccacctccagcttcccaagtagctaggaccacaggtgcatgccaccacgtccaactaatttttgtacttttggtagagatggggtttcatcatgttgcccaagctggtctcgaactcctgacctcaaacaatccactcaccttggcctgtcgaactgccgggattacaggcatgagccactttacccagcctaaatattttaaaattccaaatatagttaactttgttttatgtatttattttgagatagaatctcactctatctctcatgctggagtgcagtgacacagtctcagctcactgcaacctccgcctcccaggttcaagcaattctcgtacttcagcctcccaagtagctaggactacaggcctgtaccaccatgcccggctaatttttgtatttttagcagagacggggtttcgccttgttacccaggctggtctcgtactcctgacctcaagtgatccgcccgcctcggcctcccaaaatgctgagatgataggcgtgcgccaccacacccagctgcaattaactttaatttgcttttttttttttttttttgagacggagtcttgttccgtcgcctaggctggagttcagtggcacaatctccgcttgctgcagcctttgcctcccaggttcaagcaattctcctgcctcagcctccctagtaactggagcgacaggcatgcgccaccacgcctaatttttttttgtattttaatagagacagagtttcaccatgttggccaggctggtctcaaactcctgacctcaggtgatctactcacctcagcctcccaaagtgctgggattataggcgtgagccaccacgcctggcctaatttgctttattttgtgtaatatgtcacctgtggggagggagacattttgataaaccctagatactcaacaaagttgagatgattgagaatccttaatctgtactccaaatatacgaagtattttgttagagctgaagggcctgggaaatgggaactttagaatcagatcttgtcacttaaccagtaaactatgacttacataagagatccagagatgaaagctggatcagaagacccaaaactgtttggtgcaaagtacataaagtgcaagtcaggaagctttaccttagaggatagatacggcattattcattaataccggaagaaaatggcagagaaaacgtttatatacatacatatatatgaaaatattttatatatatatatactttttttttgtgagacggagtttcgctcttgttgcccacgctggagtgcaatggtgcaatctcagctcactgcacccttcacctcccgggttcaagtgattctcctgcctcaggctcccgagtagctgggattacaggctatttaaaaaaaaatttttaaataaacataaaattaaaatacatagaatatattttatatgtaaatatacagagcaggaaaattagccagcagacagctggcaatgtctggagacgtttttggttatcacaactggttgtgggtggaggggcgggatgtgctattgacctctagtggatagaggctggggatactgctaaacatcctaccttacacaggacagcgcccacatcaagccctaattgttttttttttttttttttggttattgtttttttttttttaagacagattcttgctctgtcctccaggctggagcacagtggtgcgatcttgactcactgcagcctccgcctcccgggttcaagtgatgttcctgcctcagcctcctgagtagctgggattacaagcatgcaccaccacaactaactaatttttgtattttagtagagacgggggtttcaccacgttggccaggctgatctcaaactcctaacctcaagtgatccgccagcattggcctcccaaagtgctgggattacaggtgtgaggcactgctcctggcccctaaatgtaaacagtgctaagattaagaaaccctgaccttgaggaactccagttttcctttacggatgagatcataggacacagtctgagctttgcaggaggccagatacaaatcaccaaaacaaaaagcacttaattgtttttgttggtttctcatttaatgtccatccagaaaaaaagagggggaaaaaagttgctagtaaagcaactgtgaagtatggatgccattattccattcaacactaccaagtgattttttgtttttgtttttgttttgagacacagtctcactctgtcgcccaggctggagtgcagtggcatggtttcggctcactgcaacctctgcttcccggtttcaagcaattctcctgtctcaacctcctgagtagctgggactactggcgcatgccaccatgcctggctcatttttgtatttttagtagagatggggttttaccatattggtcatgctggtctcgaactcctgaccttacatgatccacctgcctcggcctcccaaagtgctgagattacaggcatgagccactgcacccagccacaaatgttttttatcacaggtttcaataatattcaaactcatgataatggctttgttgcagaatgatggaaaaaaaccctatacatttaaaaaattattttccagtaaaacaaatccggctgggtgaagtggctcatgcctggaatcccagcactttgggaggctgaggcaggtggatctcaggctgagttcaagaccagccagggcaatatggcagaaccccatctctaccaaaataaaaaaaatagccaggtatggaggcacacacgtgtaatcccaactactcgggaggctaaggaggaaggatcacttgagcccgggaggtgatgattgcagtgaaccgtgattgtgccactgcactccagccggggtgacagagtgagaccctgtctcaaaaaaagatggggagtcagaaaagagggagggagaaacggatatttatgttctaaagggaaaatcatcaaaatggaaagaagaaattagactcaacaataggagcagagtggcagagagcctttgagtatgtgagagccaccctacaattattattttttatttttagagacagggtcttgctttgtcacccaggctggagtgcaatggcatgatcatagctcactgtaaccttgagctcctggactcaagtggtcttcctacctcagcctcccaagtacctgggactataggcatgtgccaccatacctggctaatttatttattatatttatttattttttttgagacgaagtcttgctctgttgcccaagctggaatgtagtggggcgatgtctgctcactggaaccttagcttcccaggttcaagtggttctcctgcctcagcctcctgagtagctgggattacaggcacctgccaccaagcccggctaatttttttttttttttttttttttttgagactgagtcttgctgtgtcgcccaggctggagtgcagtggcacgatctcggctcgctacaacctctgcctcccgggttcaagagattctcctgccttagcctccccagtagctgggattataggcacccgccatcatgcccagctaatttttgtatttttgtagaggcggggtttcaccatgttggccaggctggtcttgaactcctgacctcaggtgatccgcctgcctcggcctcccaaagtgctgggattacaggcatgagccaccgcgcctggcctaatttttgtatttttagtagatacagggtttcaccatgttggccaggctggtctcaaactcctgacctcaggtgatccgcccgcctcggcctcccaaagtactgggattacaggcatgagccaccgcgcccggcctaatttttgtatttttagtagatacagggtttcaccatgttggccaggctggtctcgaactcctgacctcacgtgatccacctgccttggcctcccaaagtgctgggattagaggcatgagccactgcgcctggcctgtgtatttttttgtagagacagggctctcgctatgttgccaaagctggtcgtgaactcctaggctcaagcaatcctcccacctgagcctcccaaagtgctggaattataggctggagccactgttcctggcccccaccctataattaaaagcaaagtggctgggcgtggtggcttatgcctgtaatcccagcactttgggaggccgaggcgggtggatcacgaggtcaggagttcgagaccagcctgaccaacatggtgaaaccccgtctgtactaaaaatacaaaaattagctgggcatggtggtgggtccctgtaatcccagctactcaggaggctgaggcaggagaatcacatgaacccgggaggcagaggtttcagtgagctgagattgcgccactgcattccagcctgggcgacagagtgagagtccgtctcaaaaaaaataaaataaaaaaaagcaaaggtcattatgttaagtgaaacacgccaggctcagaaagatatatactgcatgttctcactcatatatgggagctaaaaaagttgatttcatggaagtagaatagaatgacagttaccagaggggctgggaaggctagtggggtgtggagagattaggagaacttggttaatgggtacaaacttacaattaaatagaaggaataagttatagtgtttgatagttcagtagggtgactatagttaacaatattttattgtgtatttcaaagtagctagaagatttgaaatgtttccaacacaaacaatgataaatgttgtaatagatatcctagattctctgatttgatctttacacatcgtctgcatatatcaaaatatcacatgtattccataaatatgtacaattactctgtatttttaaaaaccaaagcatgggaaaatatatcttcaattccaatttccttttggaactagatacccttcggaaaaggtgctaagagcccacatcaccctggtttagcttgttgtacaggttattagaatagggaaggaacaccttgggcccaggagtgagtgtttcttcttttacaggtgtaactaaaaaagctagttggtctaacttgtgtgtctttgtcctataagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggtaagtgcaactgggacccttagtagagtctgtaaatccacactttagcatctcctcccagaaacaaatatgctgagagtttattatgtgaattacagaatctcacacctagtggatgtctttcttcagagaactttggactacaattgaacatgtggtttatttatttatttttatttatttgttttgtttttattttttaactttttttttgagacaaggtcttgctttgttgcccggtctgtagtgcagtggcatgatgacacatcactgcaaccttgacctcctgggctcaagcagtccttccacctcagccccctgagttgttgagactacaggcttgtgccaccatgcccagctcatttttaaatttttttatagagacctgctcaggctggcctcaaactcctaggctcaattgatcctcccacctcagcctcccaaagtactgggattataggtgtaagtcaccatgcttggccagaacacatggtttaattcaatgtgaaattagaagagagctgggctgtctgtagtctgaaacccatgtgttcaaaaagaatagttataatttgttcttcctctttaaacatgggatactccagggatccataatattcagaatatggggagtggttttgggagaaggatcacatgagaatttcactgccatccttggacatgaggctaggaatccctgaagattaactttttctgaattgtcagtgttttttcctcaggtcacttatggagcctggggaaaggtggaggagttaggtgtccaccagagaaatggtagcagaaatggaccctcagaggttgctctagtccttctttccagtactcctgcaagacattcctcacaactaggatcatttgggataacttcagggaagtcataggaaaacttacagagacagagcccagcatctgaagcagcctaacttttggtaaccagctctctcttctgttttgttccatggacaaaataggacagcttccaattctagaaggggaagtttttgattctgtgaagccaggactttctgcttttgtagatcaacctaagcaggtgagtttcttatgatttgatgtttagattctcaatgccttgataacttgaccacaccactgctgttaaatatttcatgctattcactaatgagattgagatcatgtgtgagatcagctttctctcctcagctaatctcctggataaaattaattacatttcccacgctcatgagggctgggtggaagaaggctagaaaattggttgtggtaatgcaaggatgacactagcttttaagagattactccctatgtacttactgtttaaaattttgagttgaagccatcagttgtatttgttcatgtaagcgcagaagataaacatgaagttctgtagggtatgatgtataaacatggcagttgaaggcatggtgagcagtgaattccatttcagagtgccttgatgcaggatggaaccatatctatacttgagaaattaggcaacaacccatgatgacaaaaatctttggtggtagaagatgaatagagagtttgtggcgactatatttcacatttgagcatctacaacatactacatcctatgtgtctgaggccatgttgaaataaaatagaataatgcagaatgttaaacttggggagcaaatgtaaaggtatttattgttcattgtcacaagaataatcattacccaaatgcttgatgttaaaaatgatttgagtttggagaactgagaggatatatggatatatatacattttcttctttttcttttttttttttttttttgacggagtatcactctgttacccaggctggagtgcagtggcctgatctcggcttactacaacctctgcctcgcgggttcaagcaattcttctgcctcagcctcccgagtagctgggactacaggcatgtgccaccatgcccggctaatttttgtatttttagtagagacggggtttcactatgatggccaggctggtcttgaactcctgaccttgtgatccgcccatgtcagcctctcaaagtgctgggattacaggtgtgagccactgcacctggccccgagaggatatattttcttagttcagtagcacatggatagcaaatctactagaaaaatttggagctgttcaaaagaaactaccatcagagtaaacaggcaacctacagaacgggagaaaatttttacaatctacccacctgacaaagggctaatatccagaatctgcaaagaacttaacaaatttacaagaaaaaatcaaacaaccccatcaaaaagtgggcaaaggatatgaacagacacttctcaaaagaagacatttatgcagccaacggacacatgaaaaaatgctcatcatcactggccatcagagaaatgcaaatcaaaaccacaatgagacaccatctcacaccagttagaatggcggtcattaaaaagtcaggaaacaacaagtgctggagaggatgtggagaaataggaacactcttacactgttggtgggactgtaaactagttcaaccattgtggaagacagcgtggtgattcctcaaggatctaggaatagaaataccatttgacccagccatcccattactcggtatatacccaaaggattataaatcatgctgctataaagacacatgcacacatatgtttattgaggcatcattcacaatatcaaagacttggaacgaacccaaatgtccatcaatgatagactagattaagaaaatgtggcacatatacaccatggaatactatgtagccataaaaaaaggatgagttcatgtcctttgtaaggacatgtatgaagctggaaaccatcattctgagcaaactgtcgcaagaacagaaaaccaaacaccgcatgttctcactcataggtgggaattgaacaatgaggacacagggtggggaacatcacacaccggggcctgtcgtggggtggcgggagcagggagggaaagcattaggagatatacctaatgtaaatgatgagttaatgggtgcagcccaccaacgtggcacatgtatgcatatgtaacaaacaaacctgcacattgtgcacatgtaccctagaacttaaagtattaaaaaaaaataccagggtcaggggtatatttgaatagtaaataaataaattaattaattaaaaataaataattaaaaaagaaaaattaggagctgttgaaagcaactatattattagaaactgacttggcatttagaaaaggtgatcgtgttgtagttgctaacaataatgatcaaagggcagtcagatatcagaatagaagttcattcagggaaatagtggatttaaaataatggttttcatttattacaaattgagcatctactgtgtgccatatgatgatacaggaatgagcctgacatgttctttaggagatcatcaaaagtatggcatcattactgccacagcttgtgtggtaaccacatgcactatgcctcatgcacacaacagtttagtggtggtaggcagcgtatctaccatcccacacttgaggaaaccaagtcccaacaaggccaagtgacctaagttaggccacagggctagcaagcaagtcttctgactctaactcctgttttcttcactctaccatcctaaagctgatttatatataagaaacatgaaataatcagccaggtgctgtggcgcatgcctgtaatcccagctactcaggaggctgaggcaggagaatcgcttgaacccgggaggcagaggttgcagtgagccgagattgtgccgttgcactccagcctgggtaacaagagcaaaattccgtcttaaaaaaaagaaaaagataatcaactaaaatgatcacaatataaaagaataatttggccaggcacggtggctcatgcttgtaatcccagcactttgggaggggtgaggtgggtggatcacttgaggtcaggtattcgagaccagcctggccaagatggtgacaccctgtctctactaaaaatacaaaaattatctgggtgtggtggcatatgcctgtaatcccagctacttgggtgactgaggcacaagcatcgcttgaacctgggaggtggaggttgcagtgagccaagatcacaagatcatgccactgcactccagcctgggtgacagagcaagaatgtcccaaaaaaaataataataataataataattttttattaggactgtcaaaatgaaatggattctccttttttttttttttttgagatggagtgtcactctgttgcgcaggctgtagtgcagtggcataggcttgactcactgcaacctctgcctcccaggttcaagcaatgctcttgcctcagcctcccgagtagctgagactacaggtgtgtgccaccatgcctggcttatttttgtattttttagtggagatggggtttcaccatgttggtcaggctgatctcaaactcctgacctcaaatgatccacccaccttggcctcccaaagttctgggattacaggtgtgagacaccactgcgcctggcctggattctccttcaaagcggcccacttctctaggtttctcctgctacagagcagagagaggttggagccctatgccacctccctcttcttgctcccacaaagtatgttgacagaatagaccagtgccagccactaaatggatcgttcatcagatgaacgggttatctcttttgaagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaagttttaaaactgcatcttggatcattctgcccttttccctatatgaatactttatgagtttttagccttttggaatgtgaccactaccttcagtattccaccactgccaaagcattgtgatgactctgaccacttgttatagctagttgtttacatttttaactatcactcttaaatgtatagagcttttcctaaaaaatttaaagtactttctatctaggatattcttcattctttttatttttatttttattttttgagatggagtctcactctgtcacccaggctggagtgcagtggcgccatcttggctcactgcaagctccacctcccaggttaatgccattctcctgcctcagcctccggagtagctgggactacaggcacctgccaccacacccgactaattttttgtatttttagtagagacggggtttcactgcgttagccaggatggtctcgatctcctgacctcgtgatctgcccgcctcagcctcccaaagtgctggaattacaggcatgagctgctgcacctggctgatattcttcattcttttagatttttaaagcagaatcagaagtcgtttctaatcaactttattaagataaacttacatacaataaaatatatctattttaggctgggcacggtggctcacacctgtaatcccagcactttgggaggctgaggcaggtggattgcctgaggtcaggagtttgagaccagcctggctaacatggtgaaacctcatctctactaaaaatacaaaaattagctgggcattgtggcgcacgcctgtagtcccagctactcaggaggctgaggcaggagaatcgcttcaacccaggaagcagaggttccactaagctgagatcacaccactgcactccagcctgcgcaacagagcgagactgcatctcaaaaaacaaacaaacaaaaaattatatattttaggtgtacagttaaatgagttttgacaagaaatagaaatttcctcatgctcttttatagtgagtttccctcacccctgaaaccaaccaatcactaatttgcttcctgtcactataagttttgcttattcttttcatataaatggaattatacagtttttatttttatttttgtatatctggcttttttcctctcagcataaagtttttgagaagaataatggaactttaaagtttgattttttttttttttttggaaacagagtctcactctgtcttccaagcttgagtgcagtggcacgatcttggctcactgcaacctccacctcccaggttcaagcaatcctcctgccttagcctcccagttaactgagattacagttatgtgccaccacacccggctaatttttataaatttttttgtagacatagggtttcaccatgttgcccaggcttggtttcaaactcctgagctcaggcagtccaccttccttggcctcccaaagtgctaggattataggaacaggcatgagccaccacgcctggtgaagtcatatatatatatatacattttttttttctgttacccagactggagtgcagtggcacaatgttggctcactgcaacctccgcctcccaggttcaagcaattcttctgccacagcctccagagtagttgggattataggcatgcaccaccacgcctggctaatttttgtatttttaatggagacagggtttcaccatgttggccaggctggtctcaaactcctggcctcaaactccacccaccccggcttcccaaagtgctgggattacagacgtgagccactgcacccggccctaagtcatatatttcaactcccttcttattcagatcaaaaatttaagtatagagagttttgttaaattcagtatttttatttttattcttatttatttatttatttatttattttttgagaggcggagacttgctctgtcgcccaggctggagtgcagtagtgcgacctcaggtcactacaacctctgcctcccagattcaagcgattctcctgcctcagcttcccgagtagctgggactacaggcgtgcgccaccactcccagctaatttttgtatattttagtagagatggggtttcgccatgttggtcaggctggtctcaaactcctgacctaaggtgatctgcccgcctcagcctcccaaagtactgggattacaggcatgagccattgtgcccagccaaactcagtatttttaaattttattgtatatatttgttatgcaataaacatgtaagttaataaaatttaaatttcatgttgtgaagaatataagcagaatctcattataacaaaaaatcaggctcggtgcagtggctcatgcctgtaatctcaacattttgggaggccaaagcaggaggattgcttgaggccaggaatttgagaccagtccagacaacaaagcaagacccctatttctacaaaaaaaattaagtcccggtgtggtagctcatgcccaaaatcccagctctatgggaggccaaggcgggcagatcacctgaggtcaggagtttgagaccagcctggccaacatggtgaaaccccgtctctactgaaaatacaaaaattagctgggcatggtggctcacgcctgttggtcaactactcaggaggctaaggcaggagaattgcttgaacttgggaggcggagcttgcagtgagccgagatcacgccactgcactccagcctgggcaacagagcgagactctgtctcaaaaaaaaaaaaagattgaaactgaaaatcatagtaggccaggcgcggtggctcatgcctgtaatcccaacactttgggaggccgaggcgggcggatcacctgaggtcaggagttcaagaccagcctggccaacatggtgaaaccctgtctctaataaaaatacaaaaattagctgggcatggtggcaggcatctgtaatcccagctactggggaggctgaggcaggagaattacttgaacctgggaggcagaggttgcagtgaaccaagatcgtgccattgcactccagcctgggtgacaagagtgaaactctgtctcaaaaaaaaaaaaaaaaaaaatcatggcaaaaaaggactctgtattacaggccctaaatccattttcctttgactgtcagtacagaggacttaagtcacttatccaaggatgagcagcctaatatgtctctgtgagaacctgaatcctgattcctgatttattcctcatttattcaacataagagtgcttactgggccaggtgcagtggcttacgcctgtaatcccagcactttgggaggccaaggcgggtggatcacgaggttaggagatcgagaccatcctggctaacacggtgaaaccccgtctctactaaaaatacacaaaattagccaggcgtggtggtaggcacctgtagtcccagctactcgggaggctgaggcaggagaatggtgtgaacccgggaggcagaggctgcagtgagctgagatggcgccactgcactccagcctgggtgacagagcaagattctgtctcaaaaaaaaaaaaaaaaagtgcttactatgtactgggtactggtgaagttactggaatacattcagcagggaaccaaaaatacaaaaatggtctttgcactcctgtagcttacattctacttcaggaagacagaaaataaacatctgaacaagtcaaaagaaagttatgttaggttctgcaggtgctatggagggaaaaaaaaaaagcagggaaaggcaggtagggaatctgttgatagtgtgggggaaatgctattttaaataggacagtcagggaagaagtctttgataaaattcagttgatcagagatcttagggggatgaagaagcaagttacacaagacatttgtgggaagaatattccaggctaaagaaacagcaggtgcaaaggccagaggcaggtatgtgcttggtatgttaggaacagcatccaggaggtcagcatagctggagaggaaagagcgatatgagaggtaaggaggcggtaacctcagagaggcagggttaaggggtgtttatcatgtaggatctcaaatgccagtgtaatcactttggctttttctttttcttttttctttttgagactgaattttgctcttgttgcccaggacggagtgcaatggcgctatctctgttcactgcaacctccacctcctgggttcaagtgattcttctgcctcagccacccaagtagctaggattacaggcatgcgccatcatgcccggctaatattctatttttagtatagatgggttttcaccatgttggtcaggctggtctcaaactcctgacttcaggtgatccgcccgcactttggctttttctataagaaggaagccactggaaggttttttgttttttggcgttttgttttgttttgttttgtttgagacagagtctcactcttgttacccaggctagagtgcaatggcgcgatctcggctcactgcaacctccacctcctgggttcaagcgattctcctacctcagcctcccaggtagctgggattacaggtgcccaccaccatgctaatttttttgtatttttagtagagatggggtttcatcatgttggccaggccggtctcgaactcctgacctcaggtgatccacctgcctcggcctccaaaagtgctgggatgagaggtatgagccaccatgcccggctgccactggaaggttttgagccaaggaaacacatgatttgacgtccatttttaaagcaccgttctggctgctgttttgagaacaaactgtaggatgggggagaaaagtggagaaggcaagagcagaagctctcttgctgtgcttcatcctgttcacttatctgtctttaaaagtttgtttatatataacttaactggtttttcctggttgaaacaggatccagaggtcattatgtggtatgtttcatccatcagaaatgagaacagcaaacagactagcgttcttcctatcctatttggagaattcttttttctttcccttgataattatataaacataagacattaacacccatatcaatggtctgtattatggagaggcaagatgtttttgcaagatcgtcattcccatctcctgaaacaggattccttaagtctagatctggagtctccccatgctctagagaccctagccatgtgccagaatctgacaggagctggtagcagagtacctcagcccttaggtgtgaacttcaccacagcaggttcatgtcagctcatctaaggaatggagtgggaaggctcctcctagtttccagtgtatgtccaggtagagtttatcaggtttaaaaagttacaggatcctgatttgagctggcagggttaaatatatgcctttccataggtccagttcacctatacatttagatggtttggtttagctttacttaaagtcaaaggaatctctgtgtttgtgtttttgcaagaaactggtaatggcttgcctagtttcttctctagtttcttagggcaaaggaatgagttttgccaaaattttatctaggaaaaatggagtagttttctaagtcttacaggacactgtcaaaatatggaaatctattttattgccttagggaattctttttttttttttttcctttttctctaggtaaaggagatcttcaggaagtcacctttcctggtaccaaagggcagtgttagcatcatggatggatccgacgaaggtgggagaggtgttgatatgcgttccagggggagaggggcaggatcagtgaaagatctaactaaaggaactggggccaggaataaacagaaggaatgagatagcaggaaatagaagacagggagaagggaacatgtgctctagacatggaatttagagaggaaaaaaaaaaaacaaggttggggccaggaaagagaaaaaatgctctgggatctaatccttgtctttctttctttttaggcatattagcttgggttactgtgaattttctgacaggtaatacatcctcaagtttatctttagagcttaactagcttttacatgcatagtcagaggagtaaaagccttttctttcattctgtattgtttcttcttctttaaaaaaggaaaagaggctgggtgtggcagttcatgcctgttaattccagcgctttgggaggctgagttgggcagatcacttgaggccaggagttcaagaccagcctggccaacatggcgaaactccgtctctaccaaaaatacaaaaatagctgggcatggtggtgtgtacctgtagtcccagctactcaggaggctggagaatcacttgaacccaggaggcagaggttgcagtgagctgagagccgagattgcgccactgcactccaggctggatgatagagcaagactctgtctccaaaaaggccttccaaaaaaaaaaaaaacacctgccttgaaggcctctgctgcaacaagagtccttccgagttgacattcacctgcagccttggggctggggagcagtggagtatgtatggaataccttcagtgtatgataagagcaagagagacaagtgttgggctgcccaggatgtcgaggctatttagagctggctctcatttgacaggtcagctgcatggccacagacaggagactgtggggaccttggacctagggggagcctccacccaaatcacgttcctgccccagtttgaggtgagtcatttaatgaagatctggttagaagtgcacttggcaggcgtatcatggtgccaagaaagaggcgccccattttcagccagcagctctaccacgcttaggcagagtcaagtcaattaataactaggtgaatgttcccttgccatctcactgttcagaatcccttcgtttcctcaagcctagtgagattagccccttaatctgtcttcatctctgattttttgctgggagggacgggtggtggtgtgaacatcttcaggtaattacagatcctgaatagtctttttgctttttctgatttgcagaaaactctggaacaaactcctaggggctacctcacttcctttgagatgtttaacagcacttataagctctatacacataggtgaggacggggacagggaagaagaatatttcatgttgtatgattctcctaactttccaaagcattctcaaatctgttattgtatctgattagcaaaaacaaagtctgtgccaattccctaaggcctatcaactgaaacccggtccacttacaaagccggaggagcctaagaggcttctccattcttggcctcaaaagcattaatatatgacttaagagtcaaaagttttcggctgggtgcagtggcttcatgcctgtaatccctgcactttgggaggccgaggtgggtgggtcacctgaggtcaggcgtttgagaccagcctggcaaacatggtgaaaccccgtctctactaaaatacaaaaattagctggatatgacagcgcacacctgtaatcctagctattcaggaggctgaggcaggagaatcatttgaaccctggaggcggagattgcagtgagccgagatcacaccactgcacttcagccggagcgacagagcaagactcagtctcaaaaaaaaaaaaaaaaaaagaatcaaaagctttctgtagggagaggacacttcaagaaggctcaggcaaagctccttgccagctcctttgagctggccttcagaggttcagaatccagcctggaatgtgatcccagttggggctaggagctaagctaaagagagcttttctgggaatggttcctagtgtgggaccctaggaattgtcactgtctctggcctttgaatgataactgtggggaattcttactgcatagccttgatccaaactgtgcagaaattaccccttgttgaccacaggagatgaatatgtcacagacagaacaaggttttcatctttccagagggacacaggaacaatgttacttttgaaggaggtagctttaggctagagaacttcaggaccagcatgaaattagtcaatcctgtattttacagttacctgggatttggattgaaagctgcaagactagcaaccctgggagccctggagacagaaggtttgtctgggtacctgtgctggggggggatggtgagggtgacacagatactccgcttgcttcttcccttccttgatagccattctatgaaggaaaagattatgttgaattgggaggcaaatgttgtataatggacctaataatggcaaactccttttctagtttataagttcagaagttttgatgtatattattagccatttttagaatgaggtctacttgttcaggggtaacagcctatgtctaggcagctgaagtgtctgcagaaatcccaggctttacgaatacattcagcaggagcttgctcaagccctgagctttacattggaggcacaggaagcagagtctgttctacatgcaggtggaacaacagagtaactccattgatctcttcacaggtcaggcagaactgggttcagtcccagtgttgtgatatgaggcaagtaacctatctgtgcccctttcctcacattaaatgagaatttgcatttaaggcactttgtacagtaatctgttattgggatgacatctattttgcatttcagagtatacaaaacatcttcaagtatatttaattgaagcctctcagcaaccagtgaggaaggtagcatagcatttctttcctgtttttataaaggtggaaagttgctgtattgaaggttttggatctctttgagatgtgatgaaagccatggacccctctgacaaaagcacatatgcatgaaaatttgcttctggtttcagggggttcaccaaccccacaaagcctatctttgaaccctgagttaaggattcctgtcacaggatgttgtcatggaattaatttcataggattttaaggcccagcccccatggtgattcttttccacctcactggcttcttgcttgccttcctccctctctctcacttacttacctcttaccttgtgccctggattctttcagggactgatgggcacactttccggagtgcctgtttaccgagatggttggaagcagagtggatctttgggggtgtgaaataccagtatggtggcaaccaagaaggcaagtgatgttttttcactggttaaagttacgtttacaatggaagctctggaaaagtcccatgggaaactttttccagaactcaagagaagcttatcttgttgcagggacttattccaaagatcttggcatgcctccaaggactaatgtgaagtgacagtgaacaaagcagctgtcattctgcatcagccaagtgtcatggacccattagatacctgcccttagccaagtgctgtggtgcacatctattgtcctagctactccaaaggttgaggcaagaggatcacttgagcccatgagttcaaggctatagtgcgcaatgccactgcactccagcctgggcaacagggagaccctacctcttacaaattaattaagaagcatattctaagcctaggtctaatgcagcagtgtgaaagcctgtttagttaatggttagctatttaaattatagtaaaacttaaaaccaagacaagaatgattcatcttcttataaaaggtatatacctgaatatcaaggaatgaacctgaattcccagtgaaggaagcaggcgagccctttagctacttgcttacaaatgctatggaatgtaatgctaggcagcagcacaaggttggccatgatctggtgaatacagattaggcaggagagcggccatggagaaacagactggtgaggctgcagacgtttgctcatctttgttttgacgcctcttgtcccaagcctcagccttctcctgctttccttgaccttcctgctgttccctcattgtctccagcagcctgcctcagagagtgtccccttcccccagcgtcgttctcaccttacccctgtgcacctttgcctggcaggggaggtgggctttgagccctgctatgccgaagtgctgagggtggtacgaggaaaacttcaccagccagaggaggtccagagaggttccttctatgctttctcttactattatgaccgagctgttgacacagacatgattggtgagttcaccccaggtgtcagtccagagaggaaggtggatagggctgtggtggggaaggtcaaggagaaagagcacttgaggtgctttgtcggggtgattacccacctcttttctagtcactcgaacaaaagggtggaaatgacttagagtcttttggaggtgagagatgaccaaaacaactatatgaggtctttttttttttaacatgtttattgaggtataattggcatacaataagtgcacatttaaagtatacaatttaagttttgtcatgtatacacccatgaatccatcagcacattgaagataataaacatattcaccacaaaaagtttcctcctgtctctttataacttttcttcttatcacaaaagcagtgtttttgcctaactgtgaaagtatatgtacctgatctgtcatggcctgagagagatgaattaatttcctattattgtgggggttttgttgttgttgttgttttggttttttgtttgtttgtttgttttttgagacagagtctcactctgttacccaggctggagtgcaatggcatgatctaggctcactgcaacctctgcctcccgggttcaaccgattctcctgccccagtctcctgagtagctgggattacaggtgcctgccaccacacccggctaattttttttttaatagagacgaggtttcaccatgttggtcaggctggtcttgaactcctgacctcgttatctgccttcctcggcctcccaaagtgctgggattacaggcatgagccaccacacccggcctattgtgttttatgggtctgttttttccattgtggttaaatatacataacatggaatagattgtaaataagtaaattaggttgcatagattacattatgtacatgtgtatataatgaatgaatgaatgaatttccttatgcttccttgaaggcgttttgatatcagataatcttctgttttatttcagattatgaaaaggggggtattttaaaagttgaagattttgaaagaaaagccagggaaggtaagtgtcaggggaagcccttgaaggtaagcctgtgagactgcctgcctactctagtgacctaaagtgacctaaagcacctcagtcagctcagaaggcctatcagaaggctagtttcctttctgagtcttccagtctttgctaaaagttaaaagcattgggtggtagccaggcatggtggcacgcatctgtagtcccagctactcagggcgggaggattgcttgaggccagaaattcaaggttatagtgcactataatcacacctgtgaacagtcactgcattgcagcttaggcaacatagtgagacctctgtctctaaaaaaataaattttttttcagctttatgcagcatagaattatgggcaagaatatgggaatacaagaggttttaggaggccgggcacggtggctcacgcctgtaatcccagcattttgggaggccaaggtgggcggatcacctgaggtcaggagttcaagacagcctggccaacatggtgaaaccccatctctactaaaaatacaaaaattagccaaggaaggtggcaggcgcctgtaatcccagctactcgggaggctgaggtaggagaatcgcttgaacctgggaggcagaggttgtagtgagccaaggttgtgccactgcactccagcctgagcaacagagtgagactccacctcaaaaaaaaaaaaacaaagaggctttagggctttagggaaatggtgaagaccttttttttccttctacatttcttgctttcttttttaaattgaaatagtgttatcagtgttaatgaaacactaagcatcaaaagacatggtaaatagccacagaggcttccttgagaggatcaaaactaccaagagagctaggcacagtggttcgacctgtagtctcagctacttgggaggctgaggcaggaggatcgtgtgaacccaggagcttgaggctgcagggagctgtgatcatgccactgcactccaccctgggtgacagcatgagaccttgtctctaaaaaaaaaaattaataaaaagtttttaaaaattaaaaaataaaatacaaatgatcttatcgagtagcccacagtagggttaaatgatatttccctgtcttctgggcctcaccattaataatagataagggatttagaactaagcccccacaataggtcatagaaacttagcaaataaactagagcccatgtaaatgtgaatagataatcataccagagatgtgcaagttcttcagaagctgcggtcttacagaggcagtcagtgcagtctagtctctgagatgcctaagcattaaccaaagggagacttctgctttgcttattcttcttctccccctaccttttttttttgagacagagtcttgctctgtcacccaggctggagtgcagtggtgagatctcggctcactgcaacctctgccttccaggttcaagcgattctcctgcctcagcctcccgagtagctgggattacagcggtacaccaccacgccctgctaatttttgtatttttagtagagatggggtttcaccacgttggccaggctgatctcaaactcctgacctcaggtgatccacccgcctcagcctcccaaagtgctaggattacaggcgtgagccaccgcgcctggcccctattccacttctttctaagagaaaatcctacacctctcagttagttgcaaacttgagctccactgtttactctctctttcagtgtgtgataacttggaaaacttcacctcaggcagtcctttcctgtgcatggatctcagctacatcacagccctgttaaaggatggctttggctttgcagacagcacagtcttacaggtaagagacaggacaccagagtctcataacagccctcttttgtgggggttgagaaggagtaagagcttgttcagtaatcagagtagctagaagtgaaattatgaggtatttttgtttgggctatggacaaggtactgtgctgggcaccatgaatgtgggaaattatctcaatgcaatggtagcctccgagtgtattaccaggcaagctatcgcacaggtcacagaacagaaagactagcagcccaaattaagatgccaagtcacatggtttatttatttatttatttatttattattatttttttgagatggagtctcgctcttgtttcctgggctggagtgcaatggcatgatctcagctcactgcaaccttcgcctcctgggttcaagcgattcttctgcctcagcctcccaagtagctgggattacaggcatgcgccaccactcctggctaatttttttgtatttttattggagatggggtttcactatgttggccaggctggtctcgaactcctgagaactcctgacctcaggtgatccgcccacctcgaactcccaagtgctgggattacaggcgtgagccactgcacccggcccacatggtttattaaatcagtttagaactcagggtgagaagcaaggggaaagagttggagaggtgaacacagaagacacggtgcaagcaggatgcaagtgccacactctctgaatcttgggttccatttgtcctaggtttatatgtcctgcctgtctctgctgctaatagagtggttacacatactagagctgaagttcggtcatgggagcacaaagacaaaaggtgcctgaggccaccacacaaacttgccctatttggagaggccccaggggcacacacacatggccatttgcattagctcagtcattagcctataagatgggttttctttggcagaggacatgagagaccaagagggtgtcaccagtgagtggcttatttaaggcctcatgaacactgaatgcctcatgcatatgtaatgtgtcatatatatttcatgtgtgcctcgtatatttaatgcctcttgaatcttaggtctttctttgtcctcctgtctctctccatctgtttcagtacctgcaggctctactttatctgtagtaagttatttatccccagttttgggcacagtgtctaggctctattacatcaggtcaacacagaacaatcaactggtttatagacttttttggtggtggtagcatctttatccaacaaaaacttatgtagaatatcagtaatacagccgggcctgatggctcacgcctgtaatcctaacactttgggaggctgaggcgggcggatcacctgaggtcaggagttcgagaccagcctagccaacatggtgaaaccccgtctctactaaaaatacaaaaattagccgggcgtggtggcaggtgcctgtaatcccagctacttgggaggctgaggcaggagaatcacttgaacctgggaggcagaggttccaatgaggagagatcataccattgcactccagccttggcaacaaagagcgaaactccgtctcaaaaaaaaaaaaaaagagtatcagtaatataaaactggtaaaagtggaactattctggttgaagcagagattgggggcctgaaactcctctatcatttggcctccctttttccttcgaagcatttctaagaaacccctaaaattctgaagaaaacaaattgataaaccgataaacactaatctaatcctcttcttatatagttgaggaatttgggtctaaagttttgcccaaggtcactaagctaattgagatatgtactggcttagaatgtcttaagttccctgtttgattatttttttcttttctttttcttttgagaccaagtttcgctcttgttgcccaggctggagtgcaatggtgcaatctcagctcactgcaacctccacctcccgggttcaactgattctcctgcctcagcctccgaagtagctgggattacaggcatgcgccaccatgcctggctaattttgtatttttagtagacacggggtttcaccatgttggccaggctattctcaaacttctgatctcaggtgatccacccgcctcagcctcccaaagtgctagaattataggcatgagccaccactcctggccttttttgttcgtttctttttttttcttttttttttttttttttgagacagggtcttgctctgtcacccatgctggagtgcagtggcatgatctcagttcactgcaacctctgcctcccgggttcaagtgaccctcccacctcagccctctgagtagctgggattacaggtgtgtgccaccactcttgtctaatttttttgtagagacggggttttgccatgttgcccaggctggtcttgaactcctggcctcaagcaatccacctgccttggcctcccaaagtgccaggagtacaggcatgagccactgcgcctggccccatgtttggttattattagtgcttaggaagaggcacttgcttacatagtaggagttgagaagcttggtttgttctttcctacccctagatctattctcacctcctgaccatgctctttctgccacatctattatcattacaagttgccttatctgaaattagtgaatcagaaaataaagcaggggatactttgtgtagtttcaacgttagggaaagttcagaatactgtctgtctaaactatctctctagaaggcctgatgggccacaacctgggccagaagcattcagttcagatatgagaatggtgggtgtaggggcaatggccaatgggccatggccggaaggaaattgttacagagtagtgggaagcctgcaaagactggcttctgtccgttttgccttggtttgcccatgtggatattctttgccaatattttctgcccaagagctgtgcttgctagagttggaaactggatgaaaaggtgaagactttttttcttctcaacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacatttccagggagaaccatatttaatgtccctcatgctctctttttgaatccaagtgctcagagctcttgactgtgaattatttaccccaaattcattatcttgcacttttttttgagatggagtcttgctctgttgctcaggctagagtggagtggcgcaatctcagctcactgcaacctccgcccccaggttcaagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaacataatcatccctgcttctcatctgccctgcagtgctcttggacctggaagatctccctgtggtctggcccctttgccttggttgttaacctccagcttctttgcaggagtgtatttccccaaaacttgtggctttcacagtagactccgtttccatcctctctctcacaaaggatgttaagtatgcctggccctcacacagtccatgggaaaccttatttttaacattactccattgagtcaataaatatttaccatctgctgtgtgcaagttactaggcaaatttctgtatccttgtccctaaaattcttgtctttaaattcattgtggaatttctttagacttcacactgacttttattactaaggtcacctttataccaactgccttcctcaaaatgcttataatgaaataacagaatcttgagttggaaacagcccaaagaaataatccaatgttgtactcagtgcagaattccctagaatttctaacaggttgtcattcagcttctgctaagccatgttcaaacagcttattccatttggaactgcactgatattaaaaaaaattccttatattgagctgaaatctacctatcttctaagtggtcttagttctgctctaatctctccttccaaaatctttggatcttttgaaaaaagttcctcccaagttcttttataagtgacatgacttttagaccccttcccatctttgtcaacaaaagtagggtgccagaccagtcacagaacactaaatgtcatccatgtttccttcagtagaaaccagcagttttaaaagaggtaagctgtgttcactaaagactgttccagcttgacaaatgcagagatataagtctctggtctttaatcactgtgggggccattttgtaaaacacacatactgtccagcagactcctttggtcatcccaaatacctccgaactcca

SEQ ID NO: 11922 - DNA, 6448 bp, Human
ctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgacgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtc

SEQ ID NO: 11923 - DNA, 8246 bp, Human
  misc_feature (1)...(8246): n = A,T,C or G
nnnnnnnnnnnnnnnnnnnnnnnnnnnnnnntcttgctctgttgcccaggctggagtgcagtggcgtgatcttggctcactgcaacctccaccctcctgggttcaagcaattctcctgcctcagccttccaagtagctgggattacaggcatgcaccactacacgcggctaatttttgtatttttagtagagatggggtttcatcatgttggccaggctggtcttgaactcctgacctcaagtgttccacatgccttggcctcccaaagtgctgagattacaggtgtgagccagttcacctgtcaaaagaaagaaaatttttaaaaagtctctcggagatgtctttcctgtttggtgccacctgaatagtggcaaacctttccattatgtatcaggtcaccaccgcatctgctagaagcccccctcgtccagggtgggatgacctgctcctataaagccaaacttaccgggagctcagtctcttggatttttaaaatatgggtgtctcttttccccggttcctgatgacattgtgtcccaaggtgccaagggggcctttccctcagtccagaggggttttctgaccacctgctaagttccagacacgggccgactgtgcatgacaggcccacggttctaggcccaaatactcagttgcctttgccccatatgctgttattgtccacatcacttgctgccaaaacccaggactgagctgtggagggaacagctggaatgcaccttggaggacgttgttgacacgccgctcagtcgccgttcgtgccctggtgtttgtcttgcagacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttgaagtgtgctcgtggtgcagcgccggcgggggccaggagggggagctgcaacccaggctgtgggctgcagcctctcagggcttctggtgaattctgggcctggggcctcagggtagggcaccaggggcccaggggctggggtggggggcccaggatgcaggggtctgcccctggccaggctctgccttcagaggaggctgagcgtcgtcacacgggccgggccgaggccctgggccctgaccgtgcagcctaagacaggactgtggctttaagaccctcctgacccctgacctctgcccccagtggccctggcccctgggcagcccttcctggccgccatgtgtacccagagcctgggactggctgggctgggcagtgacccaggtgggaaagggtggtcttgccctctaaggcccggcacaagtgagaggcctgggggtccatgttgggctgggctgggcgaggggtggtctctgacttcctgggggttctggctgggatgggcagggggctgggtgggagagtgtgggccctgccctccgaggccgggcatgggcgagaagcctgggggtcctggctgaactgggctgggtgaagggggccccctgacccccttggggtccgggctgggctgggtgaggggcggtttccgacccccagccaggttcccaggcaggatgagctggggttggggtggctaggccgtgggccttgggagctgggcagtctgggctgggctgggctgggcagggcgccacatggaagctggaggagcaacgggagcgctgggcgtggggtgcaaattgcccagtgccttctgtttcccaggcagctctgtggccatggatatgttccagaaggtagagaagatcggagagggcacctatggggtggtgtacaaggccaagaacagggagacagggcagctggtggccctgaagaagatcagactggatttgtgagtgctgggacggcccctgagttacccaccctgggccatcacaacctgggcgctccctgatccgttccctctttcctggagtccacgtttaactcctctgggtgctgcccagcagcccttacctgtcctctccccagttcactgccttctgaccagcctttgccggggccctgactgtggagtttggtggatgacgtgccaaggagcacaggtctccattgccggggccctggtcattctgtggggttaaggagaagccgatccccctggctggaagtgcccttcttggcccaagtctctgcccacggctgtgcccttgtttcttgcagggagatggagggggtcccaagcactgccatcagggagatctcgctgctcaaggaactgaagcaccccaacatcgtccggtgagttggggattgaggtggggaagctgggatggcgaaggtagcatcctgactgccatctccctgtcagactgctggacgtggtgcacaacgagaggaagctctatctggtgtttgagttcctcagccaggacctgaagaagtacatggactccaccccaggctcagagctccccctgcacctcatcaaggtagggaaggaagggcagggaaggagaggtgacaccccatccctgccatccctgtccacgcagcacctccgctcagctggctgcacctcgcgctcgtttctccagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtattgtgagacaaagaggagagaggggcagcaggaggagtgtcacccatgcactcagccaccctgagtgatactgtttctttgccctgcaggtggtgacactgtggtatcgcgcccccgagattctcttgggcagcaagttctataccacagctgtggatatctggagcattggttgcatctttgcagagatggtagagagaggggcacacatggccacagggtgccacaggcagggtcctactggggttgggtggggtccactgatgctcccattcgaggcggattaaagagtgtttggggctggacatggctcacgcccgtaatcccagcactttgggaggctgagatgggaggatggcttgagcccaggagtttgagaccagcctgggcaacgtaacaaatccccagctcttaaaaaactacaaaaattagctgggtgtggtggtgcatgcttgtagtcccagctacttgggaggttgaggcaggaggattgcttgagcctgtggttgaggctgcagtgagctgtgatcgcacgactgcactctagcctgggtgacagagcaagactccgtctctattttttaaaaaaaggtgtttggtactggctaaaggactgaggaaggtagctttattccaaaagaggccagaattctttgcacagtcatggaaaagatatcttgacaggcctctccctgggtctggccacttatctggtattggattctgtataacaaagtggcggaccccacaccttctcttcttccccatttcaggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatggtaggtgcatgtgggctccagctgctgctccgactacagtttcccctcatcagccagcctcttacataaccctggcactttctgagtccaaggccagggtctctttcctgacctttgtacacaactggcttgggtatactgattgttcaacccggaagcctcccccaggataagtgcagtatttatcttccctgtgaaagtggcgctcattgagttagctctgtctttatgctgtgctacacgccctttttccctagttgtcttgtgtgtttggttattctactttgtggacattactgctccatctaagctgtatgcctccccaggctggggccataccttcttttcttttcttttttttgagatggagttttgctcttgttgcccgggctggagtgcaatggcgtgatctcagctcactgcaacttctgcctcctgggttcaagtcattctcctgcctcagcctcccgagtagctgggactacaggtgcctgccaccacgcccagctaatttttgtatttttttttttagtagagacagggtttcaccatgttggccagactggtcttgaactcctcaggtgatctgcccacctcggcttcccaaagtgctgggattacaggcatgagccactgtgcccggctggggcctctcgttctactgcctggctgttcccctgtgactcctacagtggtcagtcttcagaacaggctgttccctactgcctgggcccatgccacagttctcactcacccctcctgttggtgtcttgagctgacccaggccggactgcccaggaagtctctggcagaaccgtctgtttttttttttttttttttttttttgagacagggtctcagtctgtcactcaggctggcgtgcagtggtgtgaccatgacttactgcagccttgacctcccaggcacaagcgatcctcccatctcagcctcctgagtagctgggaccacaggtatacgccactatgcctggctaccttttgtattttttttgtagagacagcatttcaccacgttgcccaggctggtctcgaactcctgggctcaattgatcctcccacctcagcttcctgagtagctgagactataggggtgcaccaccatgcccagctaattttatttttgtagaaatggggtctcactatgttgctcagactggtctcgaactcctgggctcaagcgatcctcctaccttggcctctcaaagtgctggggggatcacaggtgtgagccactgcgcccgtccactgtccattcttgcccacaaagtcttggagccacatttctctccttaatctggtgttgaatgagaggaaggtgggtcagtattttcatcttcaggctgtgtgtccagctctccagaagtctctgtgtgttgtgtacccgcccaatggcagcaggacggcacagactccagccaaggccccgagccctccagctgggctactccaccacagggggtccttccacatcctgtctgggtttagggactctagggcagagggctggacaggtttggcctcttggagtgtcagtccctgagcccccactcagtgttcctccctggacagcttcagtcccctgcttcctgatacgtggggttctgtgctcttcccgactagaagcaggctgggacctgggaccctccccgagaaggggggtgactcagcttcagtggcctgaggagacctgggtgactcgttaggactgtccagattccaggagtgtccggaactggctggagagctgggaggtcatggcttcatgcggttctgggtttgagggcagccaatttggggcccaggcccttgatctgggacctgggaggggaatttctcaccccaccctggctgcacccagaccacatcttcttccttctttcttcctagcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaagaaataaacgtggtatgttcctgagttttctgattgttctgctcacaggggacacctgggcttcctgacaaggggaacattgacacagggctggagacagctctggcccaaactgagacagtggggaaatgggcaaggagtaggtggggagacaggggctagtccatgatttttttttttttttttttttttgagacagagtctcactctgtcacccaggctagagtgcagtgacataatctcagctcactgcaacctctgcctcatgggttcaagcagttctcctgcctcagtctcccgagtagctgggattacaggcatatgccaccaagcccccatttttttttttttttttgagatggagtctcgctgtctcaggtctaccctgttgcccagggtagagtgcagtggcatgatctctgctcactggaacgtccgcctcccaggttcaagtgattctcctgcctcagcctcctgagtagcgggaattttaggtgtgcaccaccacacccagctaatttttgtatttttagtagagtcggggtttcaccgtgttcgtcaggctggtctcgaactcctgacctcggatccacccgccttggcccccctaaatgctggtattacaggtgtgagccactgtgcccggcctcctttagtgattttaaaccataatctctttccatgacctgccactgcatccctgccccgcactcaaggaggcacagccctccgaggatgcctgtttcccaggcaggcaaattgagcacgtccgcccaggcaaggacttgagcaacgctgtccttgcactcatcccccagacacatgggtcctgcactctcaaatgtgaatgaatgggacaccacatggcacagggagacagaattcgtttattgggatcactgggtggaggtggaggaagaactgagtggctgctgtcctggtctggggatggatcaggcaccaaggttaggggagggagcccatcaccatgttagtaaaataataaaacagtggttggacagagggaagacccactgcctgggatgaggctgctctgaggcaagaggtgtacgtatcctacctggcccaacacacgcacttccccactggctccttggcccgtgtcagcgaagggagcgcgggacggtgggggaggcggagcggtagcagcggtacccctccagtgccgctggcaggagcagcaggccgctcagggggtctttgcggcagcggcccatggcctccttgtagctcagccgttccttggagatggggtctgtcaaatccttctcgtagctggactcgtcctgcaggagctgggccagctcttcactgatcatcccggagaggagggcctgctggatggggatgcggcctgtcctcttggggtcgatgagccccccggtcaggtgctgcacctgcaggtgtgggagcacgctctcccggggcatccagcccttctggacggcctcgcccaccgagagcctcttcttggtgacggggtcctcgatgccggtgaaggccttctgggcgttaagcagcctctgtgtggaggtgttctcgatcaggcccctctccatcgccttgtgcacagagtagcg

SEQ ID NO: 11924 - DNA, 11948 bp, Human
cctgggctcctccaacactgcccttgtgagacctgagggctaaggggaactgaccctaacatgaagttcatgctgcttgctgtaccatggataataaagtcctttgtctctgacctaggagtctcgtgtcttctgccaacatccacgaaactgtagttatgtcattaatttgcaagtagcataaaatctcagatctttcatcgttatttacaggcaagtggatgtcatatataaaggccctgtggcgggagtcagtagagcaaatataaggatttaaaagaagacatataagcatgagtggaatatagggagggtgggggtcatggcctgagataaggctgggaggtggtgagcctatgagacccttggccaatcctgctaacacaggcctgggggtatcttggccatttgttgttacaaagctgccttcaggcagagcatgtggaattaataaactgagcttgagggagcataggacaacaaggcttgggccaatctaagcctatgaaataatttttaacaaagggagatagtgaaaataggaggtgttttcttaacatcctgtgctctgtgatgaaaaattttgcatctgcatgccacttcataatatcactattagaaattagaagtcctcctctcagtgccccaaatgaaccagaagaagctatcattgactgtcattgctgtcaatcatcttgggtacaaaaggaggcagtcatcttaaaaaggaaaagtgatgcctctttagtattcaccgagcgtgattctggacaagccactttttgtccacctctcttacaatgaagggaaggcactggctgagttttaaaggaagagaaagggagagagggagagaagagggagagagcagagagacctcaccgagagagctgcaaaaccagcctggaaaaattagagtattacctaacattagtgaaaaataaaggtactttcttgagaagcccttggacccattctgcctcttggagttctgaacttttcactcactgcctattaattaatgttaagcctgcaaagaatggagttgtcctggatatttggccaaaaaaaaaatgtatccacaaacagggacgtaatcaggcagggagcctcgttaagaagttttgttcttgtcctaggagtgatgagagatcactgaaggatttagagaggggctgtatcatcaggcttgggttccaaagcctcactgagagagttggggagctgactgatgtcagatgctcgtgcagccgccccgtagggcctgtatttcctccatggtgcctcactgcagcaccgagcttgcaaaagatcctctctctttatgggaatttcaaaacagaagcaaaatagcaccggggcttaaagcattcttgggaatttccctgtctttccctctaaataatcagcatgtaaattgcaaaaaaaaaaaaaaaaaaaaaaaaaaagacacgggcccaaaagggagcgctcagtttcaggctctttgctttccttcctcccgaggctctctggcccttacccagcctgaagacagaaagtgtgagggggagggtaggaaggtaggtcaagcagggcaatgctgagcctgggaagaaaacaacagccttgtttagggcactgtggcttacgtaactaaattgtgcccagtttccacctggccaggggcctggagtgaatgctgaagatgcaaaggtagaggctgccagaaaagccaggaaattgctggcaagaaaggccagtggtggggtgcaggagtgggaggaaggctgggaaatgcggctgagtcacatctccggaagccccccatcatcaccctagtggctcttctgctggcaggtgcctcatgaagacctgacccaaagttttcaaaactctgcggtttctcaaccctcctctggtaatccatagtactcccccgcctccacttgccagcctcgtgattccttcattgacacatagctcagttcccataaaagggctggtttgccgcgtgggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggtatctgggctagccaaggttaatccatcagagttgtgggttttcaggcccagacagcccgcagagccatctgcctgctgggtgagggactaagggagtgggcagagggggaggagaagcagagccaggggagggactgaggctgcaaccaggaggtgggggtgggggaggtgggtctcagttgcttgggggagggagcagggcggaagggcaggatgcacttgcaggggtctcatcctggatttctcttcaggctttgtggtcctggtgctgctccagtgctgtgagtaatccctccacctccacttttaagtccagaggcgtggcgagggcacagggcaggtgtggaggaggtcttagctccaagggaacactttgccaggttcttctgtgcttccaatgacttcgaaatagtcacgtttgctaaactggagtgaggagtatatggatgtttattttgctatactctttggtatatgtgaaaattctcaaaataagaaactttaaaaggtcctggttcagtgaaggctttgactaacagcccctgggagccgctagtacagttgcccagtagctgcttggatgagtgatgcccacattgtttgcagcaggagaaacagaattagaggcgaggaaggatttcctggtccattgtgatattgtgccccagcttgggggacatgccgagggagcacaggactgccattccgggtgggttacaagttagaggcactctcaccaggaggcagagaaaggtgggccagagtccctcatggatgaaggacctcactgcaggtcactaaaggtgccagcctgaaagccagggccatctgtgacacaggctatcttgggccttcccctcccacaaagccactgcttccaggaagcctgctgtgctggcaccaagtcccatttcatccttattccccagctcctacccttcccccacacagtgcctgtagcgtattcatcccctgcattggatcttttctaagcattttcagaataggccttattttcaccagtcagggaactccccagaggcagggggacctgaaccagctcctttcatttaagaattctgactttgctcacaatctgcaccccactcctccctacccaaccccacaccccattggtgctcagctctgggctcagcctgaggtctcttgccgaatcctggcccgggccccatcccagacttctccttcaggctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggttgggccagggctggccaggagaggagggaccagctgggctggtcccagggcagggcaaccccacccaggaggaagggcgaggccccaccctgctcacctatgtttggagagttagaggggcttggcttaaatgggtggaggggatgactgtaggtgctgggcaatatttggggtgatgagagactgtagacggaagcgcagctgagcccctctgggagaggggaaccctctcctgcccctaacgtgctctccagggagcatggaaaatgagcaagactctactttgccatactctgtcttctccactggggaaaacaaaaatgggcagcagacctcagagtaactcccatgaagcctgtgacccctcagagatccaccactatgaatctctatgggattcccatgatgtcctatgggaggacatcagcggcctaacccagcctctcacccaaagcaggaaaccttctatggcctctcagacatggggccacccagtgtcatgacaatgtcattccactcctgccctccccacctccctgtgctccacaggaaccccaacctgaagactctcttgtctgtcggaggatggaactttgggtctcaaaggtaggagcctctccccaggggcaggacggcagaggatgatggcataggagtgaggagcttgggtctcccgcatccactgtatggatgttccaggggctccagactagataggtacaaggcctacctgtttgtcaagggcctgcctgatgtgtagcaaagaaagcagagcccagagagagagcaggacttgccaagagtcacacagcaagttaacagtggatctcccaattccctgccaatgctctatttactacctcacaggcccgaaaatatgggacttctggggctaccaccattagggctggaaagagagagatggaaaccaatggggacattgagaagtggggagaccctgggaggagtctttggattaggtggggttggagcagggcttgaaatgggggtggttatggccatcgttggcacccatgtgctgggtactctttctgtgtccagcaccctgtctccccatgatcccatgttgtcctcacaacagcaaggtgagctgttatatttgtccccattttacagatgatgaaactgagactcaggttataacctttcacagtggctggctagtaagtgatagagccagacttggaaacctggaatgcctggctctaaggcacatgcatgcctggaggcgacccctgtcccaatcatgccctcccagagctgtgtggcctcaggatcccagctctgcaggtcctggaaaccccaccagaggcccaaggcacctagcatatcagtgctgagcatgctacagggctgattttggtcctagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggtgctggtcaggtcagggacagggagggaggtgggcaggcatgagggaatggggtgggctagaagccggcgtcagctgctgtcctcctgaggacaggtaaagagggacttcagcctcagggcagtgtcctgggaccctgtgccctgaagatctcacatagcaaggaaggcttcttgtgaccatggtgggaggtgggaatggggttctaagaggtggaaggttgtgactgagcagagcacccacttataactacccacttagtgcattgcccattgcccacccttcaatcccatactgatgccacccatacccagcatgcactgtgtccagcagctctcagctctgcctgggggcagcctaagtatctccagttaccaggggcagaaggagagtctaaacaaattgttcacaataccagcagcaatcactttaactttgggatttcatgcaccagctagaacaaagcacagaccgaaaggcaaatgtctcccaaagtcatctgtgggccaataggggtcacccactgtccgatgctccctccaggacagggagtaattgagtgctgatgggtgtgcatgggtttggggagaagattagtcagttttttaggaaaaggatgggtgacttgaggatgggaccactgatgagccactttatcacttccactaggccccaggcaggttggggagtacagcaaatgggttgcgcagagacctagtccgccctcgatgagtctacctctcatgccacttgggaccctttctctcacctgcctgtctcccatctaggaaatgaaggccgaatttataaaggaagcccagccagggaaaaagcagctcctgctcagcgcagcactgtctgcggggaaggtcaccattgacagcagctatgacattgccaagatatcccagtgagtctcctgccccaggcagcctccccagaacctctgccaacactcctgtttccccgccacccccagccctagcactccatgtagactgaggacactgggcttccagtcccagttcttccaaagccttgatgtgtgaccttgagcaagtcacttccctgccctgtgcctcagtttccccatctgtcaaatgaggcataacaatccttgcctttcctttttcacctgggctgttggctgagcagttgagagagctgctatgaaagtattttggaaagggaagtggaaaaagctattcaaaccctccagctattgcagagtattttctccacaccaggcagagcagagtgctgggccctggagaggccacacagcagcctctttctagagtgctggggagtcctcaaggctctctcatacacacaggcctccccctttcctgttggccccacgcctcatcctcaccccacccctcatgcctgtgaggaacaaggaacagccaagcagcctcatctctcctgagagcagagccatgggtctcgggaaacccaggagtaaggaacaaagactcttcaaaatgacttcagagctttctttaggatcccagggaggtgtaaactcagtgcttaattaaatggattctttagagggtgggaaacaggtggatgtcaaccatttgccccacatacccgtattcatgcaatccacccccagtgggctcaccggtgcgggtgtgcaaaacctcctcccaccccagtcatcttaggttcaggtcatcctttggtcctgctctttccccgccaggctgtctgttgatgctacttttaatctgctttcactaagataagcctggcagaagtggtgggggtaaggtgggctgtaggccagctcccaaatgtgtgctgggcataacagaagacccattcttgactgaagtgcccttgtgggaccctgagcccgtgccctggagtggcacagggaggtgtgccagcaatggggaccgaggtcactggggactgctggggttcgggctagtggcctgtctggctgctgtctgcttccctcgttcacatcctgctggagccttaaataggagcccaaaagcttttctttcttacttttttttgagacaaaatctcactctgttgcccaggccggagtgcagtggcacaacctctgccgcctgggttcaagcgattctcctgcctcagcctcccgagtagctgggattacaggtgcctgccaccatgcctggctaattttcgtagttagagtagagacggggtttcaccatcttggccaggctggtcttgaactcctcacctcatgatccacctgcctcggcctcccaaagtgctgggattccaggtatgagccaccacgcccggcctaaagcttttctattaataatttcctgcctcaccctccatccccttcctcctcagacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtaggtttccccaaggccacacctcaggacaaagagaaagaaggaggccccgctcccagcagccagattcctgtcccttgcactgaggtctgggctgggctcacagagcacatgtgccctgtacacactctgggtcagggaacccagccctgctcctctgggcctcccctgccaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtgtgttggcgctttgctttggtctatctttgagcgcccactagacccactggactcacctcccccatctcttctgggttccttcctctgagccttgggacccctgagcttgcagagatgaggccgccatgtcctctgcctagccgcagagagccccagtgggaggccagcgtcctcagattcacctgccttggacttaacccaagcatggctgatggccttccaaatattaaagtcattgccatccagatttctaaattaaattccctgttgaaagaaacgttttctgtttcctgaaggctagcaggccctgggaaagaaggcttttcatcccaacactccctctcttctgatccacaggaaggtggtgggagctcatcacaggaccaggttagaaagccctgaaccctggaccctcagggccagcaggaaatgcagatgtcatctcatgcacccttcctgcctctcgggactggagtccctgcagagtgcttgagagatggccctccagcctcccagtgaggggcagccgattaccttggaagcaacccattccgtggctgggctgaaatctgtcaatagtcctagtgctgggcttagccctttgttctgttcacccctcccctaacactcatccctccacccattcagagatcaaagtacctctgctcaagctggcctgagataggaggtcgggaggatgtgatggggtgactcagaagaatagacagattttcagcctttatgaggtggagacgctctcatcaggcttctgttgaattcccagggccccaggaatgcctttatccaaaaaggctccagatactcaccccagaactaaagagaattgatttgtggattctctgatgtttggattatctgtgacttaggataatcacaaattggcctgatggtttgtgacgccggtttgaagtggagggaaggaggaaatatctgaaatctgaaccagctggagctgggcagatgctactgatcccaaggtcacagccctgctgaaggcgaagaaaacaaggactcggcaaggcgtggagtggggtgtggggagggggtacccggcatttcacctctggctggtggggccaagtattccctaatccctgccactgcccaccccaccacacaggcatctttgaaaccccagggctgcaagcccttgtgggcagccaactgccctcccctggggccacccttcccccagccggggacaggctctccagggctgactcagtgtcctgtggggttagtcacattcacttatagctgcagagtcagaggccaaggatggagatccagtctccaggacccactccctgcctggcaagacgtggagtcacctagcagagggcgagggcatccagggagggccagatccagaggctcccaggccctgcactgccactccccagcagagacagcagggttgagaggcagccacaccctggtgtccccagtcctcaggaaagggaagagcatgcatgctgctgagggccctgaataaatcacttttacttatttttaaattgtgagcacatcttacgtgctaaagagtgcataaatgtatttgtttaatttgaagaataactatgtagtaagaacctgtgtaaccaccacccaggtcaggaaaggaaacctcattagcacccctgcagccctcacgatcacagatatccctgttcctccacctagaggcaatcgccatcctaacttttgtactggcctcatcttcctttctggccttaccgcctacggatgtaccttgaagaagggagcctggtgttgactgcatttggatttaatgtagatgagacagatgagacgcaacatttctgtgtgccttgctcttctgctcatcactgggtctgtgagtagctgaagttgctcatttgaccccatattttgctttacagttgcataaacactccacagttatttatccatcccactgttgagggacagctgttttcccccacatttcaacaattacaaataacattgccatgaaccttcttctccatgtctcctggggcatgtgtgggtgttatatgagcggcacggctgggtcacggagtaggcacctcatccattttactaggcactagtaaaactctcac

SEQ ID NO: 11925 - DNA, 143155 bp, Human
taccttttaacttctctgtatctcttaaaatagaggaagtaatagtacctacttggttatcaggtggtgcggatgtaaaaatgtacttagcagagtaactgacataaaatcataataaatatcaacagttatttgtttaaaccaccatcatcgtgtggctggatcatgtcaacagtttcctgagtggtctcccattagattatgagcccgtgatggtcccaaaaggtgaaaagaagggagattggtccatactttcacccaaaagtggaagagaatgaagttggaaaagctttcggattgatgctatattttgaaaatagtattggttcatttttccttaaaatatatgcatttttcagagaaaggaatggaaaataaaacaaatataaagaagataacatttgtaatcagcacccagagggaaccactaataggtatatatactcctctggatttagagttttgtatctttttttttttcttatttcaaagcatttttctgtatcatatttttcaacaatatgatttaaaaggcacatcccaacatagaaataaatacatgttcattgtagaacactttgaaaaatacagaaaaatattaggaagaaaaataaaactctcactatcctgcaataaccacttttaacgttctgctgaatatccaagctttttttttttttttttcttttgagatgagtctggctttgttactcaggctggagtgcagtggcgagatctgggctcattgcaacctctacctcctgggatcaagccattctcctgcctcagccgcctgagtagccgggattataggcgtgtgccaccacccccagctaatttttgttttttcagtagagacagggtttcaccacattggccaggctggtctcaaactcccgacatcaggtgatccacccacctcagcctcctaaagggctgggattgcaggtgtaagccaccacgcctggcctatcctagccttttttttctatacatatatagtcatactgtatactgtattgtttggtgtcctttttttgcttaacactttatgaattttctgtcataaaatattctataacattatgcagctatctgatttaccataactgtttgcattctctcaccttatacctggctttctaatttcccctattcccctattttaataacagaggaaataataatacatgagtatgttatacaaaattttaatgtacttctgatcacttttttaagaatgaagttttaaaatactgaaacactttttgactcacagagttcataggcaaaatgtgagaaaaatcatcactttgctctccatccttccttacaccctgaaattaaccttagggacagctagttcatttaacatcatcaatcttgttctccagttccaggtcctggaatctagctcttagtgtccgaaagaaacttacttttgtgtaagcacacctattatatactaggcactttacctaatttatctggtttaaacttcacatgcccgagagagatactatcattgtcttcatttcacagataagaaggttgatgagacattaactgtctcagtcacattcagggtagggattcaaactcacatccaatgcctcctcaacctcttttacgtgcagcactatcctctagccccactgcccgtatataggcctgggctatatcaccattgtccgcccttgagcctggaaggaaaatgagctgaggggttttgttttttcagaaaggaacaggatatttcatcatctctatgtttacgtttttcagagaatttctgtgcgaggaaacaaatccattgtcagctttttaaaatatatccctttggagtagccacttaacatcctctgaggcccagatgggctagcttgccgggaccaaaggaaatctttgggtctggaaggcgacaagagatcacaggctttctaggtctaccgcgcaccccgatgacgtcacgcggcgacgttctctgacgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtagttgggggcaggaggggaagatgtgtttcggaattgagggtttagggggaccagaggccaggggtgtggctgatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtaagagacaacctcttccctgctccgtaatggaggagcatatcgctagaatcttgaccacctggggaaagaagaggcattccttactcttggaggaaggaaagagtaacctccagaattgacccgatgtaagagagggggaagcaaatgggggcaaatcttaacccagcatctttttttttttttctttttctgggctctgcagtaatggtctggtttgggaaaggctgtagattaagctgaaagtaaagaaactggaacgtcctgttatttccttatcatttgaatccaaatcatttgttcatgctgcttgttttcaagagtagtcttctattggaggggtggggtggggggggacaggcctttattgaactcacgcggatgcttcattaaacttttgacttttattttattttatttttgtatttttagtgacagggtcttactgtgtagcccagtctggtctcgaactcctgggcccaagcgatcctcccgcttcggcctcctaaagttttgtgattacaggcgtgagccagcgcgcccagccaaacttgacttttgagaagaaaaaatgttttgaaaactgccaaagacttatcataaccattgtggtttaaaagaaagtaaatgcattaagcttagaaaggcagaatgactaagaaagaaggtggtctcaatgagaatcaatttaaatgattagttaccttccttgtatacttcaattgcttagcctcagggtacacttacaaagtagtaatagaaagcagcagatgaaggaggtgcagctctataagaaaacgtgttaagacattccagtgatgactaagcgtgctggtaaggtgagaactgtttgcagtatcttagccgttgaaactttcaaggaagcagaaaggatgatgtataatgcaaacatcctcactaaaagctgggtggtaaaatcaatataaatctaatattctgactgtgtatgaagaaactcaaggaagtccagttctttcattctttctttccttaaaagatccatattttgaaatactaactttttaggcacaggtttgaacgaagctgagcaaggaatatattaaatagggcacgttctcctttctcttgtcctttctttccttctagccttaggttttccagagtttaatgttattttggttaagaattagatgtaaaacttttgaactcctttgcttcgttataatattaagaagctactttgtagtctgttatgtttaaatagaaatcacaggtgattttagcttttgtgtctcataatttcttatgagcaaggtaatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcagtttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggctttgcttatttctctggctcttctgaaggaacattttctccccccataggagcagcttgatttttgaggcacttcagcaaatattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccgcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtcttctgatttgtttttatttacactattttcatttttcttggagtttcttttggcttaaggcaagaaccagcttggcaccatgtttctctgccaatatggttagggaatattttgttactattgtttacaatatggttactagagtgatatcccttctctttagagcagcagggactcttaatttagaatctatcttataggcttctaaagatacttgaccctcctctcttccctgaaattttgtgggtgggtgcattattttctagttaagacaagaacacttaatgctcacagtgaacaggatagtaatatattccttgacattgaaattgttaggggagataatgaaatatgtgagctactgataaaggtatgacttaagacttaggttaatttattgtttaatagaatgtagtgaaaatgcctgttaagaatttactcatgcctgtaatcccagcactttgggaggccgaggtggatggataacttgatgtcaggagttccagaccagcctggctaacaaggaaaaaccctgtctctactaaaatacaaaaattagctgggcgtggtagtgggtgcctgtagtcccagctactctgaaggctaaggcaggagaatcacttgaacctgggaggcaaaggttggagtgagcccaaattgaaccactgcactggagcctgggccacagtgagattttgtctcaaaaaaaaaaaaaaaaaaaaaagaatttaatgggctgggcacggtgatcccaacatgtagtcccagctactcgggaggctgaggcaggaggattgcttgagcccagaaggcagatgttgcagtgagtcccagctgggactacaggcatgtgctaccatgcccggctaatttttgtatttttattagagacggagtttcgccacgttccccagactggtctcgatctcctgagctcaagccatccgcacgcctcgtcctcccaaagtgttgggattacaggcgtgagccaccgtgcctggccaaaaaaaatttaatatgtgtatgtataagaggcttttcagagaaattgggtgacaaattctaaggaggttttgttttaaaatcttaaacaagttttaaaggacatagcatagcatagtaaatatcctagacagattgtaatggatttgagctatagtccttctttgaggctcaagtaatcgtttctgtttactggtttttctgtttgtatatatacattcataaataacttcagatttattccaggtcttttatgtgaagaattcctttcttcatttgcccacttcacatttagtttacattatgaatggactaaatgattataacattctttgaatttttgctagaaacacattgtaaaaacattgcataaggcaagcttcagtataatttttaattataacaagtattaaaggagaaatttctatattctgtaatgatatttgtgagtcctagctcacttcttttaacaagatcattctgtgaatttctggtacaatctaaagagctattaggatcaagactataaatagtaattagctggttggaaagatagcaaatgagtctaatttccattaaactgtacaagtagcacgttttagagatcagatttgaaccagaagtttttcattattttatgtttatctggctcttttttcttttctttaattacattgatttgtttggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtctgaacggatgtctcagtcttttgccttgtttttaactataaactggcattatttgggaatactcttgggctaaatctggattgttggaagtaagaaagccacatttttttttaaatccaaaaatatagttagatacaatgaataagatctagtatttgatagcacaaaagggtgactgcggtcaacaataatttactgtacatttaaaaataactaaaagaatgtaattgaattgtttataatacaaagaaaggataaatgcttgaggtgatggatatcccatttacactaatgtaattattatgcattgtctgcctgttatcaaaatatctcatgtacctatacgcacctactaaatacccacaaaactaaaaattaaaaaaaaaattccatgcataagtcatggttgcctctctagatgtttgttgtgaaagaatattgtcctactaattttgaattttttttttctgaaagagattctttttattgaaagtttcatgtcatagatcggcaaaattgttttttcttttgaccttacactgcttcagaatatatgttttggagtgattccagcttgaggcaaggaagttaccagattttcctgaatggaaagtaattgcagatatatttataaaaaggtccagctttagctcttgaaagctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattcttttctcttgctataggtgcacattaaagatccaaagtcatgactgactccaagtatttcacaaccaataaaaaaggtaagtatgagaatacaatcaaatcttttgaaattttcaaaagttgtagtgtaagattgccccaggcagaatgttgctgacctcttccttcagacatacatgtagctgacaatctcactggacatctactacttctatagatgaatgtattcaagcaagttattaaagagtaggttttaaaagagagggctgtgatgcacattattatgacttgaaggttctgtttagtgaaagagactcctctttgctgtttgagatgatccattggagattggttaagtgtgaggaggacaaaagaagcagcatactttttcccttttattaaataatttttacttggaaataaacattttataacaaagaatacaattaaagcaatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgagggactttgcacttattactctcatcatctttgttatcagtaatataatgcttgtttttacctatgagtttgggtctaggaacaaaggattcttcttgggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattccagacatggcgccaactaccattcttctttttctcttgttgcagtgagttgcttaattatgtcagtttgttgtctgtagctttcaatcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaatttaaaaattagccctgtatggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtagaatatatgactttgcctcttttagtacccctctttggtcctgcccaactttttcctccttatttttattacttacacctcacaaaagccattagccacttgtcattcagtctcagctttttctgattttcttttggaaatatgtttatttcttcttctgttagcattttgtgtgctttgacgaacaaaatgtctataattatataaagggatacaattacaattaaatagttataattttaaaactctcctaattcttcaaacctactcttgaaaagtgtcctggtgacctttttttaattcaggcatttgtaaaagtttgagactgcagattgaatcactgctaataaacatcatacttaaaaaaaattgatagattgtgttccctgtacttcctgcaacacccaccagaactgccactgaaacatattctttaaatttatgcttttggaattggaataatttctgttacatcctgctttgattctataacacctgctgctgttcacaattcagactttctgaaaccccgccgtttgtccttcactgttcccggaagtgaatgagaggaactctaagagctggatttggcaggatgggacatggtgaagagtcctatgaagaatgactctttaaagggcccagcttttcttgctatgctacttttgtagctgttgattaaatagaaattttggaacaatttttttgccttattggccatggatattgaaacgaaaaagtgctctacttctgtgtcttactaatttcatcctttccacataatggtttcaggcaaatcacgtagtgtttgtccccactatttctttcttttttttttttttggaggaggggaagtcaggttttaatgtcccagtcctcgggcgccgtcatcccgcgcctgccaggcccggcggccatgtcgctcactcgggtggcggccagcctgcctcatcagggccttccgcggaggccgccccgtcgccctcgagcaccagcttcacgtccagctccagctgcccggtgtagaagcccacggcggcgcacacccagagcgggctggtggcgagtacagcgcccgcagctgcgccccctagcgtcagctgcatgggcccccgcagcgctgccaggccccgcaggcgctgccccacaccgcacacaggccgcccagcaggaagaagccatatgctgcttcgtgatccatgtcactctgcatgaaggagataaccccgatgcccgatgccaggaggccattgtggaaccaggagaagaaagctgtctcgtgcgcctttcggagaggagcctggcgcctgcacggtccagctcggacacaggtggcggcgaagccccgttgtgggggccgtggccgggggcgaaggacccctgggcgcccccgctccggggccactgaggcagcagtagcgacctccggaagcggagactgtccccactgtttctatgctggtaaatgagatctggttgaaaggaacgacaggaacagtcttgaaggtggaggaaagtcttttgaggcagtatggtagatgagctggaggatgtagatggaaagttgagatgggagtagtcaacctctttttcatggacttagtgttttttttccgtttcttttaaacaatattagggttgttactttcttttttattttggttccggcttcttgcagataggtgagcctggagaccaggccttaaaatagtggttacagtccctgacagtttacagtgcggagcctaagcagtcattcaagattgtacctttggaaatgactccattgtgtaccattcttggtttcaagattattcttgtttgattgaatagcaagggccttaaagcccactgatttattaaagtactgattaaagtagtgattctcaacattgggtgtgcgttagagtcacttggtggagctcttaaaggtataaatatgagttctctttgacattatgatttatttggcccagagtggagcctgtactttgctatatttagtatttctcaggtaatattagtgtgtggccagggctgagaacctttgcattcaagagtcaggagacacagtgctaagcccaactttgtcactgactctgtgaactttgagcctcatttcttaatctgtaaagcggagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttaggtaagagtaatcacccttgccattgatcacttcagaggtccataccccatcttatggcctttactgcttttcctttaaaagtatcataatcatagaacctctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcaattgctgaattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaaagctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtattccttaacaccatgtgctaaaaaagagcagtttcacttaggaatgtccttcatgagcagtaaaaatttgttttattaaaacttgaacctttttaatattgtgtttgatgaaatagggattacccataaatctcttctgctgcgtagcagtgcaatggtcgacttgagaaaaaacccttgtgcagttgtttgaactgcaaacaccatttttatgtgaaagaatgattgacagacaaactatatttaatcagactttggtatttgggagatattttattcaaaaatgaacaaagtgaacctgtcacttcaagggaaaaaaattgacaatagatacgtttcaggttttaaagtaaaaaattagaattttggaaaatttgtatctcccatcataagcttgacagcttcctaatgcttaaagacttttctgaggagattggtggtgaaattaatgattgtgattatttgctgttttataatgaaatgtgtcagcatagctcagtgaaccaatatttttccaaatgaccagagcatatgtatatcacaaaattatgcatggataaaagatctattcgaaataaagtgtggaggccaggcgtggtggctcacggttgtgatcccagtattttgggaggccgaggcaggcggatcacttgagggcaggagttcgagactaggctagccaacatggtgaaattctgtctctactaaaaaaaaatacaaaaaaattagccgggcatggtggcatgtgcctgtaatcccagctactctagaggctgaggcagtagaattgcttgaactcaggaggcggaggttgcagtgagccaggattgtgccactgcactccagcttaggcaacagagtaagactctgtctcaaaaatcaaaaaacaaaaaaacaaaatagaatgtaaatgaatggattttaatacaatcaagtacaaaaagtttatcgatacggcttcagattctatattgcaactaacttttaagaaactacagtgtgtggactcagaaagaggaaaacaaccatttgtctagttttatttatttatcattatttttttgagacagggtcttactctgtcacccatactggagtgtagtgacgttatcttggctcactgcaacctccgcctcccaggctcaagcggttctcctgcctcagcctcccaagtagctgggattacaggcgtgcaccactaccacccggctaatttttgtatttttagtagagacggggtttcaccatgttggccaggctggtctcgaactcctgacctcaaatgatctacctgccttggcctcacaaaactgctgggattacaggcatgagccactgttcccgggctgtctagttttagtgtaacatcaagaatttctagttataacaaaaaaaaaaagaaaataaggaatatgtagttatatgaaaaagctattaaaatattatttccttttccgagttatatacgtgtatgaagctggattttcttcttatatttcaaaacaacattctacaaaaggttgaatgcaggaacttatgagaatctagctgtttttatttcaagtagatattaaagagagttgcaaaaaaataaaaaagcagtgtcaccatctcattaatttaaaaacagtacattttacctttaaaatgttatgaaatgggtttattcttattttaatggattaactttttaaaaatttctcagttttaattcctgacatggtaaaatatcaataggtatataacccacatgaacaaaaactctttgggatgtcagtaatttttaagagtatgaagggatcccgagaccaaaaaggtgagggctgcttccctaaccagacggggagcgcagatagaaatggcagcgtaggaaatgactctgtatcttctcttgctccaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagtaagtacatcaggctggcatagtaagtactctttgcttagcaggcaaagaggcaaaattgagtttgttaggtaggtacttacataacaagagagaagacaaatttccacaaattttttattgaggatattcaaaataaaataatagttaagtataatgttttgtaccacaggtatactattaagtgggattctttttgggggatgataacattttgcgtaattaggattcatagtatttttcatcatcagatttgttttatttatttattgttttgagatggagtcttgctccatcactcaggctggagtgcagtggcgcaatctcggcccactgcagcctctgcctcccgggttcaagggattctcctgcctcagcctcctgagtagctggtactgtatatgcacctgccatcactcctggctgacgccaagtgatccgcctgccttggccccccgaagtgttgggattacaggcatgagccaccatgcccggccaagattcatatagatgaacacttagttcatctataaaaaccacttttagctcatggattgtacaaaaatccagcattgggctagatttaacccacaggcggtagttgcctatctgtgatctgtctagtcactgaagggctgtttttgccaaagaataaatctggattgaaaacatcagtacaaacgaattggtaaaaattgtcataactcttttttttttttttttgagaccgagttttgctcttgttgcccaggctgcagcgcaatggcgtgatcttggctcactgcaacccccgactcccgggttcaagtgattatcctgcctctgtctcccgagtagctgggattacaggcatgcgccaccacgcccggctaattttgtatttttagtagagatggggtttctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactaaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactgtccagtggaaatacagtgtgaaccacatatgtaattttaaattttctaatagccattttgaaaaaatgaaaaggaacagatgaattaattttagtaatacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcgtgaaactaccgtaggtaccatgcatacaagtgaaacacatagtttgctttccaggacagaagttactggttcactggagatatggtggattctttgacctgagtccagcttcctttctgtgaataatttctacttctgtacccttttgtgtatataggaccattgtatataccctgtgaccagctatttcattcccttttttccccttattttccttgtggaaatacacctacatttgttttttctttcttctatgctagtagcaagatgtttagcagtattaaaaatgtataaggtactttgataaagcattgtggggaagatttattgctaacttcccataaagttacagttatcctatattgtaaagatacagcttacactttagaatctgacaagctcaacccttccaagctaatggtgctcctttaaatttatttcctgtggcttataggagaatggtaaatcatgaaataactagaacttaggaaaggtataaactccttttatatttgattactctcaaattttcatttgtctgaatatgtaatgttaaaaaaataatttcactaaaagggaatcaggacatcttggaggatgactgattctaggtctggaattagaaatgtacaaaatgagcctggatggggcatcttgtcataaaggaaagtatggaaaataccaggtcatatcacaaggattcaggagctcagttcccactggtcaagactggaagaatatgaactttaaaaagcgtaactgaagtgctttgaaactgtagtagatggatatgaagaattattgttccttttgccctgtcgcactcctgaaagcaagatgattcaccagcagctctactggagccacccgcgaaaagtcagccagggttcttgctattgtgtctgctgaaactgggcacagtctgatctggaaattgagcctcgttacatgccaccagtgtttccatcatacgtgaaggatatagatttcattaagttggactaagtgatcttccacgaatggattatctaaggcacccacccaatgagagaaaccatgttacctttttgtacataaaataaatattttaaaataattattgttattttttatttttatttttgagatggggtctctctctgttcctcaggctggtgtgcagtggcatgttcgtggctcactgcagcctccgcatcccaggctcaagtgatcctcccacctcagcttcctgagtagctgggaccacaggcgcacaccaccatgcctggctaatttttaaaattatttatagagacgaggtctcactatgttgcccaggctggtctcacactcctaggctcaagcagtcctcccaccatggcctcgcaaagtgcttggattacagacgtgagccactgggcctggcttttttgtttttgtttttgtgtgtttttttgaatgtgataaaggtagtggaaaaaaaaaaagacacttgcctgtgcgtggtggctcacatctgtaatcccagaactttgggaggccaaggcaggtggatcacctgaggtcaggagttcgggactagcctggctaacatggtgaaaccccatctctactaaaaatataaaaattagccgggagtggtggcgcacgcctgtaatctcagctacttaggaggctgacacattagaattgcttgaactggggaggcagtggttgcaggaagcaaagatggtgccactgaactccagcctgggcgacagagtgagactctgtctcaaaaagaaaaaaaaggattcttaagatacacattaaaatattatagatgaagctgggcacagtggcttatgcatgtaatcccagcactaggattaacattttttcataataaaaagctttttctaaaactatagagaccttgttgagaacagcactacaatttttttcttgttttttttggatggggacaaggtctcactctgtcatccaggctagagtgcagtgacgtgatcatggctcactgcagtctcgacctcctgcttcagccttctgagtagctaagactacaggtgtgcaccaccacacctagctttttaaaacaaatttttgtagagaggatctcgccatgttgtccaggctggccttgaacacctggtctcaagtgaatccttacaccccagcctcccaaagttctgagattgcatacctgagccaccatgtctggcctacagtttcttttcttttcttttctcttttcttttcttttttttttcctttttttttttagacacaggagtctcgctcttgttgcccaggctggagtgcaatggtgtgatctcagctcaccgcaaactctgcctcccaggttcaaacgattctcctgtctcagcctcctgagtagctgggattacagacatgcaccaccatgcctggctaattttttgtatttttagtagagacggggtttctccatgttggtcaggctagtctcaaactcccgacctcaggtgatccgcctgccttggcctcccagagtgctgggattataggcgtgagccaccgtgcccagccagtttctttagtaattcatttctgtgacagttaccactgtggggacatttgttcttgcatcaaatcactgttagttaaggctattcatgttctgtccaacagcttggcaccaacacctgcttactttccttttctcttttaccctctcttctcagttctctctttccagacgtagtgaactgtatgcagactgacaatctggaactaaagaagcttgtgtatctctacttgatgaactacgccaagagtcagccagacatggccatcatggctgtaaacagctttgtgaaggtaacttttcccaaggcctcaataacagagtttgaattgcaaataagtaacctctgttcacaaggaaggagtgtagggaagtgttggcaatgactaggaatgttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtggcacgatcttggctcactgcaacctctgcctcccaggttcaagtgattctcctgcctcagtctcccaagtagctgggattacaggtgaccgtcaccatgcccagcttatttttgtatttttagtagagacagggtttcaccatgttggtcaggctgatctcgtgctcctaacttcaagtgatccacccacctcagcctcacaaagtgctggggttacggacacaagccaccactcccggcgtgattaattttttttaatggaaaattttaaacatattcaagaaaaaggactagtataataaattcctaaatatccgtcttgcagttttaacagttaccgacacataaccactcttgtttgtaatcctcatacatattttctgacctccaaccccctctcctgctggataattttaaagaaatcctgaacatcatatattaaatagttttgtctttatatttgtcaagataagatcttttatttaaacataaccacaatatcatcatgtctttaaaaatggacaaaatattttcttattattgaatatccagtcaaatctttcctatcatagatttaaagaaaataataatgggatcattcccattaatttttttttttttttggtgacagaatttcactcttgttgcccgggctggagtgcaatggcgcaatctcagctcaccacaacctccgcctcccgggctcaagtgattctcctgcctcatcctcccgagtagctgggattacaggcatgcaccaccacacctggctaattttgtatatttagtagagatggggtttcaccatattggccaggctggtctcgaactcctgacctcaggtgatccgcccaccttggcctctcaaagtgctgggattacaggcgtgagccaccatgtccagcctaatatttttttaatagttgttttttctctgtttggaacttagtgtacatttaaaaaaaacagacagcatttctaaaattagcttctatttaaaatgttttgaaaaataagcaatatgctttcttctttctcatgaactttttgttcttttcctgtgtttagctacattatagagtcagaacgtaacagtttgttctccatgactggtggttcatagagggaatatatcattgggaagaatttagtttacattttttggaagttagagttgtgcatagatttacatgggcttaaagacatttttttagtgtaaggcagtttaaaagagtgttctttctccatattctatttactatatttggaagcacttgctagtaaaagagaatgtatgttagccaagagctcagagggccttctctgctgcttaactccaggtacttatttcaagcccagaccagctcctgtgctcccctttgttttcttggctgcaggccacagaaatctagctctcttttctatttgatgtttaggaactcactgtggagtagggcacggtctttacagctcctcttttttttttttttttttttcctgtgccggaatacaagcccaaaagcttttcctgtttttagggtagatcctaatggctgtgggatggtacgaactccctaaacctctgcctggcactggagtgaatcctgctgagctgtttctcattttgtatttaaaacagttaaatgacttcttcacctaaactcttaaatagggcagctaagatttgtacttaggaaaggaatagcatggaagattggagctcatgtagaatgtatctggaagcttaaattaatgaggtaattcttttgcagcttacataaactggactgtttacttttagccaccatgtatacctacagttgttggtgattgttttctgcaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactttgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaatttctagggcaagattatttttagccaacttggttatgttgtaaatgtttagcagccagaacatagcttaacaccttaaagttttgggaccttttccttattgacattttaaactttgcttatataatgaagaaggtcaagtcccaagtgatatgtttgactccagtaataactaaagctcatttgaattgggtactaattgaatatattggatgggtcattaaatattgttgccaggaagatggaggaaaatagccactttctttaaagtgctacctttttggtctaatgcaatgtttactgaaaggtgcataacactaagagttaatcagtggataacctttgaatattcccttttaaaaattatttatctatctatttatttattttttacagataggatcttgctctgtggccaagctggagtgcagtggtgcagtcatagctcactgtaactttgaactcctgggttcaagcactcctacctcagcctcctgagcatctaggactgcaggcacatgccaccacatcccgctaatttttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccaccgcacccagccttattttttatggagatggggtcttgctatgttgcccaggttggtcatgaattcctggcctcaagcaatcctcccaccttggccttcctcagtgaattactgtgcttggcctgaatattttcttagtgaactttaaatggagaattagaatttggctggacatagatgctgtctctcatttgtaaattacctgttcacttctctgctttgacattttgtttggttcattttattttacaggtagccttggcttctgtttattatccttcaagattagtattaaatccacaggatgaagcaagtcataattttttaaggtttttatggtagtaactaccattagaaatctttcaacctaggcataagggtgggcgtcggtgtgggtgtggaagtgcagatgctttaaccatgacttctgacagagcatcaccaccagtactagaagattcaaccctgccttttatttcccctaagtaacaccatatggtaccttttatttattttttattttttatttttttttgagatggagtgtcactctgtcgcccagtctggagtgcagtggcatgatctcggctcactggaacctctaccttctgggttcaagcgattctcctcctgcctcagcctccttagtaactgggattacaggtgcccactaccatgcccggctaatttttgtatttttagtagagacgacgttgcaccatgttggccaggctggtctcaaactcttgactcaggtgatgcacctgccttgacctcccaaagtgctgggattacaggcatgagccatcacacccagccccctttttaaaaattacataaagaaattagttggctaggcatgttggctcatatgcctataatcctagcactttgggaggctgaggcagaaggatcacttgaagccaagagtttgagaccagcctgggcaacaaactgagaccctgtctctacaaaaatttttttaaaaaattcggtggggccgggtgcagtggctcatgcctgtaatcccagcactttgggaggccgaggtgggtggatcacgaagtcaggaaatcaggaccatcctggctaacgcggtgaatccccgtctctactaaaaatacaaaaaattagccgggcgtggtggcaggcgcctatcgtcccagctactcaggaggccgaggcaggagaatggtgtgaacccaggaggcggagcttgcagtgagctgaggtcgtgccactgcattccagcctgggtgacggagcgagactcttgtctcaaaaaaaaaaaaaaaaaaattttgttggacgtggtggtgcatgcctgtaattccaggtacttgggaggccgaggtgggagaatcccttgagcccaggagtttaaggctgtagtgagctatgattgcaccactgcattatagcctgagtgacaaagacagacccttcctcaaaaatatagaaaaataaatattgtctaaagttagtagtatctactttacagaatgtttagctggcaccaacttgtgtttttggcattgcttttgattcactgttattctgagcaactatctataattctctacctgaggacagatgagatgaaaagtgtttgtgctgcaaccgtcaaccaggtgggcagaatatcatgtaccccgtggaaacttattaaatattcagtggtgctaagaatatggaatggctcaaagggaaaatgagttctaacttacaggcgactccagtttgaggcagcatctctatgctaatgtaaattctttaatgcagaacctatacagttagatggtcagggataaggcctaagggatgtttagcagtaaagtcgtgtgtgtgtgtgtgtgcgcgcgcgcacgtgcgcacacacactcaagtagcacatttagagatctttatccagataaaccgagaagaataaaatgattctggaacaagcttagtttgtccgatttattcaaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattatagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgtttgacttagcctaaagaggtgcctggagtgtaaaatttaagaagacactcattctcaggtgcgaactctgtacctcacaagcctgagaacagagtgcctccttagttttgtgcctggagtgcctcacttgccttactcttgtcctggccttgttacacatactcatattaaaatcattttttgagctcttcattcttgttttagtgaagaactgaaaagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcacacacacacacacacacacacacacacagaactgcttcattttctcaaagtgtttacgtttgaatacataaagactgagttatctgaacactgcttcattatagaaatctcaaaaaagaaaaaaaaaatgaaagatacaaaaaaaaaagaaatatcaatcctcttattccagtgatggatatgagtccttattttactgctcttgaggagtgattttgttccactttttcagaggctactccacatggtggcagcactgcaccagcacatattagattctcttagaaaagaaaagaatgaatgcttccaggggttgtgccttagtagttttcttgtagctcacttcagaagggcatcctagatttgaaagcactagaatatctgcagaaatgactttgaaatcttctaatatgagagataaatgttggtcgagggctgaaaattcttggtgttatattgacctcaagtctggttcctagtgacactgtgccttgctgcaggtaacaaagctttaccatagttttgtttcctgtgttttgcagagaatcacatacatcttactttcctgcagttgttttacaatttatagtttagttgaagctaacttttgatgaaatactagttaagagagaaaagatgaatttagaagtaaaaaaatctcactctattaagtcctagctttatgttcatgttgtttaacttacccaagtctgtttcctttcctggaagatgaaggctactatcttagagagttgtttggattattaattgagcttttgcatgaaaagtgccctgtaaagtgcttggcttatgggagctcataagtggtggctgctactgtaattatgaagtaggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatatcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcatatgctaccatgcccagctaatttattttattttattttttgtagagatggatcttgttttgttgcccaggttggtctcaatctcctagcttaaagcaggcctccagcctcagcctctcaaagtactgagattataggcgtgagccaccatgcctggcctgctttttgtcttcttgggttcagtcctcgtaagtccctttggtttactgcctagcccctttgatcttcatcttccagactgtctatcactctcacagctgcccatgagaatacctgtgcttcattgttctgtcctctctgcaaaattgcaaactgttgaattagtaaaaaaaaaaaaaaaaaaaaaaaaatttctcatttgttaagtgttcttctgcataagcagcatgctctcagaatagcctcaattcaggccaaatataatctttaccaaaagttgtagttaaacttccagcttcttttaatttgaacttttgcttgaaaaccattttatgaaaaataacatttttcttctcagaaagcagtatgtattttgactatgtgctagccagcacgtagacacagcatgggattatgatggtggttctcaaccaggagtgattctactctccaggggacatttggcaatgtctagtaacatttttttggttgtcaaacctgatgggaggagtgctactggcatatatcgggtagagtccagggatgttttcaacatccttcagtgtacaggacagtcccccgacaacaaagaattatccagcagtaaatgttaataatgccaaggttgtgaaaccctggattatggaaatagcactgaggcttcagagccagagtggctgctgtttgagtcctggcttggctgcttactagaaatgtggctttgaacaagttatttaaaatgaacttcagttgtcttatatgtaaaactgaggtaataatgccgattttagtgaattattttgaagatgaaagaataatgtatttaaaattttaaactttgcctgatatatggtaaatgcttaataaactgcagctattcttgaggaagtggcctaacattatgcaccttccggttgttataatcttcatttaggcattaggaagtttacttgtgtggtgatttgttgtcaacctaagatgataaaatattgaaaaaatgccatctgtctagatctctttctaagaattttcgtcagaatatatttggtattcatgtaggctatgttaaactgcctattaaaggtaggcccagaatgcatagaaaaacttaatgacttaactttatttagtacgttaattataggattgttgttatccttaaatatatattagtaagtaacaattacaaaattaaaatattatacataaatgaaatttaaaatgtgtaatacttttcatatcaaatgtccatgaaggagttagagctggcagaattttaggcacatatgataatgtcagtatgtggtgagcacttgataagagtaacattgaaggtaatacattcagtctgtatctgagttcctcaaattgtgtttcatattataaaaggagctgctgttaatttttgcaggattgaagtttgggtaagtggaatcattgggggctgctttgatatgaggccaacttcccagctcttgaatttcccaccagttggtctgagtgtatttctgtctctacttatagagaaagcaaacactttttgttttccttttataatgtgctttgtggaaatcattttctgtgtattttcacttttaaaaaatcattacgtcgttttatattattatgaacttaggttttaaaaaatatctcttttttttttttttttttttttttttttggagacggagtctcgctcagtcgcccaggctggagtgcagtggcgcgatctcggctcactgcaagctccgcctcccgggttcatgccattctcatgcctcacacttctgagtagctgggactacaggcgcccaccactacgcctggctaattttttttgtatttttagtagagacggggggtttcaccgtgttagtcaggatggtctcaatctcctgacctcgtgatccgcccgcctcggcctcccaaagtgctgggattacaggcatgagccaccgcgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcacaatctcggctcactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaagaattttaaagattaaattttttaaagctctgagggcaacttacccacaaatgaagctaaatctaagagaactacttactacttttacaaggtaattattcaagggtgtacgtttaaagtagttctcaacagcaacttcctgaaagctggatctgttgtgtgttgttttggtggtttgccagtatatcaaggctcatttgtcactttaagatgacctcaaggctgtaatttggctggggaatactttactctcagaaatggggagatcataagtggtgtgataataagtgttttattttgttcaagttgcagcttgctttaatgaattttaggggccatggtccaaataactgtgatggttataggcatgccttttatttgtttatcgatatttatttgtagtgttttggctttgagagtacttgaattttgttaaatcatatcttaaaccacttaagtaatgaattttattttttgtaaaccttgttactatgtaatcagactttcttttcataatgagatgtgttggctcactaggtagttttacctctcattctaaggaagaagatggggaaaaaatggaatattctagattgtaatgtagcaggcatattaacagttggcattctagacagtgttttggattaaagtataagccctaagttttacttgtttgactggtactgcagtcattgtctccttaaggagataataatgactgaaactctcagaacaaatatgttgtcctatgcctcacatgtcatttgaggtcattctgtaaaggagatagcaatattctaacactgctaatttagaagagaacaaaaatatgtaaaccacctgtgtatttcctcataatagttttggtcagttactctacttctttcactttattcaagtcttcagggataccagccaaaataattgtaaattgagcagaaaaactgaagcataaatctgttcatagtgtgtgaccttgaaggtcattgctggaaatcaaagtcctgtaaatagtaatttacttaacaggaagaagtcactgaactggaaagtggtaagtttctaaggttccaaggccacgaaaatgagtgaaattagagtgcaaggtgaaaatcattttaagggacagggaaatgggtgagagattcctcataagtgagcttatgtgtgtgatattccactcccagtttatatctagatttcctttgagagtccttttttttacagggtcatttttattctaaccatacctactgtaccagctcactccttttttaacaaaatgaggtcaaatttattatcctcaactgctgcatataagacaggtatagatcataaatcatattttatagctaggtagtaaatctttccctccctaagtactgtaggatatgattatctctgaaatgtataaagtagaatacatttttctccttgtatataaatctacatgtcacctttgctggaaataatgtttggattatattatcctcccctactctgaatcttctttcccttcccttggttgaagttcacaagtcttggaagctctataaatgctggagaccaagtattagtactcagacactggaatcagatgcagaccttgagttcagattcaagcaggaatccctttctggctgtgttgaccctaagcaagtcactgaacttctctaagtcagttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaatattagcactttgggaggccaaggcaggaagattgcctgaggccaggagtttgagagaagcctgggcaacatagtgagaccctgtttctatttaaaaaaaaaaacaaaaacaaccagcagattccacaggtccataaggaaatatcatattgaagagaagtctgtaattaaggcagagaaagatttgtctaggattgagtatgattttacacatctacatgtgctgcttttatatatatgtttgtgtttaatatctatctctgtaaagtatacataattgggttagctctttgaggggatgtgaggggtggggaatgtttagtttcagtctccccaagaatagaatttaccataattgggaggcaagatgaataaaggattttttttagttttttattttacttttatctttttggagacagagtctcattctgttgtccaggctagagtgcaatggtgtgatcttggcttaccgcaacctctgcctcgcatgttcaagtgattctcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaaagtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgacgggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcctggctactcaggaggctgaggtggaaggatcacttgagtccaggagtttgagattacagtgagctgtgatcagtgcgactgcattccagcctgggcaacagagtgagaccctgcctctttaaaaaaatacaatttttttcttggaaactctaatttttctgaaatggtagctaaaggccattgttctctttctgtcagtatttcctaagagaaatgccaattttttgacaggagaagtgttacacatagttgtgttaacagttctaaatcaaagtaatagttcaaatgaaagaagcacacctttgtcttagtatacaggtgagtcaaggcagttattgtaagggttggatttgttcttttgtgatattattgtctagagaagactctggaggaagaggaagtaaatcttgagtttcaatctattattttaaaagtttattttaaaaacggaacaatatatattcatagtacagaattccaaagaaacagtataaacattgacaagtgagttgtcatgtactctctagccacccagttgctgtctcaaagttagtctttttctttaagatactttagattcagtgcgactgatttattttaagttttcattgaagagtgagagaaactcggcttacggaccaggaaaactgagagtgctgcctggtgagcctgcctcagtatgttgctaaaaatgtaacagtctgactgtggagattaggagatgaaagtgtagagataggatggaaggaacttcaagaaattttagagaaacattagagttttggtatagaggggtaggatagcatctcctctggacggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagttgcctataataacagaggatttctaattgctcattctgtttagcattcttctggtctttttctccccattgctgtttttaattctcccccttctctcgttttctttgtctatatttcctattactagaccttatatttaatctttttgtttttttaaacatgaaaagggtttcactgacagaagtggtaatttatttcagacaactggtaaccaagactgggcatgtgttggcaacaataaatcaaaacaggcatttggccttctgatatgatattttgattctttagactataataaggtcaactaagtatgttgtgcaagggaaataaaatatcttgcatgtgaagcacatggaagggattattatttctctctttatggcttttctcatgcttgatgatagagttagcaaacaaaaattaagtcagaaaagagcctcatacatgttaccatccagtaggtgggctagataagttttcctgatttgtcttaacaagtataaaatagtatatctgtaaccatatttaccaagtgagtctctgatttttcatcttagcatctttgttctgatcaccaaagtatagcttgagatgattgcatttgtggcatcattatcctttacataataatggacatttttgtaagtatattatttgttaaataaatcacattctctagacatttatcttctagataaaatcatatgctgggataatctgaagattacacagatgatgtgaatactaaaatcaatagctagattgtagtcattatgtttcttcccttgctaacaaaatgataatcatacaaatcttaatttctctagtttttattaagggacttcagtaagaactaacaatggttttacatttttgagaatatttccaatatatataattgctgaagcttgtctcctatcacatctcatttatacttggagaatatttatttatttatttttgagacggagtctcactctgtcgcccaagctggagtgcagtggcgtgatcttggctcactgcaaccttcacctcccgggttcaagcagttctcctgcctcagcctcctgagtagctgggattacaggcacacaccaccatgcccggctaattttttatatttttagtagagacagggtttcaccatgttggccaggctggtctcgaactcctgacctaagtgatccgcccatctcagcctcccaaagtgttgggtttacaggcgtgagccaccacgcccagccaacttatacttggagagtatttatattcagcctcactttgctaatctttcatcagcatctgggaacctcactgcaaaacatggtcttaatttacttgtacaaagccacaatatatagtatttgtatgtatgcatttttttttttttttagtatttttgcaacttttaaatgactttagatgttcttcctttgtagatttcttaaaattaatttgtaattttgataaagtgttgacttttcttcctgcagctaaatggattcccagatctgtgagtcaggatacaagtgtactttctagtataaggtagcaatttttcagccgggcatggtggctcacacctgtaatcccaacactttgggaggctgaggcaggcagatcacctgaggtcaggggttcgagaccagcctggccaacatggcaaaaccccatttctactaaaaatacaaaaattagctgggcatggtggcatgcacctgtagtcccagctacttgggagactgaggtgggaaaatcccttgaacccagtagatgaaggttacagtgagccaagatgtgtgcctactcagaaagaaggatacatttgaaatactgtatttcattgaatctttaatgccactgattataagatgtattattattttctgtattactaagaaagaaaaatgcttcctattgaactgacaggccattgattataaaatgcaacccagtttcaaaggtgttaatgtgaaaaactgtagcttacagttgatgaattatggtaatataaccagccaccttaaatttacataaggctttgtagaaagcacttacacatatgtcatctgatcttatccttaaactaaaactaatctgtgaggtggattaaattatctcgttttcagatgaagaaactgaacttcacagagattacatattctctcagcattgtatactagtgaactagggtctcaggcccacatattctcactctaagacttgtagtatgattaatggtgtcacctcccccaaacccatacatatacagctacacaactataagattatttggcctagatttttctctctgttgcctaatgtacatatttcatattcagactttgtcatttttcatatgctgttcatatgtcttgattttgaaagttttgagtgctgttaacatggttaatgtatgttttcctattaaataacatgtgactctgctaatatatgaattgttttaattctgggttgccttaccactctatataatatcattggtggtttaatatatgttttgaagtgatttatttgtttctatctgactaggtaaaatgttcaggaatggttatgaattgagatccgtgaaatgacccagagaaggctgatgaagtgtttgtctatagctgtgctgttcttggtgaatcaaggtcatacccccttcttttccaggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagaggtcagtctgttttcctggctactttctggtagtcttgcctgatgcagtaagttctggagtctgctattagaataaatctgttgaggaaggtcagtggcttctggggtagatattgctatctccagggtattttctctctggatttaggaatattttaggtggtagaataaactatgcaaaactatttctaagaaatgtatgtttttcatacagttacttctgctaaaatctcttttatcgtcttacgtctcccatgcacagttcttggccatttggccagcaaagattattgagtatctctctttggggtgacagatttttcattctattagatatatagaaagtggcttcatattagttattgagctgacctgtatatataattcagtatgagagagagtatgttaaagtcagcagaatatatcctcctttccagtagatatggaaaccatgtcagtctgaatttgaagattttagaaggcacacctagattgttctgctcagcctgttaccatgtaatgttgcaaattttctttggttattagaaattgactactaaatttcatctacacatacatacattttagtttacaaagttggaattatccctaatttttattgagcattttgtatatgcaggcactgtactaggcaaagtacttctgaagaaatgttggctcttcattaaagttggtatattttaattatggtatttaagaactggtctggctgaagctgatttccaagctactagaatgtaagtgatcttcacttatctgggaaattgtccctctagactgaactaaagctcactctgatagtttctttccatcactgaaagtacaaatatagtctggaaataactttactgagaattttattttcttctgttggccattgacatcacattcattcattcactcacttagcaaatatttattaagtgcatactgtgtgccaggcagtgttccaggctctgaggatacagcagtgaacaaagtcatggccctctgggatcacttattctgaaggatgggggtaggaatatatataatatgtatagataatataatatataatatgtatagatagtgtaatatgtaatatgtgagatggtgataagtactaacaagaaagtaaagtagagaagaaatctaagaaatgctgggcatttgggggtgaggggttgtattttctttttaaaggatggccagggaagacctcactgagaaggtggcattcatataaagacccaaaggaagtcaggaataggaggaagagagaagtacagcctatttatcttctttctttaatacagtaagttagctacttgtgttgcccaagctaccaaaattggattaatttctaaagaaccctcaacagataattaaatatcaaccattttatgaggcatgtaagtgtaggtggcaggggctaggagaggggggagacaggaaaatatagtagtggtgtcctgctatttaaaaaacaaacccttttcagagagtcccttattctcattatccttaagagaggaggttggattgttttccctaccagcctgcctcctgctgtatcttacaatgaaatcttcagccacaactgcgtttgctgtctcttcctatgaaataactctcagaatgcttaatttgacttcctataggttgagtagaaatgggctgagaggcagggagccttaacataatatggggagacaaagaggactataaaacaagaaggtaaatggtgtgagctcaagtgtcttgggtattgctaggttctttccagtttgaacatcccttattactggtttcctgaagtcttcttatgtccctgctctgcctgtagtttgctgagaatgaggcttctgcattgttggatcccaattttacctaagcatggagctttgacttttctaactaattctttaattttttgatacttggccattagactctgacatattaccttatagaatgaattcagcaaataaattataattcatgatattaattttcattctccaccctcagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggttgggaaatagcgaagtgttgattaaagtgtttgtaattttgcattaagcttaataatgtcaatgttaattaggctagtgttaatctctttttaatatatggaaatgaaaatgttatatggcagaaaaacttgcttgcctagcaccaggaggctaacagttgatattacagtgtttctataataaatgccatgcgttgctccacaatccagtttgttttctgaagggtctctttctgatatactgtctagtgcctggttgatatggttcaggctgtagtttagagccagattgttgttctagcagttcttcatggcaacatgtgccctgatgcttaaaaaggataaaaataatctgccaagtggaactgataagaatagaggcgtatagaggaagtttatgcttttttttttttttttttttttttttgcctgagtggagcgagaggagagcagagaggcacagattaggtattaatacagtctcagaagggtatatcagtatatgccttcaccttcctttcttctgtttctgtgtaccctaggcctgaaatcttgaagcaggaaatcaaagtcttctttgtgaagtacaatgatcccatctatgttaaactagagaagttggacatcatgattcgtttggcatctcaagccaacattgctcaggtcagactttatgcagactcaagttgatgatgatttagctcttaaggtctggcctttaaagaagctaggctgtgagattgctatttgagaatccttaatgattaaccacttcctgggtttaacaggttctggcagaactgaaagaatatgctacagaggtggatgttgactttgttcgaaaagctgtgcgggccattggacggtgtgccatcaaggtggaggcaagtgtctgatggtagttaggatcatgtattggggattctgagagttctcttcacttttttctttaaaataatttttaagtttatcaaaataataaagcacacagtttcaatgttaaagaatttttaatggaaagcagctgtctctggttcctcccttccctacctagactttcttctcagagggaatatttttaactctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttggtatccacaggggcccaggaaccaatctcccatggatttggagacatgactgggctgccatatctctaaataatattcttggctgggtgcagtggctcacacctgtaatcccagcactttgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgagtctgggaggctgagactgtagtaagctgttattgtgccactgcactccaacctgaaaccttttcactctgggtgacagagcaagacgctgtctcaaaaaaagaacaacaataatattcttatgctattatttattaatttacctatcatagactttttctgttaactatctgctataagaagtttacttcatacacccaccattcccacttctgtctcctgttttccagtgtagttacataatgaaggtttttgttcctatatccattatcatggtagattgaaataatatgcctttgtttcttattctatcaactgttggcttgcaaaatttatgcatattacgactgtgtaaatatttagggccaatgtaatgcaaatgattacattttctttcttatagcatcttttttttttctggaggttttttgttttgttttgatttttgagacagagtctctgttgcccaggctggagtgcagtggtatgatctcggctcactgcaacctctgcctcccgggctcaagcgactcttatgcctcagcctcctgagtagctgggattacaggcatacgctaccacacctagctaatttttgtatttttagtagagacgaggttcgccatgttggctgggctggtcttgaactcctagcctcaagtgatccgcctgcctcagcctcccaaagtgttgagattataggtgtgagttaccacacctggccctggagtttctttaattgcctctttttttcttgcatgtgtgtctttatcatgcccctatattattcctgttccttaagcataatatcaaatctgtaaactttcttttgtcttagacccttctcttttgcagtcctctgtcttcttgttttttctactctgactgattgcttttctggcttctgcacatcattccatacagcctccctatttcttgttattggtatatttttccttgcattgctctttttgtggttgcaatagcttcttgaatctctgaggatatgaatgattcgtttttttgtttctgcactttgaatttaattatcggatattttttggtgatgattgcatatctatacatataattttttaattgagatgtataccatgcatacagtaaagtgcagctcgtttctgtttaagaaagaggtaacagaaaagttgattaggacttctgtatacataggcaaggctgtcgactatcaggtttctgctttagggaagggggtttatctttacatggaagacctcttgaagagcctatctggtcttagagggcagattggtttctagcttggctgcagccttccggtaagtattatgggctgtaatttatattgccctgcttcatcagtcagcagtcctccatttgtttgtcctcattcagaaatttgttgaaattaacagtggcttctgttcactgtttttatgggttcagagccccatgtttgttcttgctacttgattatatgcagttctgcctagagtcagaggattggaccatatgatttctcaggaatacgaaaacaatttgtacagtatgaccagtactttaccggaacaaaaggaggcagatgtgtgtcagagaatcttctatgaaatacctgttcctaattggccttccttgttttttttcagtttagtgctgcttcatgtagtttctgttgataaataatttaatagaaaggctgttaacagcaagaagttagctagtcctgggttctattcctggttctgctagctcacttgattcagatatttaatgtttctcttcattggagaaatgttaaagtctttttgttggatcttgatatgttaacattgtttttattaccactgtcaccacacgtcacaacttgtttttcttttctttttacgttaacatatcttactagccgtctacttagtattaatgtagataattttcagagagattttggtagcataagagtaaggtggttttgttctcttcactagtgtacatagccatcttttccacaagactgccattgtcttatgacctacctctctgacaaagctgtaaacagtaatacaaaaattatatcttattctgaagttcagagactttctagccctggaattactagaaagtgttctcaaagcatctagattcctcaaggctgttagtcatctattgtgactaatggaaaggttctccataatcttctggaaaagacttctgatggctttcacttcttcctttgactaagcgtgctttgatgggagtatgacaggatgtgaggaatgaactttcccaggaaacttaaggtcacccttcaggaatcctgtcttatctagtgctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaaacaaactcctggtccttttcagttttaaaaaggagagaggttgaggcactaggttaagaccaggagttcttcacttcctggtcttctggttattttctgtttactatttctgatttttatatattagaataaaatattggtttgtgtgtcatttcttaaagacaaaaaacatatttttcctattaggaaaaccatatttgtttactatatataattatagaacaagttaaacaaaaaatggggtaccccgcttcccccatcttctgtttcactctctcagatatgcagtggacataatctggtagacatcattttatatcattgtttatatagtgttctatacaaagatgtatttttttataaaaatgaaatcattccacaaatgctatttatttactttgttttatcctctacttttttttttcttactagtaatatcatggacattgatccacattataaagaaaaatttatgtcatctttagtttctggtttatagacataacgtgattacttgataacttactgaatttgtaactttatcccttattataggaccttaaagttgtttctactctttttccaaatggtggtataaggagtatccttgcaactaaatctttgaactctagttgaagtgaacattttttcataacagttatgcttattagccatttgggaattgctcactcatgtcctctgcacctttttccaatatgttatcttttccacattgttgttttaaagtcttttgtaattgagatgttaacccttcttttagttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactatttttttttttttttacttctatggcaatgattttgttttatttgttttttggggggtggtggggaaatggagtcttgacttgtcgcccaggctggagtgcaaatggcgcaatctcagctcactgcaacctctgcctcctgggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtgtaagccactgcacccagcccttgttttatagtttaagggtaattttaatcaaccgggaaataattttagtgaaagatatgagtagagtggatcaaacaccagaacaaattgttctttccttactgttatgaaatgttgtctttatcatatactgaattttgtatgtatttctgtttctggactttttgtatatacaatgatgggatgtttacttctgttcctctgccatactgctttaatggtagttttttttttttaatcaaaagcagtatggttgagatgataattttctttgaaaattaatatccctgacataaatgtttttcaaatgtttatacatcatgagtaacatccttttatttgtattcattttaatgataatactacggatttactaaatatgagctttatatcaagcactgtgctaagcacttacttgtattattaatttatggtaattcaatgcttacagtggcccatattctacatactacataatttattaatataacaattataatattaataaatatagcatatttaaatttttccaactgttttgctgttgcaataacagcaaaggaattaatagctgaaaatgaataaaatagaggacataaatagaatcagaagaaggacagaactacataaaagactgcagaatcggccgggcgcggtggctcatgcctctaatcccagcgctttgggaggccgagttgggcggatcatgaggtcaggagatcgagacatcctggtcaacatggtgaaaccctgtctgtactaaaaatacaaaaattagctgggcttggtggcccatacttgtaatcccagctactcaggaggctgaggcaggagaatcacttgaaccagggagtgggaggttgcaatgagcatagattgcgccactgcactcagcctggtcacagagcgagactgtgtctcaaaaaaaaaaaaaaacagactgcagaatcatttcatggtacaacagaaccatcctatatatgacctcatataaatgatctcaaggtacagttttgtttttattaaattgcttatagtggtttagattgttatagtacttctaaagatcttattacagaaattttcaggtgtacaataaagtaaaactgaataatgagatcttgtgtagtcatcatccatcttgagcaaatactgatatgttaactgtttccgttttatcttctccctcttcctcttccttcgggtgggtgggatgcgaatacaaatcccatatatcatcttactcaagtagtccagtgtgtatatctaagagataagatactttaaaaaatatattgtcacattaccatgcccagcaactaacaataattcttaattttattgaatattcagtacatgttcaattgtccctaattatgtaaaaatgtctttttacagtttgtgcaaatgaaaatctaaatatggtctgggccaggcgctgtggctcacacctgtaatactagcactttgggaggccgaggcgggcggatcacttgaggccaggagttcgagaccagcctggccaacacggtgaaaccccgtctctactaaaaataaaaaaattagccgggcatggtggcgcacgcctgtaatcccagctactcgggaggctgaggcaggagaaatgcttgaacccaggagacaaaggttgcagtgagccaagatcatgccactgcattccagcctgggcaacagagtaagactctgtctcaggtctgcacattgcatttgaataatgtgtctcttaagtctttttacttacttattttggtgccaggtattgaagaaactaggtcattaggcttatagaatttcccacagtctggatttggctgttgtatcttagtgatgcagttttatctattcctccatcctctttagataattaaatctagaggcttggtaattttcttgttcagaatttttagcaagaatacctattgggtgattctctgtacttcctgttgcatcttatcaggaggcacataatggagtgacccattatagtacattgtaatatatgataggctggtccttgacttttaggatctctgttctggtatctctctcttttaaaaatgatcacttatagtttctgtacatttgttttttcacctgtattctctcatattctcttcattaataaaagattaacagataaaactccattttatagattaattataggctatggaaaattgttgtttatctaatgccatagacttttaagtttcatagccccaatattggtaaattgtcgagtactacagttctttggagtgttttggatcatgtgtaactttgaaaatgtaatggaagttgtagacccactcactggaaaatatgcttgaaagctcctacaaaatttggcgatttcatttcagtaggtttaaagacaccctctgctatctccactcatccatgaacttcagttaaagacctcctactttggcttattctttaattcttattctttcctcctacgatggcttattcttcttacttctatctcctggctatccaagatgggtgtgtgtgtttctctgtttctggactttttgtatatacagtgattggatgtcactctacttctctgccatactgctgtaatggtaggtttttttggtgggggtgggggcatagtctcgctctgtcggccaggctgtagtgcagtggcacgatctcggctcactgcaacctgtgtgtctcccgggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtgtgatctcggctaactacaacctctgcctcctggattcaagcaattctctgcgtcagcctccggagtagctgggattacaggtgcctgccaccacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattacaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatcaaaagcagtacggttgagatgagaattttctttgaaaattaatatccctgacataaatgtttttcagatgtttatacatcatgaggaacatccttttgtttgtattcaaaggattcatttgaactgattcacctatcagttcaaataataaataaaactgtatcatatagcttggtatctagcctgtagtacagcttggtcaaattaagtgcctgatcatttagtttggtttagttgatgcacctgcatgtttcaaaatttttatgttgaggtggtgttatcgcatagatcatctgacttctcattttttgtatttttcttcccagcaatctgcagagcgctgtgtaagcacattgcttgatctaatccagaccaaagtgaattatgtggtccaagaagcaattgttgtcatcagggacatcttccgcaaataccccaacaagtatgtccaaatacctttacccctctttctcaaattacttaggaaatgtttaaggcactttgaaattgcctaggtaagaattactcttttgaatgttcctggtcataataggatactttatcaaaaatcggaaacataaaatggttagcacagggattaaaacctgagttttcactctgctttctttctttaggaagaattgaagctctgcctgaatatgcattgtctattggcatattttaaagttaaccagattctttgatggcaaagttactgttaaataggacatctatatattctaggttgttcaggcataatctcagtttatacctgttatccagacataattaatgattgtgcaccttttcttctcagaaatgtataagtttggatgatatatcgtatagcaccctaccataaaagccaggaagggaacagctgtgctatttactttgcatgttacctactacattgtggagaattacagaacatgtaacattatcagtctcatgccttttctgaagtattgtagttattctcatacagatatataaaaaaaaatctgcatttttacttcacaagtttttcagattgagggcctcttagtatatgaagcaaaaatactttttagatttgatttttgaaaacaagtaattaaggaatctgaaaatgaaataaaagcaggttttataagcatcttaaatctcattttgccttacactcatagagcttctgattgtcttttttgagacggagtctcactctgttgcccaggtgagtgcagtggtgcgatcgcagctcactgcaacctccgcctcccgggttcaagtgattctcctgcctcagcttcccaagtagctatgattacaggtgcatgccaccatgtctggctaatttttgtatttttagtagagacggggtttcactagccaggccagtctcgaactcctgacctcaggtgatccatccacctcagcctcccaaagtgctgggattacaggcatgagccacgatgcccggcccacttctgatcgtctttaaagatagtgttaaatgaagcagcttgtagtaagttagcttagtggtgggctcaagaattagtagatatattttggcaaggtagtggtttattaagcattgtgtatatttttaaaattttagaaatagttattttggaaagagaaccacatacttttactactctcccaataaagaagagggtcggtttctaaattttttttttttttttgagacagtctcactctgttgcccaggctggagtgcagtagcgtgatctcagctcactgcaacctctgcctcccgggttcaaacattctcctgcctcaatctcccgagtagctgggattacaggtggctgccaccacacccggctaatttttgtatttttagtagagacagggtttcactgtattggccaggctggtctcgaacttctgacctcaagtgatcccccccacctcgccctcccaaagtgctaggattatgggcatgagccactgtgcccagcctaaactttttttaattaacttttttgtttgtttgttttcagacaggatctcactgtgttgcccaggctggacacatactcctgggcttaagtgatcctcttgcctcagcctctccagtagctaggactacaggcctgtgccactgtgcccgacatttaaacttattaagggtgaagatgtgtatctgaatgtgattggtagagaaatgtatccatttctggtttatggttaataaagagttaggacggtttatgtttaagaaagcaatcaagagcctggtttaatcagtaaaagtaggcagatacttagttaagtgtgctatttagttgtccacatctaatttattatacagggtcattctaatcgttaaaactacattagccaaggagatggattcaacatggtaagcctgagagagctgtagatatgtaaaaataaatattttaattacttctttctttggagaaataagtcagtgcaggtacctttagaagaactaacataaagaaagatctctttggggccaggcgcggtggctcacgcctgtaatcccagcactttgggaggccgaggtgggcggatcatgaggtcaggagatggagaccatcctggctaacatggagaaaccctgtctctactaaaaatataaaaaaattagccaggcgtggtggcgggcacctgtagtcccagctactcgggaggctgaggcaggagaatggcatgaacccgggaggcggagcttgcagtgagccgggatcgtgccactgcactccagcctgggcgacagagcaacactccgtcttgaaaaaaaaaaaaaaaaagaaagctctcttttataaaaagcagagataagtggattaagggacagatttaccatttcttgtctggacactgttgttgtctaacttcatttgcctaaaaataaagtggaatttctgttcctctctaccatgaaggcaaaatggaacaataggaaaattttctaatgtacttatatgaaagattgttacaaatacaaggtagtggtattatcttacaccacaggttaatttttccttgtaaaaatggcagtgtggctcgcacctgtaatttcatcactttgggagaccaaggtgagaggatcacttgaggccacaagtttgagaccagccggtcaacatagcaagacccccatctctacaaaaaaatttttaaaatttagctgagtgtggtggcactcaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcccgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttatttatttattttttttttttgagacagtttcactcttgttgccaaggctggagtgtagtggcaggattgtggctcactgcaacctctgcctcctaggttcaggcgattctcccacctcagcctctcgagtagctgggattacaggcattcaccatcactcccaactaattttttgtatttttagtagagacagggtttcaccatgttggccaggctggtctcgaactcctgaccttaggcgatccacttacctcggcttcccaaagtgctgggatcacaggtgtgagccaccttgcctggccagttttactgatttctaatgttaaaaacctacataactcagaccagtagttctcaaacttcagtgagcattattaacacctggggggcatttttaaagcacatgttgctgggcttcaccctgagagtatctgactcagtaggtctgagatgtgcctaagtatttgcatgtcttacaaggttcagggtgatgctgctgctggcaatccggaaccacacattgacaaccactggcttagagcagtagttaccactacttttttattttctgtcacctaagaatgactacacatttctgttagtaatggctgtggctcattacagcagggattttcgctagaggctgtggtgaggtttgaaaagattatctttggatgaaaattctgagactgcttctcactttcccctaccaaaattagagccacagaaccaggaagccaataaattattaagcccttttttcttggcatttgtactcaaagcaaatagaaaataatgtatgtaatctactatagcaattttaatagacctaattcaaggagtatgtacaagtcaatagctttgtggtttagcagccaactcctaataggctgtaatctgacataattctactgtcttggctcttgccccagtacgacagatgattccataattccccccaaattgtagcttttggtagaagtaaataatgaaagacttgctcaggagccaattttatcaccatcagtatgttaacatatactttaagaaatacaagccaggctcggttactcatgcctgtaatcccagcactttggaaggctgatgcgggagaatcgcttcaagccagggctatgagaccagccctggcaacattgcaagactacatctctacaaacaatacaaaaattttaaaaattagttgtagtggcttgcacctgtagtcccagctacttgggaagctgaggcaggaggattgcttgagtccaggagtttgaggctacaatgagctatggatgtgcagcctgggcaatagagggagaccttgtctcaaaataataatagtaataataataataataaacacaggtaactatctgtcttagaaacaagcaatattttgtgccaaaaatgcatttcgaggttaaaagggtagagttttcggttgaatacctttgtatttcccacgaatacttttgactgctgttgttgatattgattgagtttcagccttttgtctcttaaccaaaatcagaaaggctccatagtaattcatagttggggaaacaccactttggagatgatggcagggaataatgccagtgccattctttcactctatcacaaattatgtctgtttaggtgcagctcactctgcttactgccatagtgaagctgtttctcaagaaaccatcagaaacacaggagctagtccagcaggtcttgagtttggcaacacaggtaagaaatctggaaaaagcaagatgttgatttgtcttgtttcaaattgtaggaaattatgaaactcttcctaggggattcatttggggaagctttatttgaaggaagtatggcctttagatcctgttaaaatattaaaacaatgcctttttacgtgttcaactgaattgtagctaattctgtggcttttaaatgagttgactgattccagttttcataattcatgaaaattgaacctagactcttagtttagtgaaggacatacttagatgaaaatgacgtgatctgatagtacctgcttcactgtgacttcatttcagctttcaaatgaaagtggagataatagatgcctcagtaaagtttcatgcattgttctaccttccagagtagttgcctttctcacagaaattaagtgtttatgctgcttccttgtattatttgatatatttggatctccttggaattatttgtttttttaggtcagaagaaaagaagtttagatggattcagatctcaggaaagtggcagctggctttaaatatcaggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaatggaatatgattcagatatccagtttaccatttttctgtctttgtcatccctttatactggtgtgtaatcaaaatttaaaaccctttcacagtactttgcctagttctgagccataatttttcctgttattacaacttaaaaaaatgtatttgtatgagctttttgaagtattttaaaaactttcttaagcatcttcctctgcctgaagcaaagcaattataaacatcagtggttaatattatctgtattgaattgagcattctaatttcctggatcccatttgcatctctaagatgaattcaaaacaatttctttattcctcccacaccccccacagccttttttttttttttgtactctgtttcatgttttaattttaaactcctaagtcaggagtgtccagtcttttggcttccctgggccacattgggaggagaattgagaattgtcttgggccacacataaaatacactcacaatagctgatgagctaaaaaaaaaaaatcacaaaagaatctcataatgttttaagaaggtttacgaatttgtattgggtcacatgtggcctcaggttggacaagcttgctgtaagtggtcacatagaatgacattattagagcagctcacattctgtcaaaacaatttctaaagagaattttggcctttcttcctctctgcttactgtaaatattcaagcaagtatgtttagtagtttcctctgttttcacaagttctcaaccttatcatcattgtctgttaaagcctatgtgattgtatttaacaggcaccataggagagctgtattacgaattctggccagacttcaaactcagtctcattacctcttaagtatttatcaaaatttgactgagataaagtatttaggaaggattgcttaaaggatacaaggtagtgctgttcttacagatagtctgaaattcacctctgaatcaagcattattaatagacatctggatacctggactgcattgtttttgacccctaataaaattgcttttactaaattacgctgatactaaaatactatcagtctgtagtaataacagtcgtcatgggaaactaccctatttggatctgttgttagcttgttatcagagtcattacttacttcattatgttttcttctttatgaagccccatcaaatttctaacaagttttggatttttctgtgtatcagtgtagcatgcctgatcagctttcttttccatattggttgtttgaaaccttagaatcacatttaacaatctcccatggaaactatgtaggccactgtggcatgcagtttcctgactctgggtttaattaacgctctttagccttagatgcatttttcataagcttcctagaacaggacaggctagaaactcacttaatcctagtaagggttagtaaacgatttctattttatagatgaggaaactcagagaggcctaattattatggggcagaactaggactcagactcagatagtctggctctaggtcttgcccacggtcttgtccactgtgctatgcttcctctctagtctgaaggttaagaatgacttggagaatacctattccctgcctgaagcaatattgagcataagcccatatgtatatgtgtgtttgctagttttaaggtctttgtggatgattatttcatactataaataataagcaacttctcgaggcttgccttttttcaagactgagtctagctctgtcacccaggctggagtgcagtggcgtgatctcggctcactgcaacctccacctcccgggttcaaacaattctcctacctcagcttcctgagtagctgggattacaggtgcatgccaccacgcccagctaattttttttttttttttttccagtagagatgagggttcaccatgttggccaggctggtcttgaactcctgatctaatgtgatcctcctgccttggtctcccaaagcactgggattataagtgtgagccacagagcctggctgaggcttgctttttctgtccaattaattaatgaagtctgagaagttatcataaaacagtaagtatgctgctgggtgctgtggctcacacctgcaattccagcactttgggaggccaaggcgggcggatcacttgaactcaggaattcgaccagcctgtgcaacatggcaaaatcccatctctacaaaaaatacaaaaattagcggagcatagtggcacacgcctgtaatcccagctacttgggaggttgaggtgggaggatcgcttgagcccaggaggcagaggttgcagtgagctgagatcatgccactgcactccaggctgggtaatacagcaagactctgtctcggaaaaaaaaaaagaaagaaaaaaagaataagtatgcctatgtaagtctttttacctggaagttttctgttttttccccaagtttgtgaaataagaacctaaatatttatggctagtgagtaccaatttaagtttaggatgcaatgtggtcggctgaattgtgttaacttaaattggtatatgtgctgccgaagcgagcacatgttaacttaaattgggtagtgaggttctgatgatgctacttccactgattctggacatgactgagcaaatttctttcatactgcttttcttctgtctctatagtagagttaattaatactgttctttacctgtgctgagaattaagtgaagtatatgtgaaatcttagtgcttttaagtaaaatgggagtataattaaaaatattattagttagggggaaaaacccaacccttgaatctgaggcttcatttcaaaaatttatctttttctcttacctgttacacagaaattcaatacaatattcagttcaactcagtaaagaatacaaacaaaggccgggcatggtggcttatgcctgtaatcccagcactttgggaagccgaggcaggtagatcatctgaggtcaggagttcgagaccagcctgaccaaaatggagaaaccccatctctactaaaaatataaaattagccgagcgtggtggcatgcgcctgtaatcccaactactcgggaggctgaggcaggagaatcacttgaacccgggaggcagaggttgcagtgagccaagatcgtgccattacactccagcctgggcaagaagacctagactctgtctcaaaaaacaaaacaaaacaaaacaaaaaaatgtctagacgttagtaattattctttgtgatacatggaatagaagtcttcatgtttttctgtctatgaactaggggccaccatcatcagaatcatttgggctgcttgttaaaaatactaattactaggccctacttctgatgtaatgaatcagaatctctgaagtatggcccctgggttctgcactttcagtggcattcctggtatgttaaaatgttgatgcacattatagtttaagaattactgttttagtgctggcctggtaagtattgttttgggacctcttcccctgaggaaggcctatgggtctagcagtacagtagatccaaagccaaattatctgagtcaccaaacatttaatggcaacttaagattacaaaaaggtcctgtatttttatttatctcggtcttgacagtctgaattactgtggcctccatgtaaaatgtgaggcagttggtgaggactggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggtggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgagatttttgaattttgtgaatccctataggaatttttctttttggtcatttggttaaattgtttacattacatatgggagaaataatttgaagaaaaagcattttattttgatgagtatattattaaactatgtattataaagttgaatacctttaagatattactagtccataaagacaaactgaattttctaagttaataagataaatgcagtgtttaattatgtaataaaaaccatactttacaaattctaaagtacatgtgctttaaggactgcatatataggttaaaatttaacgtttaagttacgtataaaaaaatgtgggagagaggagttgcttccctgacctgatattttgagaaacttgtattctgctcttttaaaaatatcaacttgtttttgttttataatgttcaagctttgttttcaaatgaagatctaaatgaggaggtttcaggctgctatttataaacacttaggagcaaattagtccctcagtgccccccctccccacacacacacaaacaaaatcaactaaattagatataattatcactgtttcttttttttaacccgggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatatagtcaaaaacatcagggtaactactgctattgaactggatgataagggccttaagtggctaaatcgtgaatcaattcatctgctcgcttagaaactaaaatggaagccctcagattgtcctgttttaaagaaaatgttttttgtttggttatgagttttttgggttttgggggtttgttttttttttttttcttttgagacagagtctcactctgtcatccaggctggactgcagtgacttgatctcagctcaatgcaacctccacctcctgggttcaaatgattcttctgcctcagcctcctgagtagctgggactacaggcatgagccactgtacccggtctggttatgagtttgaaatatagaaattgaaacagggacttattgttgcctttaataagttgctgttggaacaactcgtgcataaataaatgccatcatatagacatacttttgaggtaggtaccaggatatttattgccactttataatgatgacaaaaacaataaagaaaacaataggccagacacggtggcttatgcctgtaatcctagcactttgagaggctgaggtgggcggatgacttaaagtcaggagttcaagaccagcctggccaacatagaaaaaccctgtctctactaaaaatacaaaaattagctgggtgtggtggtgcgtaccaataatcccagctacttgggagacagaggcaggagaatcacttgaacccgagaggcagaggttgcagtgagccgagatacgccactgtactccagcctgggtgacagaacaagactctgtctcaaaatacatgcatacatacatacatacatacatacatacaaataaaacaataataaaggtagaaagggaaaaatgggcaacagtgaaaatgtccctcaatagtggactaataattaatggtgcagtgggcattacagtggaaaagtgcagtcgtatatatcaacatggagagcaacttcagaacagtatatataatatgaaactggttttatatgaaataagtgtgtgtgtgtgtgtgtgtgtgtgtgtgtgtgtgtgtgtgacccatctggacagatatataccacattactaatcatggctatttgggggattgggagttgagatggagaagggttggataattgggggagattttttttttatgtcacacacttaaaaattgtgatgtggtatgtttggtaataatttctttttagccatgaacatgtatacaattatttaaaaaccaccatagcacaaaacaagaccaccaaattcaagtgttactccttttggaagcagttatgtcctctctttagcagtttttgattatttagataatagtacctttcatactctattgaaatagttaatattacgtgagctccttaaagtcaggcagtgtattgttacctctttatttccagggcttagccagtgtctcaataggagatacttaataaatatttgaatgaaggaagaaggtatgggtacaatatatggaagatataatatatgttattaataagcctgctaatatttaaagcagttaaaaaaaattttttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaagccaccgcgcccggccctagtttaaaaaatttttatgtcctaaggccgtctcaaccagttaacttttgccagattaaacattgtttttctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcctgggctcaagtgatcctcctccctcagtttcctgagtagatgggactacaggtacatgcggctctacaccccgccctgataatttttgtacttttattattattattattttttgagacagagttttactctgttgcccaggctggagtgcagtagcgtgatctcggctcactgcgacctctgcctcctgggttcaagctattctcctgcctcagcctcctgagtagctgggattacaggcacacgccaccaagcccagctaatttttgtatttttagtagaggtggggtttcgctatgttggccaggctggtctcaaactcctgatctcaagcgatccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgccttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctcttctttatgcttttatagtctggaaaagaactgctgtacatttttgcttctttatgcttttatagtctggaaaagaactgctgtacatttttggacacctactactatacaaccccagggagctccatctgaataccagtgaccacacataaaatcggtgaaagactcctctgtgttccaatctaggagtacattatggctttagaaaattgtggtgaagaccttctaaattgataaagtctgaaagttgcttaagtctgcagtaagaagagactagaaataaccccatagttgaaaacttggaaaaaagcctgtgtatacatttagccatcttgatccattactgtagcttttgttgagccttctggatagttagcaggtataacttatgctgtaaagctgttaatgaaataatatttcagtattgttttatttaaaaaaaaaagcctgacttctatgtggacttagtttttcagttacctgtacttttttatattggccatatcagcaaggaaattgttatgaaaaggctcttgggtaacatggagctcttgctttgtagctatcttaaaattctaattaggcagaagaaacactctaataaactcttacaatgggtatctcagaatcttttcagaatctgattccttcatcaatcatagtagaccttgattgaagtaggatttccttccagagtagttagaataattgggcttctattaatgagtgtcttgtaccattgtctaatatatattattgtttaagtggtttttgtgaatggccaaagtataggatttattgctttacaaattggcgtggtcagcattttgggttctatgtaaatagactgtggatacagataaaggaaaaaaaaaacagcaatacccaaggagattattaatctttcataattgagttgaatctttgggtttacagcaggtgctataattttaatccagaggagatgtgagcttcataaggattagtctttatagtaagttagggtgtttctccttgtaggcaaacatgtttaacattctatagatgagactatttaacttctaagaatttctcccagtctgtgcttcaagtttcgatgtagatacggattttctgttgtaacttccctctgtaaccgtgtttgtatctagcctcctgctaacttttaaccctcacatggaagtggggaaatgaatcaacaaacaaaaacaacgctttcttaaacacagggagagaaccaacatttaaactgtctaaaaagaaagtgtcttacataaggcttttatctgattaatagcctttaagttcttatcttcacaatttcttttgtggttcctttttggataacctcctttttgtcatttgtgcatgttttgtgttttttaaaaaaatgcaagtacagggaaaatctgttttgatataaatgggaatgatacgttgctgcaaatgacatgtctgtaatagtattgacattacctagctctcttctgcaatgtgaggttaataagtgatacacctctcataggaaacaaagcaacactttaaaccttattctgcatcttctagaggtttaaaaatactcacttcactaggtcttttaaaatcatctgggaaagagagaagtgatttttacttggatattgcttactatgcttatacttgtcagctgctctatgggggtgaggtagtaaatagttgtctaattcagaaaaatctcacctttaaaaaatattgctttaatgacagttatgcagttatttcccttaaaattggaaatgtctttatattaattttcttatattttccattgagaaagatgtataataatgatgtatcatattcttgtagaatctataggatcatttatatcttttcattgaactcactttatcttctcatattattcattcctttccattagagtgaagaaaaatatgtgcatgatacctattctaccttctttttagacatactgatagaaccatgtgttctgtcacattttctaaatggtatgtcagaagatgacagaatttcatgtgtagagaatactctgtgaaagattttatttatttcttgtcaggtgtatgaaatcatttcccctttttacttctttcttaaagccttttcatcatggcttcctggacactttccttgtaaattagctttcctagattgtatttctgtctttaatctttgcagttccatgtttcttctcttctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaaccttatgcttcagtgatattgttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctcactgcaacctctgcctcctaggttcaagaggttctcctgctacagtctcctgagtagctgggactacagatgtgtgccaccacacccagctaatttttttgtacttttagtagaggtagggtttcaccatgttatccaggctggtctcgaactcttgacctcaggtaatccagctgccttggcctcccaaagtgccaggatcgcagacgtgagccactgcgcccggctggaatatgaacaggttctgaattatcgaccccagtgctctaccctgagactctgggcatgagccaccgtgcccagcccagtcccttgttgctgtcaggcttctctacttgtttttcttacttatcttaacagaattgaaacctgcacatataatttttcctgtcgtccttctagagtcccctgtgattattagctaatcttttgcttcttagtttttgtttgtgtcaaaatttaactaggcttttttaaagaaaacatttgttttttaattaaatttttacaattttttttactttttttttttgagatgtagtctcgctctgtctcccaggctagagtgcagtagcacaaccttggctcactgcaagctccacctccttggctcaagtgattcttgtgcctcagcctcctgagtggctgggactacagctgcctcctaccactcctagctaatttttttgtatttttagtagagaccgggtttcacaatgttggtcaggctggtctcgaactcctgacctcaggtgatctgccgaccttggcctcccaaagtgctaggattacaggtgtgagcctctgtgcccgcctgtttttttgttttgttttactttttatcatataaatcttaaaatatgcaagatagaatggtataacaaacttggatatacctatcactcagctttagcagttatcagtatcttgccagtcttatttcatttattgcccatacagttgtttttgaggtggctcaaatattttaaatccaatcccagacctcgtatctcttcacccgtaagtactgtacttggtatctttaacagataaagacttgaaattacaatgttatcaagcctaacaaaattggacataattacttaatatcatccaataagcaggctaacctactttgatattttctcaattgccattctctagtctcgtttagagtttatttaagatcggctttactttttccttaaatgtttggaggaattcacagtgaagccctctgagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagaggtgatgtttttggtaaacaagctgggtaagatttgccgagttccttttactgtttgtaatctttccttagagcatacctgtgttggattaacagtataaataatagggtgtttattatattgtttattaatattaggctgtcagtggattattccggtctgatataagcttatgcagtggagaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttgctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgtatgagttccatacatctatctacattgtcagcaatgcttggtagtttagttttagttttagccattctggtgagtgtatagtggtgtcttgttatagttttaatttgcattttcctgatgagtaaagttgctaagcacattttcatgttactgtatcctcttttgagacttgcctatttttaatgatttgtctttttcttaatgatttgtaggaattccttatataatttggatgcaagtcctttgttagttatatgtgttgtgaatatcttctctcagtttgtagagaatatcttttcccaatctcttaatggtgtcattggaagacatgttcttaattttaatgaagttcagtttattactttttttcttttgtggctactgctttttgttgaaaccattatcttctccaagcttataaagatgctactctaggttttcaactaggttttacctttcacatttatgtctgatttatctcaatttttgtttaccttgtgaaccatagggggccaaggttcatttttcccccacatagctatccagttaacccagcaccatttattgaaaagatcatcgtttgtcctacctagtccttttaacatgtcttgaaactcaccactttctttttatttttattgcctgttgagttgttgttatttcatacattgttgattacagtagcagtttagattactcttagctgatcttcatgtccattctcctaacttcagtccgttatacacacaggtgctagaataatgtttctctaatgttatttttagtttctgttctttgttcaagaaataaaagtgattctgcatttcttatcatataaaaaatcaactcttggccgggtgcggtggctcacgcctgtaatcccagcactttgggaggctaaggtgggcggatcacaaggtcaggagatcgagaccacggtgataccccgtctctactaaaaatacaaaaaaaattagccgggcacggtggtgggcgcctgtagtcccaactacttgggaggctgaggcaggagaatggcgtgaacctgggaggcggagcttgcagtgagccgagatggcgccactgcactccagcctgggcgacagagcgagactccgtctcaaaaaaaaaaaaaaaaatcaactctccagactagttttcaaagttttattttccttattctctcttcctccaaattttaccaatcccaaactctgctcctgccaatataattttttcaccacccctaaagtcaaattgttcatttctgtgcctttgtacaaaccttctcttcctctttggaggtttctctctggtagttcctcataaaaccattccgagaagcttttagaatcagcaccgttgattttgttgtgtttctctctcatatcctatcaattatgcagacacacaatacatgtttctgctgttacacagtaaacttgctttttattcattttgtaaatgctgatttttttgttggtgtgtgagccattcagggcaggaaccatatattttacagtttctacagagaaccatagaattctccttacagtgttccctcatagacgtttaattaaaattgaccaattatattatataactgacaaggtttacataatataatttattttcattttagcagctgtattttgataaaaataagaattgctattatctcttcatgaacataaacaaatggttataaaatcagagagtttttcccccttgtatttgatagttatatatagctatatgtttcactgttgttgcgatgttatgtcctaggtgaaactgacttttctcttttctccattttatgtgtatgtgactttagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtaagcatctttcttcccttgttcttttggttatttttagttcttgatatgctagagagttttaaattattcagctttttagaactagacctttccttgatgagcagtagtgtcctttgataaaggacaggattctttgtctttagtaagacaaaattataattaatactgttcatcatcggtaatggggtatgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttcttttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgtttctgtacaagataaatgaattttaagggtgaccatcaatctatgaagagaaggccagaaaaataacaagtctattacaagactgcctacatagtaggtacttaactgtggtggaattagagaggcttttctagctagacccttgcaaaagagatttttgtcaacccaatgactataaagatgcccaacaacgatttatttaccaatatcattggagggctgacatcttagatatgaaaatatgtgttcccagagatgacagacacaaaacaactgcactctctgctgcatatactggcatcttctcttctactttatgaggagttttatgtctgggatttataccagccagtagaggttcatttactttttggctagcagagagtctaaggaaatagggttatagtcatatctctgtgggttgtgcattttactaatggaaaatcactgcttctagaatttatacattgaccaagctgtggactccagcttatattgacacaaatgagcacttctgttgtctttcttgggaatataagcaaatactttttatattcatatctttaatgattgaaactgactgaatagcttcctcatatgatcattctacttatattgctgtatagcctccttatagactccggagagtgacaaatatttaaatgttcatggaggctcctaagaatcccttataaaattaaaatagctcttccttttctgttcacattcaaccacaaattaaatattgcatcctcctcaagtttattacattccctggtggggaagcttagtaaaggtggactcattgaacctaaaaatgagaaacaaacttcaagggatagaggggagaaagaggccctgccttttcatgttgccagacccaggaccctgcttgacccactataaacatagaaaaaaagagacatgttactttcatttgactttgtattagctcatgccaactccaaaaccaatgggttttgtcatcatattttacatagctgcccagtcatctgcattagaattcctgcaagtattgtatcaaagggaaaagctgttagaacctgcttggattgtagtagccaaagttgcacacaggcctatttcctttttttttatataagggatattcttttggggatgggaaagttgttgtttttctaattggatttctaaatatgcaacctttgctagataggcccagttatgtttttatgtaactctaaattttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgagacctagagtctgcgtttctaacaaggtgacactgaagctgctggtccatgggccacattttgcatagtaaggacatagaatatcttgtgaccactgtgaactacttcagtttagtgtttgaactgtagctacctagatgctcagatacctttttctttttctctctcttttttttttttttttttggaggtggagtttcactcttgttgcccaggctggagtgcagttgtgtgatcttggctcactgcaacctcacctcccaggttcaagcgattctcctgcctcagtcttccgagtagctgggattacaggtgcccgccaccacgcccggctaattttttgtatttttagtagagacggagctttaccatgttggccaggctggtctcgaactcctgaactcaggtgatccacgtccctcagcctcccagattgctgggattataggcgtgagccaccacgcctggccctttttctcttgacttcagtagtaaacagacttctggaaagagggctcctcctctcccttaaattaattcagagggcaagaaacttattaaattattttgttaaagctctttcttttgccctgtagggagaatagtgtagctaggagtggtagaattcaacccaaacccctgtttaaaatatggccatagttagaattgtgtggtggtttgggaagcagcgtttaggttagctcagtgatcatttcaggaaggctatcaaccaggccactagactgttggttctatttttatcatgggtttctaacagaacctcacccatagaggccagtggtgtactgctaacaaagtattgcctggttcctgatgaccatatggttctcaactctatctgcagaattggtcccacataattaccagtttaaaaaaaaatactctctagccattgaaactataaagaaaaaaaatactatcaatacttgagtccaggagtaattaaataccacctctgggaggcaggacctagacattgctatttttaaaaagttacctgggttattttaatcttgcagccagtgttgagaacattaaaccaaatgaaattccaaatggagttaggtagagatgttaaaaactgatctctaagccaagacagtgaccgccacagaagaatcatattctcgagatcctctttggcacctcctacaaaaacagatatctctgactttacttttgttcttttccccctgaatatttttctgttatgatattctgtgaggttatccatcgtgtcagaagttgactggaagttgaatttgaccaatttagatatggtcgctcagtcccagggtcctttttatccttgcttacttgccataattggagaccgaaaattgagggcattttatattttggattgtctaaccattttctattcttctatcttaaaacttgatattcatgagaagatatttttattcttcctttttcatagcctggtgatcttcccttagatcttgttctgtttcatcttcttttactgtcacactcataaaattcggccagcgttaagatgtagtgagttgtgaccttttcttattaggttggagcaaaagtaattgcgatttttgccattaacagtatttacttttgctccaacctagtagaactgtcacagtcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtgacctgatgcccatgtgtataactcttgcatatgtgttatgtgctcatgagtctgacatctgcgaggatcactgaagtaataattgaatctcaattattttcttgcctttacttccaatctgtcagcagaggccttggctaaattacagccttttgttcatccaaggtgctgtgcattattcttttacataaacagtgctattgtgtatatcaaaaatggaaaggaagaattatccaaagtgccctttctctgtgctgatgaaggatttcatcctggagaaatatgctgtgtgcccagcttgagtggtatggaattgaagagaaactgccttttcctgaccctcagtccatgtttttcccactgtttctttcaggtttttacctttcagattattaagtcataagctatttattaatagttttgagattttttagcccacaggaaatccatcatctatactagttttgcatctttatttttcttcctttggaggagctttgcaatgacttaaaagtttagtttttagagtttgtgttatgtggaaagatctttgtaagttgttgcctgttaaatttctcagtgaggcttccataaccaccatctttgtatcagtgcatacgtttagtcaaggctggcctcagacagttttgagaataattactaatttctgagttctagtccctgtgctagaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaatacagcttgcttgccctgggcctcttgatggtgtacatcccaggtccctgagtatatgagtttgggttaatgtgtcacatgaaagttggagaaggactacagaagtgtgttcattcatgaagaaaagagactgaataatgagtaagttcatgcacctttcttgcagcaagaggaacagattgttcatcttatccttatttatttatttaaagacagggtcactgcaaccttgagctcctgggctcaagtagtcctcccacctcagcctcccaaagtgttaggatttacaggcatgagccactatgcctggtcattttattttcatttaagtaaaaccacaaaaatctccgtttcccatctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaagtagctgggactacaggcacatgctgcacacatggctaatgggtgttcattttttttcctcagttggttctattcatatgtttgtcaatgttgatgcagatattgtgctctaagtaaacaattttgtcaggcttttgtccttttggtgataattttccctaataaaatgattcacttcaagattgtctcccaggaaatactgccagtagccatatatatattactgccagtagccataaatttatatttacgaaacattcattcattcaataagtaaatatttgagtgcctagtattcaggctctattctgtgtactaggcatatagaatggtccttgcaaccttacgaaacagtccttggaagcttacattcgcgtaggggagacaaatgataaagtagcaaatgctgtgaaacaaagtgagacagaataaagaggttctcttgttgatttttactatattcatcattgagttctgtctgacctaagagacctgtggtgaccattctaaggactttttgtcttacatcaggaagtaatccgttccatccccctacttttccactgatagaagccttttcccccctcaggttatggagtcttctgatgatttttatatgatctcaatgcgtttatgctattccttatcaagtctgctcttagccatcagtttattagcttttgcatggttacagagtctttccaccaatttgattaattatattttatgatgctttttggaatagctttttttttttttttttttgagacaggatctcactctgtcacccaggctagaaagcagtggcactatcacgacatactgcagccttgacctccctgggcccaggtgatcctcccaccgcagcctccgaactagctgggtctacaggcgcccaccactacacccagctaaattttgtattttttgtagtcatggttttgccatgttattcaggctggtcttgagctccggggcccaggcaatccacctgcctcagcttccgtaagggctgggattataagtgtgagccactatgcccagccttgaatagctttttgaagatcatattaaaatttgcagcctagtagctaaaaaccatactttaacctacaagatactgtgtgccatctaaaatttaaactctgttagaaagacacacactgatggttttgataccaataggattttgacgatagttaagttttattgtttgtgaagggaatcattgtatactatttttgcaccattctgttgactcctgaataatagagctattggtaagctatatggcttggagcattccttagattcccttcaattcagtaagttctagaaaacagtaaataaaagagacactagctctaaacaggagcatagaaatgtctgagcttaagatatacacctgcagttaagagaatgtcttcagatacctagacagctccacagttttagaagcaaacagatgtactttggactggccagacataggtcaaaggggctaacccagatcagtcattatgataatttgtgggattttttttccagtccgctcagtggttatctcagatgatattcctttataaaatttaaaaattccttttcaaattttcttttcttggagtcaggcggatttattcccctatataacttcaatcttgagttccttctctgtatttctgctgttgtagcacattgccattggacaggggcatttccttttgttatctatagctgaactgagcctgtatgcaggctcagctctgagacttttggctctacctggctctacagagctcatgtaaccatgccgaaatccctttagcccataagttacaataagtcaccataaaacccctgttttctgtccagttactgaacattattgtgcaatgacacattattgtgtagtttaacatgaaccaagttccactcagcattacttcagatgtggtaaagtgaccactctttggcagtagacaaatgttagtattattctcagtgccatttaatgagtacagcaattatgggggactacaccactagcagaaaatttggatttaggtatcagttacagttttttaatacagactgttcaattctcagtatttgaaatattcttttcctgaagttgccgtctttcccccttctttctgtatctgatttagttgacctataattgacatcattttcttcatggagaaaatggcagcctcagtaaggcaatcctgggaacaatagtgagtggacacctccaagagacacttaaaacacagtatctagacatttaagatcaggatcaaagccataccctgcactcctattccttttccctcctgtctcctaccagctcactggataacagatatcactctgagttttacaagttctagtttgattgattttgtaccctacctgataagtatgggcttagagtatgtccagacagatgaacctgaatcccaataatctcaggctgggtgcaatgattcatacctgtaatcccagcacttcatgaggctgaggtgggagaatcgcttgagcccaggaagttagagcccagcctgaacaatgaagtaaatttttttctttaaacaaatagtgtccaactgaactgaaatagctactgtctagttcaggctgatatacaacaactttcttgtgtagttgttcactttctagctttcttttttcttgatgagtatctccttcctcctgtttatcacttgtagataggagaggccactcactgggtaattcgcttccattcctgctgacatctccctattagtcactcacacccatcatcatgctgtcaccttgccatggtttcagagagtaggataatctccattagaatatttttcagttaagagggaagttgctgaatagtccgcataagctgtagtcttgctagttagaaaacatgtatagtattgaaattgtcctttccctttgctctctgaacatagtacaattaggtgaacctttgtatccctggctgtgtctctgatatcttttggaccctgtctttgtgtcagatcagagttcatgtttctagctgagttgtatctgatatactgaacataaacagaggaatgtcaagattgcttttcagttcttcatgattttgaataaaattgacaagcactgggggacagtactttcagatcctttccagctaagataatattcatatatcattcaacgataaaaagaatgaaatctaagaaaataagggctatgaatgtgctttctttcctttggtctaaacactacccatgaatctcttttctcaatgccttttattgaatttagcaaaactgctgtttcctttccaatgtgtttttctttcttgctgttctgtgccaagcaggttcataaagaattctatctctttgaatcttggattataagcctagccagaagaggggagaataagttgcggtgagagggggtaagcccatcagaaagtcgaaaaccacctcagagtatcaggacaaatgaaacatttttcgtaggatcctttccatgggttttcctcgctgctcaaattttttttttttttttttttttgagacggagtcttggtctgttgcccaggctgtagtgcaatggcatgatctcggctcactgcaacctctgcctcccaggtttaagcaattctcctgtatcagccttctgagtagctgggactacaggttcccgtcaccaggcccagctaatttttgtatttttagtagagacgggtttcaccatattggtcaggctggtcttgaactcctgacctcaggtgatcaaccggcctcagcttcccaaagtgctgggattacaggtgtgagccaccacgcccggcctctctgctcaaatcctgacttcctttttattcacaagttccaaagtcatttctgagcagatgaagtcttgtctgactctaaataactgattctctaacggcagtgttttcaaccttggctgtacattagaatcaactggggaagcttttcaaaattctgatgcccaggctacaccccagaacaattaaattaccatctctgggggcgagtactttttaaagcgctactctctgcaacccccacacacagatggttgattccattgtgtatccaaggttgaaaccatactactgaaacataattgacatagttattagtattcttagaaagcttagtctaagaaacctccaggtttttatgaaggggaaattaaaaaattaaaagacagcctttgcaaacttattttgtatgagtatttttttaaaacacatatcaaccctgtgttccagtctaactggccttttcattcttccatgctttcttcacctttgttcatgctatttgagaaatggccttcccccatttttgctttttataattccaccctaccacctttttgaagtttctcttcattctttcagccagagggaggttcttcccttcagaacttcgcttttttgctttagtatattctgtatggttttgcatttgtgttttatttctccagctagtttgcaaagcttcattcttatctatgtagtcccctcattgccaggcatctttatatcccttgtaatgccttgcatccagtaaatgttatgtaaatgtttgtttgaataaaaggaatttcagacgtcatgctgcagatgtgtgctatgatagaactagggagaaagcagatgtgtaatatcttttctattcccttcacacttttctagttactcaaattcttggtttggggatgcctttttttttttttttccgagatggagtcttgctcttgttgccgaggatgaagtgcaatggcatgatctcagctcaccgcaacctccgtctcttgggttcaagggatgctcctgcctcagtctcccgagtagctgggattacaggcgcctgccaccacagcctgctaatttttgtatttttagtagagacaggatttcaccatgttggccagggtggtctcaaactcctgacctcatgatccgctcaccttggcctcccaaagtgctgggattacaggcatgagccaccacgcccagccaaggatgatctttttatttatttaagtatgtgattttcatcccctgtgcaaccattaagtagtcttcaggaatcagattctggaaatgttagctctggtttggaatgcttatagtttacaacagagcatgcttgctaatgccagttatgaagcacctaccagggttattttctttcatggtttaaacagaactttgttgtagtcgtcactatttttcaatatttaagattaatttttagatttttgagaatgccattttatgtactactctctgttcattgagaagataaatcctctttccccaatcttaaagatacaaaataatttttacagctcaacgacctgcaactttctaccactaaatgactataaaggagaatgtgcttagagcagacaaggcatttgatgattcaaggaagtgttttagatgcacagtaagaactagggaagaaacaactgtggaactgtagcaaaaagtagattttgctttttaaacagctccattagttgtgtttatgtgtgttttacattgcctatatgccacctattttcagcttgagttctttaatgtttttgtcaaggaagaccgacttcagagtgaattatatctatcagaatcctgagaaaaaaagcaagactaagaccatgtggagttattttcttgtcagctaggtaattcagttagtctgattctctaatgcgtaacatcctttttaaatgatctccaaataaatccacatttctccttagtagaattgactgtgaaagagatttgaagcactgcatgcttccccacttcctccttagatagttcagatattttcttttttaggaacattccaaactctaaaaatcacttttgttccacctataatttttgcagcttgaagttgcagctcaatactagtttggctcttactttttcagtggggcagcaggttttgtaaattaaaacacattaattgttttgttttttggcttttccttttccaacacctccccaccctttccgtccgccccccactataagtttccttttaaagaaaaaataaagcatattcgaaatattgccgcttggggatagagcgtcttagaatatgcaaactctttaaatcttgtttgggtttgtgcctgtgtaccccagtgcaaagattggatctgaaacatccctgagatgtcccagctccgtcttctttccaagttttctccaaactgatacaccatcactaccaccacttagttcccctagtacatatttctttgtaatctagaatttttttaggctttgggagacaagttgaatggcatgtatttccagcaacttggtagagcaatttacagattctatatgggcatctagtatttagctaaatgaactctacctctctctcctctctctcctttctctctttcagcttggcagtgaccttggcgggggcattggaggaagtccggcagtaagtgccatctgtttttttcaccatgagaagcactgccccctgtttgatgcctttcctatgtacacattatcagaccagccactgctgctgtctagcactgcacaccaaaacctctataacagtatatgggtagtagaaagtagtatagggttacttggaattgttggggtcatgcaccacatggtgtagagacatctttaaggtttaatgttccagtgcctatagagatctttgtctttctgatattaaagagctaaaggaaatggacccttccatcttgactggagaatgcttattccctggtgtcacctagaaagaacttgagagggtcagctggactcagagtgagactctcctcgtaaatgagttagtttcaggggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttcttatcaatgatgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatatagtcttacctttctgaggaccaatttggctgaattctctgctttctaatctgactccttatgggggatccctgctatagagatgtagaccagttgtccattccaggagttgtaactgtgataactgagtgtgtatagttattacagtacatagcaaaaccgaagatattcaaaattgagccatagtgttttggcacaactcggtagctttgttgtaaggtttactatatgggatattatcttcagacttttaattattagttatctaatgcactcatttactaacataaaagtattgtatacaaatgaccaacgtaaataatgtaaaaatgtaagaaggaaaattgtctccccctgcccccatttcccatgtatagccactgttaactttcttgtgtgtcctttcaaaagaaaaagatcatgcccatagctgtatatttgtatcctttgaacattccgtgtcagtgggatatactattttgcaccttggtttttctctaccatattcttttgaatccgtatatctactgaattgatacaccataatttatttaatcactcctctgttgatgaacatttaggttattccctggtcctccccaccacctgccactcttttagtatggctgagtacattatcatgattattcaccacccacagatcctttggtattctgtcttaggtggtcagaacagctcatgactcctgatttttttattttatttttttttagacggagtctcactctgtcgcccaggctggagtgcagtggcgtgatcttggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgagcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttctttatttgttaaaaaatacatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactggttaaaaactcacatattgggccaggtacagtggctcatgcctataatcccagcatttgggaggccgagacgggctgattacctgaggtcaggggttcaaaagaccagtctggccaacatggtgaaaccccgtctctactgaaaatacaaaaatgagctgagcatggtggcaggtacctgtaatcccagctactcaggaggctgaagcaggcaaatcccttgaacctgggaggccaaggttgcagtgagccgagattacgccaatgcactccagtctgggcgacagagtgaaactccatctcaaaaagaaaaccaaacctcacacattggcagatgctgtatgtagagtgagccctggctcttgcaagccttttcagttatcagcttcaactctggaggcactagggagtttgttgggaaactcatccaaatgcgatgaagaaaccagaacttatttactatcttggattctaggattagaacgtttttgataaatttttaactgaaatccatttattcattcaacaaatcattgtttaacattagcatgagccagacatttctaggtactggggctagagtagtgaaccaaacaaagctcctgactgaaagttcacattttggtgggggaaattagcatatttggttggtataagaaatatggaagtatatatgctgaacaaataatcacataaaccttgacaacctccttttagcaatgaattctctgccttaataaggaagagagcatgaagaagtaaaatgttaatgtcttattctttttgaaacatcagtgggttttattcagttttatggttcaggaaaatggctgttagaccttaatggcatgtccattcatttgtaaatacaggatatttagccctgcatataaaaagtagtaattggacccttaaagcagatttcataaaatttgtcaatggcaatttgcataagtgactgtctgatttatttctcatcatttggaaacacttttgtactctggatttgagagcttggcatgttaaaaatcatttaactatctagaaagtctgtgtttctttctgtcaagactaccaatgtttccagccatttttgaggagctggccctgttaaaggccagggctgttgggaaaataaataaataggccaaggctattggtggaattctgttgtaataaaggaaatctgcagatgcagagtctgcattcatctctagcctttttttttttcctttttttttttttgtggggggatggagtcttgctctgttgcccaggctggagtgcagtagcacaatctcggcggctcactgcaacctcttttgttctgttccattgttttgtttttgtttttcttctttggggttttcaattattcatttattgactctttgtttatcttttatatactgtttttctctctaatcgttaaaaaaaatcatcaaattcttttatatcagcaaataaccaattagtgtcagattttcacagttgtctaatgtttttgtactgtttactttgtctgaacagggtcccaataaggtcccatacattgcaattggatgataagtgccttaagtccctttaaatctataggttcctcctcctcctctgttttgttccttaaaatttatctcctcctccttctctgttttgttccttaaaatttatctgtagaagaaattaagtcttttagtgtggagtttcccacagtctcaatcttgctgattctacctgtaaattggaggcagattatagatttaatcagatttaggctcatattctggcagaaagccttcataattggtggtgattgcaaatcctgtttctcttttagttatttatttttctttttctcattttattctctatgtttcttaccatgtttactatgatgtctgtttccttgttctttgtaagtcagtctttttgtcactataattgtaccttttctataattttttataaatgaaattacataatatggaatcttgtatctggtttctttctattagcataatgcttttgaaatgtgtatatcagcagttgatttcccttttgttgttaagtaatactccattgatgaatatacagtttgttgacgtgctcacaagttgggggagtttggttgttttcagtttcatctttatgataaagttgccatgaacatttgtgtatacatctttggttggacatatgtttttgattttccttggtaaataactaggaatgttattgctaggttatatggtaagcttgagaattccagatattccacatcctcaccaattttagccattcttgtcgctgtgtagtagtgtctcattttaatttgcatttccctaatgactactaattttaagcattttttaaaataagcatattggtcgttcttatatctttcacttaagtatcagctcaaatctttgccttttgttgtttttggggggagagagaggatcgtcttattatggagttgttaaagttctttgtatattctggatacaaatcctttattgcaaatattttttcccagtccatggcttgccttttcttaataatgttttcaaaaaaaaccaaaagggtgtttttgtttgtttttttgtttgaaacaaaggcttgctctgtcacccaggctggagtgcagtggcacaatcaaggcctactattgcctcaaattcctgggcttaagtgattctcccacctcagcctcctgagtagctgggactacacctgtgtaccaccacacccagctaatttttttatttgttgtagagatggggtcccactctgttgctccagttggtctcaatgtcctgggctcaagtagtcatcctgccttggcctaccaaggtatgggaaatacaggcatgagccactgcacccagtcgaaagttttcaataaagtcaggttcatcagttttttttcttcttatgacttaggctttttgtgttctaagaaatctttgcttaaccccatggttacaaagatttttttggcatgtttttaaatataagccttatagtttttgttcctacatttagttttataattcattttgagatcgtttttaaatatgttgtaaattaagagtcaatgtaaaaactttttccgtaataggtcttgaaatcagatggcctaagtcctgcaactttttttcttttcaaagcttgttttggctattcttggtcttttacatttccctgtaaattttagaatcagcttgtcagtttctacaaaaaaaatgctgagatttttattggaattgcagtgaataagtagatcaatttgagggagaattgacatctaaacaatattgagtcttctaatccattagcatagtatatctctctgtttaggtctttaatttctttttgcaatgttttataatttttttatgcacaaatcttaccttttgtcagatttaagtatttcaaatttttgatgttatagtaaatagtttttttttttttttgagacagagtttttcgcttgtcacccaggctggaatgcaatggtgtcatctctgcccactgtaacctccgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgcccttggcctcccaaagtgctgggattacaggtgtgagtcactgggcccagcagtaaatagtatttttaattttaattttttattattgctagtatatagaaatataattgatttttatatattgaacttgtttcctgcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgatgttagccataggtttttcgtggagcttgaggaagtttcattctgttcctggttttctgagttttattatgaatgggtattaaattttgccagatgcctcttctgcatttactaaaatgattatgtgaacttttttagtccattaatatgatggattacatcagttgacttttcaaatgttaaaccaaccttacattcctgggataaatcctacttgtttaggatgtgttgtctttttttgtgtattgatggagttcattggcagaaacttttttacatctatgttcatgatatatttactcttcatttctgatatgatttacttttttttattatttctttcctgagttagattggctccctttaccttttcctgttgtcttgccctcacctcacattatctggtcatcccttccccagatgttttcttttactgttgtgtggtcttccttggtagctagcattgttgtttgtttgtttgtttgttttgttttttcaagtatgttttgtttgtcattaaggaagttgtactgctgtctttccacttttttataatagggctttgaacagttgctgtgttttttaccattatgatactcatatttgaatgagttggaatttgcaggactagctattagtagacttctatagaaaaggaagctaggcgggtagttttttagactttgctcctcaagaacgtttccttctttgctctggtgtagccacagcttcttagcctctctgaatctaacttgattctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattacaggcgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaattttataaacgtcgtagtcccatcttccatcatgtggctatttagaatataaattcaatataaatttgtatcattttgtttgttatcttctaggccaattttttctttctgcttcatctttataaaattttgttttcttcttttttttccacccgaaacagggtcttgctcttttgcccaggcatggtgcagttgaggctcactgcagcctcaacctcctgggctctcaacctcctggactcaagtgatcttaccacctcagcctcctgagtaacagggaccacaggaacacaccaccacactggccaatatttgtaatttttttccagagacagggtttctctatgttgcccaagctggtcttgaactgctgggctcaagtgatccactcgcctggcctgggtctcccaaagtgttgggattacaggcatgagccaccatgcccagtctatggttttggtttttttttttttgttttttttttttttttcagacagtcttgctctgtcgcccagcctggagtgcagtggcacaatcttggctcactgcaacttccgcctcccgggttcaaacaattctcctgcttcagcctcctgagtagctaggattacaggtgcctgttacctggctaatttttgttgtatttttagtagaaatgttgtttcaccatgttggccagcctggtctcgaactcctggccttaagtgatccgcccgctgcagcctcccaaagtgctgagactacaattgtgagccactgtttccagccccagcctataaaattttatccttatgcttctcagaccatctgtcctcccacatatgtatttgttttctatttaacttcagattcagactgagtttcccatctctttaccattcttatattattaaacaagttttcctggataaaactggtagctattcattgcctgcctgaagcttagaaagtggccatgtttggctctacaacttatcctaattgtttggaatttataagccagtcaatgccacttagactagctctttcccagtgattgtgtcctatgtaagtgaaaaaaaaaggaaagtgagaattaccagtaaataatcctctggacttatcagtcaggttatcaagcctgtaaaataatttattatacttctctttacagagtagaaattggttttcgtttttgtttttgtatttttaaagacagggtgtcgctctgtcatctaggctggactgcagtgatgcagtcacaattcactgcaacctctaatgcctgggatcaagcaagtgattctcctacctcagcctccagagtagctaggactacaggcgtgtgccaccatgcccagctaatttgttttcttttattactttttttttggtggggggtgggcagtaaagacacggtctcattatattaagtgaccctcctgcctcagcctcccaaagtgctgggattacaggcgtgaaccaccacacctggcctcagggtggaaattcttaattcttctttctcccaagaattatctaaggaaagatttattaaaaatgatattcatcaaacctgccctctagtgacgttttaaagagaaggaactttcagagttatagcactagcaaagcagttctgcacttaagaatattttctccttcctcaaattcatttaatggaaaacagaaaattatgatgtaaccagtgttatagcaaattggcattgagcaccttgattcctgctatcccttttatttaattgtattaaaaattttgtttcctcacctgtaatcccagcactttgggaggccaaggtgaccaaattgcttgagctcaggagttcgagaccagcctggccaacacggtgaaaccccatctctactaaaaatacaaaaattagcatggcatgatggtgcatgcctctagtcccagctacctgggggactcatgtgcgaggatcacttaaacctggaagttgagggctgtggtgagctgagctgaaatcatgccactttgctccagcctgggtgacagaatgagaccctatctccaaaaaaaaaaaaaagtttcctttaaatggagcaaaatgccattaaaacccaaagatatggcaaaatcctgcctctttttttttttttttttttttttttgagatggagtttcactcttattgaccaggctggagtgcaatggtgcgatctcggctcactacaacctccgcctcccgagttcaagcgattctcctgcctcagcctcccaagtagctgggattacaggcacccgccaccacgcccggctaatgttttgtatttttagtagagacagggtttcaccatgttggccaggctggttttgaactgctgacctcaggtgattcacccacctcagcctcccaaaatgctgggattacaggcatgagccaccatgcccagcctaaattctgcctcttgattaacctctgtgatttatgtatcctctcttctagctttggtgtcatccccagcactcctctggccatccatacaccactgatgccaaaccagagcattgatgtctccctgcctctcaataccttgggcccagtcatgaagatggaacctctgaataacctccaggtcagagatttacttcactcaggtggtacaagttaatatcttgacaattattattattattattatttttaaagacacagtcttactctgttgcccaggctggagtgtagtggtgcgatcttggctcactgcaacctctgcctcctgggttcaaatggtgctcctgcctcagcctcccaagtagctgggattacaggcacaagccaccacgcctggctaatttctgtatttttagtagagatggggtttcaccatgttggccaggctggtctcgaactcctgacctcgagtaatctgcccacatggacctcccaaagtgctggaattacaggcatgagccaccgcgcctcgcccaatttttcatttacatgtaaaaaagtccctctttcttccttaggtttgagttagtcatggaatcggatttgaaataaatctttgtggacgagagttttatgttttgttgttaagaaaaacaaaagtcatgcatgacatagatattcattcttttactcaacaaacacttagaaacttttttcttaacttcttatttgtaaaccttttttccttaagacttttatagcaaaatttgaatgtcattaatataagaagagatttatatggaggttatcattgaacattggaccacaggtagctaggctgtttggatttaaatgccccattagcacctatctatgataagtataacagcatcttagaagaattttatgtggtctacaagagcctctttatcttgaaaatgtcgaattttttagaatgcttgggtgtcagcttagagtttcattcagttttcacctacctcgaagtttcctttgaaatataaaccttctgggcttcaggcaacatgaaggcagagcagtaagctcataagtcagaactgtagcaaccctggaggttgctagcggttatggttttaatgttcacaagaacaggaagaaagccttgggccacccagaaatggggaactgtaatcgatccctgcataaagcagagaccctggaagggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactatgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttggctcagacaagaagaataaagcaaggattactatgcagatggaattggctgttactatgatgacagtaatgtgttaaggggcttttccagcacaggatcctgaagaaacttaacccaaatctacatctgttcccttttcattgaaatctaacctcccattggccacagagcctcaagcctaatatttgaggacagtcagcatgcacgcaagaatgctttacctcataagtaggaaagagaatttgggtcacagaaaccagggcaaattttctgctcttaaaatgaaaagaaaaaaaagaaaagaaacagtaaacaaattaatgaatgtcagtttactttcctgttggcatttccatttgactaactcctgaacaggaaccctcacaagagaagttgaatcttagtccaaccctttcctcaaaagtattgatgtgatattagaactagcaagttttaattttcataaacctgatattataagaagcaaactttaaatttttccatctatagttaactactgatttttcaagtttcccacatggattctcttcttttggggatgtcataattgtggctattttctcattaattggcatttcccaatggatatgataaacaaaacttgaaaagagaaaaactttttccccctgtgagcagctctacttagtgtatgctggtgagagttggaactaatgtaatggctagcttagggatgtgtagggtactttagatttcagcttccattctgcccttttccccgtatgaacaagaagaaaatcaaaacatcattccaacaaggttaaactatatatacatccagataaagccaggtaaagattgatctagcttttaaatatatttgtataatgtttagattcaagagctcatgtgggaaaattagtatttttctagtactacagaccataaaattgggaaaaaaaaatgttggggattgaggaaatgaaattttgaattccatgtggattttagctattttggctaatttaatatcaatgtgtagaacaattaaatcaagcccagctgccagaactgtagtataaaacttattataaaaacttttcatcagaacactcattaaactacttattggcttatagactatttgaaacactatttaaaaatttaaaagataccattcattcttttttttttctttgagatggagtttcattcttgtcacccaggctcgagtgcaatggtgcaatcttggctcactgcaacctccgcctcccaggttcaagcgattctccagccttagcctctgagtagctgggattacaggcacctgccaccacacccagctaatttttgtatttttagtagagacggggtttcaccaatgttagccacgctggtttcgaactcctgacctcaggtgatccacctgcctctgcctcccaaagtgctgggattacaggcgtgagctgccatgccctgcctattcattcttaaaatgtaaaatacattatgccttaaatatgggaattaaatacctagtagagatttgaacctggaagaatttttctactatactgacatcgactgtaaaagcttttgtgaatcagcttataaacattatacaaagtaaagttaagcttgctcctactgggagcctttcttgagtttatttatatcacgtaattatattccttaaaaagagaattgattctctctgtttaaatacagcagaaaccttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcaagttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggctaacacggtgaaaccccgtctctactaaaaatgcaaaaaaaattagtcaggcatggtggcaggtgcctgtagtcccagctaattgggaggctgaggcaggagaatggcgtgagaatggcgtgaacccgggaggcggagcttgcagtgagccgagatcgcgccactgcactccagcctgggtgacagagcgagactccgtctcaaaaagaaaagaaaagaaaaacccagtcctgagacttttctccctaacaagacctccaatatctcctcccacaaagccaatttcgttcacctcttttgataattacctaaataacatgctcatattgggactcctggatttttatttatttattttttttgagatagggtctcactctgtcacccaggctgatggtgcagtcatgagacactgcagccttcacctcctgggctcaagcaatcctcccacctcagcctcccgaatagctgggaccacaggagcacaccactacacccagctaatttatattttttaaaattttttgtagagacggggtctctccatgttgcctaggctggtctcaaattcctgcggtcaagcaatcctcccaccttgacctcccaaagcactgggattacaggtgcgagccaccacacccagctggatttttctgttttagatattcctgtacatgtccccactcactgccatcatctacatacttttcatgttcccattttttctgacagaactatcttaaaatttacttaaatcagtgttcaatgtttacatcaatttttttttttaagagataaaatcttgctcagtcacccgggctgaagtgcagtagtataatcatggctcattgcagcctcaaactcctaggctcaagcgatcctgctaccttaggagaatctcaagtagctgggactacaggtgtgtgtcaccacgcctagctaattttttatttttatgtagagatggggtctcactgtgttgcccaggctggtctgaaattcctgggctcaagtgatcctcctgcctcagcttcctaaagtgctggaattacaggtatgagcctccacaccctgcccagtgtttacattattatgactgcatatattctttgaagctgagccatatattaaagtgatttttcctcaataaaactttttgtagataattggagttaatacccatttatgttggtgtttttaactgtaattcaatcccaaattccattgagatcagacccttcaaagtatactattggtttccctttcttaaagtctcttctagactgatttacttgaatgcctggaacatagctgtcttcctgggacctcctttcatcttaaccctggagattcattcccttcatcagctctctcctactcaggatctcctgttatagtgtccttttcttggtttactccctcttttgatgaaacacattttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtcttttcacccatcatgctgggtactcattgggttctttaaaaccggaaactcatgtccttcaattctaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaatacaaaaattagccaggcatggtggcacacgcctatagtcccagctaatcgggaagctgaagtaggagaattgcttgagccagggaggcagaggttgcagtgagttgagattacgccactgcactccagcctgcgtgacagaacgagccacaagcctttatctcaaaaagaaaagaaaaacacttttttatgaaacatttttaacattgcagaagtaaacagaatagtataacgagcccctgtgtacccatcatccagcttcaataattatccatggttaatatcatttatacccctttccataaccctactctattgtttgaaacaaatcccagacatttatatcacttaatctgtaagtattttagtatgtctcgtattttgtttgtttgagatggagtctcgctgtgccgcccaggctggagtgcagtggtgcaatctcagctcactgcaacctctgcctcccgggttcaagtgattctcttgcctcggcctcccgagtagctgggattacaggcacgtgccaccatacctagctaatttttgtatttttagtagagacggggtttcaccatgttggccaggctggtctcggattcctgaccttgggtgatccgcccttgtgggattacaggtatgagctaccacccccagctcagtatgtgtctttaaaataggtctcttttaaaaaatttaactacaataactattctcacaacttaaaaaattagcaagaattccttaatatcacatatcgaatcaatgttcagattttgtcataattttttttgttttattatttgtgtttgaatcagtaaagtgcacatattatggtgggttgatagctcttaagtctctttagctacactgtttaatatgatagccactagccacatgtggctatgtacattgaaattaaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgtatgtagttgtttttcttgtatttctctggcttggagctcactgagcttggatctgcaagttgatagttttccccaattttggaaatgttttgtcattcttcagattttttttctgcctcattatgtctcttctctccttctagaactccagttacatatgtgttagactactggatatcatccctcagatcactgaggctgctttttttaaatttaatctttttttctctccgttcttcagactggataattcctattgatctgtcttcatgtacactgcttctttcttctataggcaacaaccttctgttaaactaatccagagcattttcatttcagatattgtactttttaattctaggatttccatttgattttttgctgaattttcctcactgggctggctcaattctttccaaagttatctttaagtctctgtctacgatagaaaggctttctgcaagccttgtggggagctaaattgggaaagagggctggagagtcttagcattcagtatgcattaattcatttaattcaccacccctcagccatgtctggcttttacttctaagtgccatctattttatcctctctaaaagaatcaatcttcagttttgtgcagggcctagagacctaagagctgtccagcagtatagaatcggggttggtatctagaaatcctattgacatcttaatcctctcgtttttaacactcccctcctctccccaccatacagttccagaggtgctaccagtcctaagcctttgagaattctgtggtggtattgctaatccatctgttttccaggtaccaagtttttgttgctgttatatctttttgttagtatctctatgaatttataccttgaaaattttttattttcccttagttatggcagaactttttccaggagaaaggaaacttaaatgtgatttttcagtctactgcctctgcctagaggtctgatagcaccttaacattttttctttccttcctgcgatacaactttataattaggaaccttagaggtgaacctgtggagaaagaattgaccctttcccatatatagtttttgttgtccctgtctttattgcctttaaatctcacataaacattgtcgaataagaggctgaatattaattagagaaaagaaatagacacaatgtctcttttttttttctttgaatatctttctaaaacaaggcaatattcatcagtctgttcatgtaacctttgattagggcagaaagtgctgaagacactagctgcaaaggacacgatcttacagtcctgtttattcatgtcttaagatcattgtcagccaaattttgctggtatatggctctgaggaaattctgtcccttgctactcctacatgtagttccagcctgtgagacagtcagttgcagatggtgcttgtccctgatatttcatgtcttgcatatgtccgttcacactcagaaagcccacagctatagctattgtaccagaaaaactggtagacgcttccaagcggaagaccttttcagcgctcccatcaaatgaagcaaaccagcttggcatttgctgacgtttcttgactgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattcccacgtcagacagttggatccagcgttggatctactatccaaatgatccctgtagacctaaaaatattccacctaaaatattccataagcagtatgtaggtactggagtcttcattatgaaagattaaaacattttgctgtcaaaaaataaaatagaaaattacttactgtgattgctacttccagtttgacatattcttcatgtcccatcaggactataaacatattatttaatctcatctgagaaattcaatatattatgtattagatattccttttttgctagattgtccttagtgagaacactcctttatctttttttatcaagataatcgagagtctactaagcagtatcttttgtctttctgtaaccagcactcaactactggtttctgggatcttttagcagtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagatttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtttcaaaccctatctgtttttgatggaattccctctttcttggcagtgatgggaaaatcagtgtgtacatgaataccaccagtgatttgctactctaaatgacccattctgtcttcataaaaccctgttacggagttgtttatttggcgtttttttatgtttgttttctttggcgcggggcggtggggggaggggcggtaaattggagtctcactctgttgttgcccaggctggagtacaatggtgtgatctcagctcactacaacctctgcctctcaggttcaagtgatcctcctccctcagcctcctaagtagctgggattgcaggtgcctgccaccacgctcagctaattttttggatttttagtagagatgaggttttttcaccatgttggccaggatggtctcaaactcttgacctcaagtaatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccctggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttttacccctggattgaaaaatcagttatgttcattgataccaattactgcctattattactgaagtttgttcttttattgaatttctactaggtcttctatgacatattaaattagagtggaattttaatcactttaactgatagttttctagtcttgccttcacgattttttgattcaatacagtatgtattaaatgcttttgtttgttttttttcagtcagggtcttgctcaacttcccaagttggagttcaggggcacaaacatagctcactgcatcctcaacctcctggactcaagtgatcttcccaccttagcctcccaagtagctgggaatacaggtacatgccatcacacctagctgacttttttttttttttaattttttaattttttgtagagttgaggtctggctatgtttcccaggctggtcttgaagtcctgggctcaagccatccacctgccttggcctcccaaagtgctgggattacaggcatgagccaccgcacccagcctaaatgtatttttaaagtttaacagtaaacccaggctgagcgccatggctcacacctgtaatcccagaactttgggaggttgaggcagttggatcacttgaggtcaggagttcgagaccagcctggccaacatggcaaaactctgtctctgtctctacaaaaatacaaaaaagttagctgggcatggtggcacacgcctgtaattccagctactcaggaggctgagacagaagaatcgcttgaacccaggaggcggaggttgcagtgagccgagattgtgctgttgcactccagcctggggaacagagcaagacttcatctcaaaaacaaaaacaaaacaaaacaaaaacccagtaagccctacatagcaaataatagctcaagttgtgcctctgcccccctcttcccacccctgactattaacataaacaatattcgaagatgagacagcagcaaccaagggcacatcagccagtacatgtagctgtgtagctatcattaaagggaaaaagaaagactggtccctttcggcttatctgtcaggcaggctgaaaggcctgtgaaattattgctgactgtttctggcaactggaactatatagagtaattctattgtaggctgctagaagaggagaggattaggggccagtaagatttctgaagagtaactgggttgatcaatatagtatcacaggtgggttatacattggcagaaagcagtcacatatacatttgctgtaagttctggatttattttatttaacttataaaactttcaaaatgagggagctacccaggagtaggaacagatgcagtgtatcttagcatgattttcccttgatcctgggttccctgtgaggcacacagctgccagtgacataggtatgtcactggcatacctatgtcagtgactttcacatactggtgaaagttgcttaattcttgctataccactggcctgttccattcaagtaaccctcaggtaagttacctgttatactcagatatctaacttatagcaaatgtatatgtgactgctttctgccagtgtataacctccctgtgatactattctgaccaatcttttttattggcccctaatcctctccacttctagcagcctacaacagaattactctatatagtttcagttgccagaaacagccagcaataatttcacaggcctttcagcttgcctgagagataagccgaaaggcaccagtctttccttttccctttaatgatagctacacagctacatgtactggctgatatgcccttggttgccgttgtctcatctttgaatactatttatgttaatagtgggggtggggtggggctgaaggacaacttgagctatttgccaagtagggtttactgttaaactcaggtaaccatgagtataactggccagtgctatagcaagaattaagcaactttcatctgcccactcggaagagcttgcattaacagtttctaagcagaaaaggcaaaatcctaccaaaggtctccaagaccttgggtgatctagctatgcctttccctccctcctttcctcattaacttcatctgctactcctcctcttcactatagccattctggtctcctcacttatcttagaatagggtatgctgccacctcatgaccttttaattgactattgtccttgtctggaatgtgccttctcctagtctccatatcgtatagcttacttacttactttaggtttttactaaagtagtacccaaaaaaagagaatagaatgatagttaccaaaggatgggaggtgaggggaatgaagagaagtaggttaatggatacaaacatacagttaggtagaaggaataagttctttttttttttttttttttaagtctcactctgttgcccaggctggagtcaatggtgccatcttggctcactgcaaccttcgcctcccaggttcagcctcccgagtagctgattacgggtgcccgccaccacacccggctaatttttttatttttattggagacaggagtttcgtcatgttggccaggctggtctcgaacaactaacctcaagtgatctgcccacctcagctttccaaagtgctgggattacaggcctgagccaccgcacgcctggctaaatagtacctttttaataaaagattttctcacttcactcccagtactaccaatctcccttatttttaccccatagcatttcattatattttaattactacttaattatttattaccacctcctgctcctctcctactagaatgcaaattccaaaggaacagcagtttttgtctatgtttttcccaccactgctatgtctcccagggcctggaacgatgtctggcacacagtaggtgctagataaatatttgttgttgaatgagtctttttgctttcatttaggaaagtattaaccagcatcagattcatctagttcttgaaccaaactaagcaaggctatctcttcatcttaacaaacagagtatccctaaacacagcctctgcctgttgtttctcagcagccttgcgttctatcctctgactctgatacaatacccttttatctggataggtctggtcctggtcccaagtttaatctgaagactacaatcacaaattcattttctctcaagtaggcagagcaaatattagaagctgttgcttccttgatattaggaaaggcaagatcacagcacattaatggaccctgttttcaaaactggagatgactaggaacatagcacatgttaactgtgctcacattttgggaattttttctgttgctaacttacgtctgtatgtctctttaaaataaaaccaaattgccaccatgagactattaaattattatcctaaagagccttagactattttggttaatttaatatttctagagtaaatttggaagctcaaaatcagagtaaatgaggaagttcaaggatgctcttacaagtgttttggagcctcagggaaaaccgaaatcatttagatgcccgacaggaaatggtgctgagcaagccctttttactgtgaaaacagaagaaccctgtctttttcctaatcctgatagacacaaaagtgtaaggaggcaaactttaaaagcaagtgcctgctgggcacggtggctcacgcctgtaatcccagcactttgggaggctgaggcggcagatcacttgaggtcaggagttcaagaccagcctggccaacatggcgaaaccccatctctaccaaaaatacaaaaattagccgggtgtagtggcatgcgcctgtagtcccagctactcgggaggctgaggcaggaaaatcacaaactcaggaggcagaggctgcagtgagccgagatcccaccactgcactccagcctgggtgacagagcaagactccgtctcaaaagctagggcaaaaaagttgtcttttagcaatagatattcattatttctctttacttttaagaaaacaattttttcaggtattcaaaacagtcttttgcctttaaatggaaaaaaaagtttttaaaaaagggtagtcatctagcacttttcaatatcaggtttttctttacttgctattagaaagtttactttggtgggaaatcggtgtgataaggagtgaaaagactgagacacataaactgaaattcaactttggaaatgaatttttttcactcagtgagacttaaaaaatgaaccacccagctgcactggattttgtgttggaactttgagggtgtttttttttgttttgttttgttttttggagacagcattctcacactgtctcccaggcaggagtgcagtggcgtgatcacagcttactgcagccttgacctcccagactcaagcaattgtctcacctcaacctgaccagtagctgggactgtaggtgtgcaccaccatgcctggctaattttttatttttatttttgtaaagatgaaatctcaccatgttgcccaggctggtctgaaactcctgggctcaagcagtcttctgccttggcctcccaaattgctgggatcacagacaggtgtgagccatgcctggcctccacagtttagatggctgcagtgatggctatgggtgggctactttttctatcctccacaaaggtagtctttcatgaaaattgtgacctactcaccctttttccaaatggctttacaggggcagggtgggggattctcttttaaagaagtacttgagaatctatttcagttgcaaaatagttaacaaaatttgatttgagtagttctgaccttgctgtgctttggactcccatttgacagccctgaaggttcgtcattctaatttactcctgcccaaatggtgattttgacagtttaatccaaagtcttttaaagcaatgtctattcataccactttacaatctttatctaatctttagtgttctgaagatttaatttgctgacatttctaatttatggtctaaattatttgagagttttttgagattgagattaagcagatctcatagcagaatgggtactacaggagaagtcatagtatttcagtttcagtgtcttttggtttctgttggcttcctttcgaatcaaggctttactaagagagattggctcttaggagctcattgcctttttaaagcccaataattatatgtgctactagaggatttacaattttagagatcatctggagggctctgttcaaagctttcatttctggttctgagaactgtttaaatatggaaacttcaaacgctgaagtgcgtattagggacatggaaccactgcctaatctgtcaaattttccctataaagggttccactgttcacatactcttaacgaacaatgtcctaatgtctcctgagaataaatcagtatggctttatactcaggatgaacagcagtttggtaccatttgaggcctcctcagctatcatgtaatacccctgatctattgggtggactgagaaagaatatgggaagagagttcttgtttgaatcctagccttggaagtgaactaaagacgctgtccagtttaaaatggaattagcactggaaggaaagtcaattgacatttcctgtggttcattactctttctgctatgtttttaactctatcagatactgtctaatatcataaataggcctttctgttttgtcagggtctctgagaattcccagataattcattggtcaatagagtttgaaatgctatttaaactttgggtcaccaagcacagtggctcatgcctgtgtaatcccagcactttgggaggtcaaggtgggaggatcgcttggggtccaggagtttgagactagcctgggcaacatagtaagactagtatgtctagtctattccagtatgtagactagtgtctacaaaaataacagagttagccaagcatggtggcacatgcgtgtagtttcagctactcacgaggctgagatgggaggatcacttgagcccaggaggtcaaggctgcagtgagctgtgattatgcctccacactccagcctgggtgacagagcaagaccctgtatcaaaaaagaaattaaaataaataaaataaacttaagatggtagataccttttggcgttgattagaaatgcagaactacatgttaatttaactccagcacctagcagaaacggccgcttctgcttgagtctcagatgatatatatcacatagttggagtaagtaccattaaaaacctgtcactccgagccattcccctaggatctgttgactaggttgtgtggtacttaaaacacatctgaatcatcattcctcagagaactggagatggttgacgtcactgcctggtcctagcttggaccagcctgcatataatcattccaaaagctaaaaggagaagagaaataaaagaaaaaaataattcttcagaaatgtggaaaggtcacaagtgacgttatggaagagcagatgatataatctcaaaggcgagccctgtactatttcacttggttttccttgtggcagtgcctcctttggttacctgtggtgagaggtggggtaagaggcctcatttgccagagttcagactgagttcatgttatacctttttatagtacttttgagtatactggtacaaggttagaatattaatttagcctgttcatctccagctgtcccaccataaagagattgtagctcctgcagcaggctttctatactatggaaagaaactaattgctggttacaggcttaagctgacaggttgttctttccttagcagcctcttaaagtaactttaaacaatcattgttattattaagcatttatagcctgcttttgtgttttcaaagtgccttataatttctgtttgctttcctattgatgtccctaaaaagcaagttaatattgttatggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatgatagtctacttcatattatacccctaatcttgacccagccccatgcctccttcacagtatgtgtccattctttcctcttctattacgggaaatacactagaaaaatgtgagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccatagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtagggaggacagtggaaaaatataaaagaagtattgggacagtggaaaaatataaactggagttggaggttgggtggtacagttttacaaaaatatgttggtcatggaagacctatctgaaaagataatatttggttaaagcaaagactcaaaggagacagggaaagaatcatggatttctggaggaagagcattgtagacagaagaaacagcaaatgcaaaaagccatgaagtaggagtgtacctgctatgtgcaaggaaggaacaacaggctcctgcagctggattagagctagcaaggaggagagtattagcacgacctcagagaggttggaggagttggattataggcaattgcaacttggtttttattctgagtgagatggaaaggtttgagcagagaaatatttatgagctgacctacattttaagatcactctggctgctatgttgagcatatactggggaagctaggtgctgtgaagggaatgtatagggggatgtggctggaagactagtggagaggcagagagactgttaaaggctttgcagaatcccatagtagttaccgagtttggaaagacagcaggaggttgtatttggaggtggggaggggagattaagagtttggttttaccacaatgagatactatctcacaccagttggaatggctattattaaaaaaatttttgaaaataacagatgctggtgaggttgtagagaaaaacacaacacttatacactattgaagagcatgtaaattaattcaacccttgtggaagacagtggtgattcctcaaagacctaaaaatgggccgggcgcggtggctcacgcctgtaatcccagcactttgggaggccgaggcaggtggatcatgaggtcaggagatcgagaccatcctggccaacacggtgaaaccccatctctactaaaaatacaaaaaattagccgggcgtggtggccagcgcctgtagtcccagctaggctgaggcaggagaatggcgtgaacctgggaggcggagcttgcagtgagccgagattgcgccactgcactccagcctgggtgacagagccagactccatctcaaaaaaaaaaaaaaaaaagacctaaaaatggaaataccactcagcaatcccattactggatatatacccaaaagaatacaagtcattctatcataaagacacatgcacacctatgttcattgcagcactattcacaatagcaaagacatggcatcaacctaaatgcccatcagtgatagactggataaataaaatgtggtacatgtataccgtggaatactatgcacccataaaaaagaatgagatcatgtcctttgcaggagcatagatggagctggaggctattatccttagcaaactaacacaggaacataaaaccaaataccacatgttctgacttgtaagtgggagctaaacgatgagaacacatggacacaaagaggggaatagcacacactggggtctgctagagggtggagggtgggagaagggagaggatcaggaaaaataactaatgggtactaggcttaatagctgggtgataaaataagctgtacagcaaatctgatgacacaagtttacctatgtaacaagcctgcacatgtacccctgaacttgaaataaaagttaaattttttaaaaaagagttcagttttagacatattctttttgagcaacctattatccaagtgaagatattaagtaggcagttggttatatatgtgatcattgatttccctcaagcaatctaggcatgatgttatagcttttggaaaatagtttagaacttgtctggattatatcttcctactatctctacctgttgggatagtgaatttttaaataagaaaacaagaaactgtctttctcttttcctgtctccctccaacaacaatatcatgctctttaaagctgatttagttatatttaagagcaatcagcatcaggattggaattaaactggcttcatactgtgtttttcccttggttcttttttaacacccaaaatatgattggcatatccttggaggacctagcattctttgggttgtgatccactacctgtgttgtcctttcttagcatgtagatattatttaactcagtgatttgaaaccaaaagaacccatacatcatcccatccccccattcctgcctcattgagaatcagtgtgcctaatcagagatgttgctgatgggattctgttatgtatatgaatgatatggaggtagaaaaaatgttgagaaacacagtgtttcatttttatttgttcaacatcttccacttattttcatgcaacaaatattttttgaggtagtcaatatgctagcgaagatgagagacagaccctccactcaaggagctcattgtattataggtgagccggaagtaagccattattatatgctatcatagaattgtatgcgttgggtgctgtggggaggtgttagagctttctgggaagtgttaatcttgaactgaaccttaaggttaaataggtattttccagacagtgctaagcttaaggagaagaaaatattaagcagaaagaacaacatataggctgggtgcggtggctcacgcctgtaattccagccctttgggaggctgaggtgggcagatcacgaggtcaggaattcgagaccagcctgaccaacatggtgaaaccccgtctctactaaaaatacaaaaattaggtggacgtggtggcacacgcctgtaatcccagctactcaggaggctgaggcaggagaatcgcttgaacccggggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcctatgttactgaaatgaacccagttctagcctagagtgaaaatatgagagctgcaaaatacagattttgaaaagctaatgtaaaagagatgaactgcttcccccaatgaatgacctgtgtagttgatcctataaagagatgacaatttaccaaggcagtagcaaaaggaatcattaagctaacaatctgccgataagccttttaaaaagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctctgttgcccaggctggagtgcagtggtgcaatctcagctcactgcagcctctgcctcctgggttcaactgattctcccacttcagcctcctgagtagctgggactacaggtgcatgccaccacgcccagctaatttttgcatttttagtagagatggaattttgccttgttggccaggctggtctcaaactcctcacctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgtagggtagggcctggcatctgttttgaaaagcctttccagatgattctgatacaggtcttcagttaagaaccactaatattatcctctagagaatggggatactactttatagtcaaagataatcacttgcatttcacatgagacctttacatgacccaccattagcctacccccatcaccccagttttcacttttttttttttgaggcagttcactcttgtcacccaggccagagtgcaatggcacaatctcggctcactgcaacctctgcctcccgggttcaagtgattctcctgcctcagcctcccaagtagctgggattacaggtgcccgccaccacacccaactaatatatatatatatttttgtatttttagtagagatggggtttcaccatctggccaggctggtctcgaactcctgacctcaggtgatctgcctgcctcagcttcccaaagtgctgggcttacaggcatgagccaccacacccggccccagttttcacttctaaatgttctttacagagcctagcgctgtctcaagatcttcttggtgcccttatttgaaataagaattctcctctcttacctgccaagtaccagatgagttagaaaatactctttcccggaagcccacggctggcatcaatctttgaaagtagtgctctggtacatcccttgttgttgttgttgttgttgttttgttttttgttgttgagacggagtcttgctctgtcaccaggctggagtgcagtgacacgatttcggctcactgcagccttgcctcccaggttcaagcgattcttctgcctcagcctcctgagtagctgggactccaggcatgtgccaccacacctggctaattttttgtattttagtagagacagggtttcaccatgttggccaggatggtctcggtctcctgacctcgtgatctgcctgccttggcctcccaaagtgctgggattacaggcgtgagccaccgtgcccggcttcccccctttttttttttttttgacagagtcttgctttgtcacccaggctggagtgcggtggcgctatctcagctcactgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctctagtacatcctaaagaatgcctttagttcctctttcctgacattactctgcttaaattccccagattcaagctttttgagaatcctatctcagcattttgggcatcaggccatgttatatataggtcacaaactcctagccttgttagttgacaggttaaaagcaaggagaataattggatggacacttctgggagagagaacgcaaatattatggagaagggaatacaggcaccatttaaagtaaggaaggtaagttgatactaaatgtagaaggactggaagtactttagaaagaggatatttggatctcatagccacagttttaagaggtcagtatgctgttgaagtgtagacatttgccataaaagacagagagtgagaatagtgtactagataagcactttttaactctgtttttagagcaaaatgagaaagaaacaggtatagttactgatcatagaacttgctcagataaatgttttcctacagcgctaagagcatagataggaaagtcattagtgacagaaaccagtgggaggtggtgacttagagcaagtctcctcctactccctcttcttacagtataagggccttatgatgtgctgctgtgcaatctgcctgttcctgaatgtatataccaatcagtgttgccctgaataaaagtacttactgtagctttaaaaaaaaaaaacaaacaaacaggatgctctgaattaagcaggctatggtagaatcatagtcgagaagtttgtattgtgagaagaaaatttatttatttgctcgcttaaaggttttttgttcttatagtcatcaggtttaccagtgttgggccaaacaagctttttccaaccataagacctgggaaataaggttttataaaagaaacaactttaaaactgatatttaaaaaaataaaaaataagagatagtatggcactagttattgtggggagaaataaaaatcaaggtttagcgtcaagtttctgtttgaatcgtaattcttctgtgtactagctacatgactctggatgttacttagtctttctaaacctgagtttcattatctgcgaaatgagaggggaatgatatctactttgtttgagatcattatagtgtgagttagaaataatatcattaataggtaacttagtaagtggtagcagctactattaataatcatagagaaaaaaatcacagactagattattcctggtatacaagttgtgccttgaagacaggccttctggaaggaggtagagttgcaggttgtcacagttctatgacaatggagtaagtaagggtgtgctttgcagtatatgggccagtttgtttgatttggggagacctgcactgagagaaagaggaaggaaatagggaggcctatttctagacacagcgctgttcttttcctcctacctggctccctgcgatgtcctcatttgaccttgttgctttcctggcaggtggctgtgaaaaacaatatcgatgtcttctacttcagctgcctcatcccactcaatgtgctttttgtagaagatggcaaaatgggtaagtaccttcctgcctgtcctgctgaatatacctttgcccttcctgtgcatgtcaggcagagcatagccccagaagttttgagttattttgaggttaaaaaaaaatgggttaaggatattctaaagctcttaataattgctcattatttattctcctgtgtcacaattgttcttgctctgccattggtctctaaatcacagtgcccaatatctgaataatccagtcaccccaggatacagaataagaggtttggggaccaggtaaatatggatttgaatctcagctctgctatttatttgctgtgtgactggtcaaggtgataaactttttggaacttccgcttccaaatttgcagtgtagataatttttataattatttcatgagataatacatgtaaatttagcactttactctgtactaagttcatactgcctcaagctaagaattcagtaatttgtaataaaccgtcagaactcccgatgtgcctattgacatttctctcttcccttatttatgaatcacaatctaataaaactggcttatattggtgcatattaaactatgttggcacttaattgatttgattcttacaatagctcttggagtaggcaggacagatgtaattatagataaagaaattaaggctcagaaaggtcataagtcaccaaaataggaaaacaagggagccaaaatgaaaccctagatatagactcttttccaattatcctagtgttactgatgacggattaattgatctgaagtatagcacttttgtagagctcagcattggctccattcccagcctgctgctagctgtattgcaagagccagcatgccaaaggaaaaatgatgcaaggcatcgaaaatcagaatactgacagcttatgcacatccatccttcccctctgctttcccatacagagcgccaggtcttccttgcaacatggaaggatattcccaatgaaaatgaacttcagtttcagattaaggaatgtcatttaaatgctggtgagtaatatactctaaatttcagtttcatcttagtaaatcaaattagatatttgaaattttaatctttcttttgcctacccttttatcctcccccgtatctactatgtttctagtgggtatatatggtagatgcattactttgcaaacctctgtttaaaaacgtgatatgttttgatgtaggtactagattacttacaagctaacatttaagaaacaagctagaatcgacccatctacccatttcttcactaaagatgtgttagttctgttacttaaacatcctaataatcaaaaactgaagtggcacttgagaacatgcactcccttagtaattgaaaggaccattttcttcttttatatcaatttttggtgttggaggaaggttaactttctttcttagattctgtacttagaaccctgtgtttataatgaaataatgtatcatcattagtgaaagcctcgttgggccaagtatggtggctcataccagtaatcccagcactttggaaggccaagatggcaggatctcttgagtccagttcaagaccagcctggacaacatagtgagaccccatctctataaaagaaaaaaaagcctagttggtaaccttttactacactgccctgtgccacctttcatatgatgatactaacctctttaatcaccattaaagagctccgtactctttcatagttaactttgttactgtaaaagaacatgaaaggggtatcccaagaagagaaacaatagcagctattagtcccttgggctgtgtttctctgaaggatttctcaggaatgaaaggagccctaagttatttagagtcctgcctttgtttcactgttgctctctctttctctttagagctctttctttctctccttttgaagttagtactaggctttgtgagtttgaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacacggcagcacagaaagcaaaaaaaaaaaaaaacacacacacacacaaaataatgccttctcattccagcttcccccaccccgctccccggcccaagatggagtctcgctccattgcccaggctggagtgcagtggcacaatctcggctcactgcaagctccgcctcccgggttcatgccattctcctgcctcagcctccagagtagctgggactacaggcgccagccaccacacccggctaatttttttgtatttttttaatagagacggggtttcaccctgttagccaggatgttcttgatctcctgaccttgtgatccgcccgcctcggcctcccaaagtgctgggattacaggcatgagccactgcacccagcccagctttttaattttagttttttatggctctatgtaatattcatcttctgtgttcagatgaatcttatagggcttttgaaatccaacatcatagtgatcagctttatcctgtgatacctcttttaaatgtgatgctcctataggccctctctgagacattcaggagactgaagccctcctggaaccctcagaataaaagacattcagacaggcatctttgcatatagaaacttcaggcagatgtttgcctctgataattgtttcacgtctctggagctcttggagaggtgtttgaagcatggtcttctgtaatttccatcataataattaattgtttcaattaattcagtaataattgatttttttcattttgtgtcatatttgaagaagatgacagtgtcatctttccctcactttgaggctcactggtggatcctattagaggagccacctctgtacccagctaggaagagaccaggcccctggttatattcacctttgtgggagttggttcaatggcaacatttcaaatagaatgttcctcagaacacttttcccttatgaaaaagggttttgggccgggcacagtggctcatgcctgtaatcccagcactttgggaggccgaggtgggcagatcacgaggtcaggagatcgagaccatcctggctaacatggtgaaaccctgtctctactaaaaatacaaaaaattagccaggcgtggtggcgggcacctgtggtctcagctactcgggaggctgaggcaggagaatcagcttggatccaggaggcggagcttgcagtgagccaagatcgcaccactgcactccagcctgggtgacagagcgagactccgtctcaaaaaaaaaataaaaataaaaataaaacaaagaaaaaaagcgttttgttatccatgaaagttgaaaaatacagcatatgctaggcttcacctggaaattgccattgcacgttagcagactaaaagttctgagaagtgctatactgaagaaacctatttaactcagtgttaactgaacttatttggccttggaatttaaaatcacaaaatacttattagtaacatcatgtggaccaccagtattccttgaacatgatctggaaaacactctccgagagagaacagagatagaccagagtgattggaaagcaggttttgtttcagacatgttcagtatgaaagggacatggttgttcaaaaaagaaaatagaagttggggtgactgaggactttggtctgtcaaaataacagagaagaaaaaatcctcctgcttttagactggagttttgaactcttattgcacctcggcatgtttttgtgatcttatcaaagaggaagtgtctggcatttctcctagtggggctgtgccctttgatgtcgtttctcagagcaaattcagttttgatcaattctgtcatggcctcacgccaatcgctccatgctgtaggtgctccaaataccaatgaatcagattccagtgatacactgctctgtggccatgccgcacatgaaacataggggaaaacagtcattgcattttctccaggagtccaaggccaacattttcccacattaaatcactgctagtcttgcaagaccacttcctgcaactaatcctttccagctcttcctttgagtccacccccaggtctggagtgccctggcctttagatttccttccagtctcgagggctctattaacatgaacgtttttggctttagtgccttctgattcaacaccctgggtctagctgagagctaaaaataccatcctttccagctgatctgccctaatcacaatagcaccaacactttaaatagcttttctgtgctagcatagacatttgacagatggaactaacactctgagggctacaggaagtcacaggcttaaaggacttaaccaacttagcactgagctttactttgctctttcatgtctttctagagaataaagaaagagaccctcttcccaagtcttaataattaatcagatcttaagagaaaagtgtatggtgggagtgcttatgatgccgctaattgtgttaagtactagaaaatgttagatcagaaagctgctaacagaagtctctcctttctagcaccgatcatttctgtggatgttgggagatctgtatgaatctgttttacatcttaccattacagctgcatttggggttaataggtatctgggactactgtcttaagtgcacaagaagtagttgcatctccagccatatctggaaaggaatctttgtgacgaacagttctacaaaccagttttttaaattaagtgtttataatattaagaaaagctcagagacttaatgtatctattttcattagttaggtactgtaatgagagacaaatatttgttccagcatgggggctaggtaagggtgaattctgtttcattgttttgttgcggctctccccatcctttggaatatttcaaaaatggaaacactcttccagctagcacctaactatcatttggttgcttaaatggtaaaaagcattcttttcagcagtcatagtggttttgaacttgctaataaataccacagcagggccccagatgtaaattcccccattcccactctctaatatgagtacctgcttcacccttgttgctgtcagaggatgtgtgaccttagctaaagtagaaagataaaagaaggaagatcacatcgacaccttctaagagttgaggccccagattcaaaatgccaaatttatggaaggatacaaatgaaccataagaaatcttatattggctgggctcagtggctcacacctgtaatcccacactttgggagcctgaggcaggaggataatgtgagcctgggaggtcgagactgcagtgagccatgatcacgccactgcactccagtctgggcaacaaagaaagactctgtcgagagagagagagaaagcaaggaaggaaaaagaaaagaaatcatatcttgaacgaagggtaactatatttgaccatctttttttattctatgctttgggataaatctcagtgtcttatgcctcagatgatatcatcagcacacagtgaaacaatattacattacattctcattatcaaactctcacaactataagattccgtcctgtttcccagaaggtcaaaatgtgttttaaaaaattaaaaactatgatatcttgtcaagaattctatcccagtcagaccaggaagcctccttatatctggcttcccttgccattcatcatacatttagcagaatctcatcattctgcaatccgtaaatcttcaaactcaaacctaataactaaaatgtataaaaatcgaatcacacatactaatgttatggaaccctctctctagtcttctgataaaaatcacagtacagtcattcattaggaacagagtcaggttgctggccagaatgcttccaaatgtattaaagttacatccattcaacttgcttattcttcctggctgtttggcatgttttctaattctagaagagtgagaataagagagagagagacagagagagtttcttagcctgtcatctcttacataggtggtgaaataattgagaatatttcatgattatttctgtaggaatctggcccttgccacatgtatatgctagaatgtatttgtgcctatgcaacaaggtgggtgttcaacaaaggctcctactttgtgtgtttttgggtttcctgggaaatgggcaagggcctagaaagttaggaatgatttttacaacttaaagcaagcccctctgtgttcaagacaatcctgtcaaaaggcattagccaaaccctagctgatgatgttgcctagcaacccactcaaagctgcaagagcccttcattgtgggaagcagggtggcaaccagaactgcctcatcccccacaaggtgattaaaagggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatccccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaacacacatggctcataaggatgtgagaagagagtgtacatttgtttgagattttaactgaaggtgttggattttgaatctgtatttctagacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacggtaaggcctttctcagaatgggtgagatggattagaggagggaggtgagagccctttcatgtttacttagcaccctagaaagacctggaggaggtgctttaaacctgagatatacaaaataagtagtcaatgaagaagcttccatttgcctcaatggaagacctcctctctgcagtgtctgccccatccaacaggaatggtatctctggcaagtgcctcaaatccatccctcccccctggtgtatacagagttgctcacaaaacttggcagcttcatcctcaatatcagttaatacatatctagtgtatctgtgcatgtggtactataataagctgccgagaggattgtttacatagttaatgtccagaagacctttcttgctgttggagttcatgacctaaggctatcagagtcattaacacatgagcttttttcagcagcattgtatgacctgaaatgcttgttattaaaggtgaggcaaaatggaacacacctttggaagcgtataaggggactttagtttgggaaatttccttcagtatcacactgaactaaagtaaaacttctggcaataataaggcagaagcagttgctttgttaaacagcagattgatagccaagcactaggcatttgtttgctgttgtaaaatgcaatttcccaataggatgtcatctgcattttgaaaagtaaaggaaaaacccttgggatgggagaaatatcttattcctctgttatgtttgagggttttatggggatctatttatttctgaggaagctgaatagtcagtagcttaagggagccttttagtcatttagctgagaaaactctgtgacccgttccttaattttgacagctaagtctgttttcactagcatatatcaagggaatagtaccatccagaactgaaaattcttggtgtttttcccactagttcccatccttgtagtaagttggagtagctgtgtgtgtgtgtgtgtgtgtgtgtgtgtgtgtgtgtgtgtgtgtgctcgctcctgaggcctatcaagttagacttttgcccaagcacttatgagctgaaaaacttcaggcttccctcataaaatgtatgctcctctccccaaccccccaccagtctcatctcttttggagagtaacatacactgtcatttatcttgagtttcccaagaaaggaaaacccctctgtgctgtttctggagggacaagttttactataaaaccaagatagcacatgcctgtaatcccagctactggagaggctgaggcaggaggatcacttgagcccatgagttcaagaccagcctgggtaacatagtgagaccttgtctcaattggaagaaaaaaagggttggggggagaataactccatttactctctagaaatttgccaaaagtttatatatgggtgtgtgtggttttttttttttcctttttttctttttgcttactgtccattattttattgtatatagtcttccatctcagctaggttaaaggagcatgattactcccaggttgcagataagtaaaccatggctaagaatgattagtgactagttcaagatcatgtaatttgttggtaggtgaattttgtttagaattcaggtgtttcttgacactcttcttacacaatattcttgattttgagaagagcttcttagtatcactgtcctaaacatagtttgttaaaattttaaaaagtattttattttgaaataaagacttaacaaattttttaaatggaacagtagagtttctacatctcttttacccagttttccccattaataataacatcttacacacccatactacattttcaaaactaagaaataggtattagtacaatataataaactaaactatagacattattctaatttcaccagtttttacattacttttgggggtgggggattggtagtggatagtactatgaactcttattacatgtatcaatttgataactgctgccagagtccagacacagacttgttctgtcaccacaaaaaaaaaaaacttcctcttgctgtccctttatggtcagactctcaccccagccctaaccccggcagcctttctccattactataattgtgtcatttttagaatgttgtataaattacacatgtaacatgtaacctcttaagattgttttttgcacacataatactcataacattcttccaagttgttacatgtatccatagcttgttcttttttatggccaagtaatagttcactgtgtccatgtaccacagtttctccattcatcctttgaagaatattttctcctttatatttaaacaaaagtttggaagtaattgtaaattcatatgtagttgtgagaaattatacagtgacctggtgtggtggctcatgcctgtaatgccaacactttggaaggctgtaatgggaggatcgcttgaggacaggagttcaagaccagcctggtcaacatagtgggaccccatctttattaaaacatattttttttaaagaaatacagtgagctcttcctgtaagtgacctgagatgatctctgctcagttggcctagaaaacccccaaaatcatacaaagcaagagattcaaatcttcatgtttactttaagaacacccgtggaagtgcccaggccatcaaaggtatgcatatccaaatagccaccaagtacttgaaagatgtcactttatagaagcaatgtgtgtcattccatattattatagtggagttggtatgtgtacctaagccaaacagacgggctgggcacaggatgacaggtggcccaaaaagagtgctaaatttgtgctgtacatgcttaaaaaggcaaagagtaatgccgaccctaagggtttagatgcagattctctggtcattgagcatgtccaggtgaacaaagccccaggatatgttgctgtatttatagagctcaggtcacattaacccatacataaactcccctgccacatattgaaatgatccttactgaaaaagagtaaattgttcctaaaccagaagagagggttgcagggaagaaaaagatatcccagaagaaattgaagaaaacaaaaatttataacctgggaataaattcagcatggaataaatgcaaataaaagttaaaaaaaatagattctgtcctcgtggtttagccacatccaccttcctttgtcccatatatttttattttatttatatatatatatatatatatatatatatttttttttttttttttttttttttttaatatagagatagggtctcactatgttgtgcaggctatctcaaactcctggccttgagcgatcctcccatctcggcctcccaaagtggtgggattgcaggcgtgagccactgcacctggcccacccgccccctgccccatatttttaaatggtgaatttgtttatacttccttgccctctttcctattcttcatcctgtctggtgactaggttctctgcccacaataccatctaaatctcccatcatagcacttgacaaataggtctaatttgttcccctaagtggcacccttttagtcattagactaaaagaagaggtggtggtagaggggtatcagaggtatctgatttgcctatctaaagaggcagactctaaagtcattctgatccattcccttcatcaccttaagttcctattatactattaatctgatctgagctaagtattaagaaagaaatcgggttgagccagcactaatgcatgacagactgatggtcccttagtctcctaagaggggttaataaaacacttctccccaaaccccagtttttattgtattttattaagaagataggtttatcctataagggtgaggctatatctctgtaagtaggtaatcctcacctgaaagataacttgtcccacgtgaagcagtgtatgttccacaccatatgccaaaagtggatgcatagccccttaattttaattaggcaggacagggtgactcttctgcccttggtgtgtctagtttggactggattcctgaatggctgatgttaaagacatgtcacataaggaattagcagttggaaagttaagccccaaggaaggcctctttctccctaggagccatacaaaatgagagccagagtcctagctatatgtaataaacttgacactttgtcagaggctggggtggaggtaggggtggggaggtgtggatattaagagtccagacacagggaaagtttcttccccatcctccaaagaccagcggtaatgcccagggcctagggtctggtcagtccatgacttcccaccaatgccagccttggcagtttgagccattgttgaggaaggcaacatttccttactagttgtaaacataaaaatgaacctccagctggaggaacttcaagtattgttacaaagatgtggaaaaatacaagatagtattttgggggagtatttggggactacctctccttagtctgggagttaactctcttaagctgttgtttctctttttagattcctcttctcttccatttctgaatccacatattctcccactagaattttccacaacactggcagtagagaaggctgtagagaaggaggtacaagaattgctttaggtccagcgcagtggctcatgcctgtaatcccagcattttgggaggccgaggtgggtggatcacctgaggtcaagagttcgagaccagcctggccaacatggcaaaaccccttctctactaaaaagacaaaaaaaaatagctgggtatggtggcacgcatctgtaatcctagctactcgcgaggctcaggcaggagaattgcttgaacctgggaggtggaggttgcagtgtactgagatcacgccactgcactccagcctgggtgacagagcaagactctgtctcaaaaaaagaattgcttcaatagggagtttgaaagtcagggaaatgcctaaagatgcaacttggaccaaaatagggagctgttttctatatataaggaatagctatattcttaagttagttgttttggttttttttacatttatcagaattgtcttcctgactaataccaagcagcagttttgggaatgccttggggactgaatattaaagctgtaaatcaatagaatatcttcccatgttcttttgtttggtttggggtttttttgcattttaaattttactttaactttttaggttgttagtttttaggaaattcaccgttgaccaaaatcttcttgaccttttattcaaagatagtctcacttttgcactatgttaaattgtccttagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcaccattaagatctttttaatattgatgtttaatttggtattcattagactaaaagaagaggtggtggtagaggggtatcagaggtatctgatttgcctgtctaaagaggcagaaaataaaagattaagctgttgatgtgaattgaggttgggttatactaagtaagtgtcttttcatgttcttgtcttccctcttaggggtgtatactctcctcattataatacagaaaggactaataccttggacctacctagtttatggttttatttcacttgattgtacatcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaagtttgtggtatgtatttttttccccagaactgacattctaggagaaaacacagcaggccagagagggacagaacattcataaccactctattaaaacttttctgactgccccagccctcccagggattcagccacatgaaattaagagtgacttgaggaagaatcatatacctcctgggggctccttttgaccaagacccaaagcaccactgcaactccaggcatctttgcaggcagggagtgctcagaggagtcaatctgtcttttcctggcagttcccctgctggggccccaggcaaatggtcccaggggcagtagccggagccacagggcctttttctgacttgtcagttggcatccagccagcagggcccagggcgagaggaatgcagcagagcttctcatcggtttattacccaggatgtctcaatcatctctcaacttacaaaagtctctcaaacccggcctcagggcctgcatattcccaagcaaatggaattaatcctgctttaaaacaagcttcccagggagttccaagactagaggcctgcatttgtgttgttgggggcatatgacccatatgttgtcaagacaggaggccccccgccaagcctaggttctgataagctgacagctgctgagatctcccactgcctggaatggggggaagaggctggaatgagggatctaacaccaagatgcccctggataagtccctgaacctctctcaccactagagtgaatgtagataaagcactctgtagcatttgagacttagtaggtgctcagcaaccgtagctgcctttattacttggatgtccaaaccccatgagcaaactgccttttggcagctaggaactttctggttgtctccatgttgccaggctgcagttagctgtaataggaaaaacacttggtgagaggggtcaaaccggggttgccagttaagaatgacgttaatttgggcaaagaaagtcctgaaggagaggttctcaactcttcggtgcacattaatgtcacctggagagctttcaaaaaagacatggttcagttcaatcagtctgggatggtacctgggggaatcagcatgttttaaaactcccaggtgttttctaacgtgcagtcaaggtcaagaatcactgccagagagagaggctcacacctgttcacctacttcctcttccacagtaatactcatgttctgtggcagttgaaaaatggttaaagcacttccatatgtacaatacctgcctattcccttacctatctcatgaatttaatttcatctccagtttacagatgagatgtggcagagccacgtcttctgactccctgtctgtgtccttagaactacactgtagcttcctccttcgtccactggaggttctgtaataggttctctcctacctctgctctcagccacatcccagcttgctaagcccctaggataccagtatgttcagagcacaccggtcccagacttgcacctgagactacactgtctttctctgcctgtaaagtgacaactaggaaacactgagatgtcaggtacattgtttctgaggtcagaaaacagctaaggactcgcaggtttgggctttctactcccacttcgtgcattaatgctttttctggttttgcttagacccagattctttttccctgccacccccagctccaggaggcaagagcctgtttattttaatacctggtatggcacttggaaaagatcacacctcccccgttgttacccaattctatctcctgaacactaatcctagaatcccaaccagcccccagacatgttattagcaacaagggatgtttcttgaaaagtttccgagttggctccaaacttaccatctcaatttctcatttagcttttgccctgccatgcttgatgctgccaacaaagggaaggctaatttgggggttggttacacccaggttctcagctggaaaagtgcttgcaatggctgtttccaagagcat

SEQ ID NO: 11926 - DNA, 95750 bp, Human
  misc_feature (1)...(95750): n = A,T,C or G
tttgtcctctccccttcttataagagcatctgtcattggattgaaggtccatcctaaatccagtattatatcatctagagatccctaccttaattatatctgcaaaggccttattttcaaatagtgttcactcacagtttccagagttaggacttgggtgtatcttttgggaggacattattcaacccaccacaatggacaagtttgtcctgagaaggtcttgagtgaagaggcaagtcgacctagagcagaagagtggggcaagaccaacactgggggagagacagctaaagaaccctgggaggaggccaataagcagctatcagaagctgaaggaggtcgccaggagaagagagagctagaaacccaagaaggagttttatatatgaaaaggatgacatggacagcaaggttaaataccactgagaagtgtggaacatacacagtggtgggcaaagagagggcttttagtgactttggcaagaaccattttttcaccttggcagtgtggatgggaagggggtggcaaggagctgaagaccctggtggccagtgctgtcataccatgtgcaagctgtaagtggcagtatgcacaatagcagcctcgaaaaacccaaatgaagaccgctgtcatacttttatgtttccagattctctgatgcttacataaaagtgcacttcacattaatttcttacatacaatatgttgaagtggcaggtaagtgagggactatatctatctatatatggtaattattttaaatgacaacattttgactttccatttcctttaaattagttttacgtggtagggggccaattcacattttagaattcgtccagaagttgttttaattgcgccttcaaacgtagatacctgtgcttcttaaatgcaaaatggctatcttttgataggattaaatggcctttcttttttatttcactagtatgtttgcactaatatcaatggtgaaatagcagtgcatcaaactgatcccaaggagagtatggtgcttaaaaaatgctagcctgaaataagaatgtaacttttcttacagttaccagagttcatttcaattaaatcttaatgaggaaaaatgagacaaatgggttcatgagcattacctctcagaccttttaatttttataaatccactggcagagttagacttaccctgttgcaattatttcatttggctcttggaaatttcacctcgaattgcatacggcgggtgccagaggcaatcatctgcttcggggcctaactcttgtggtcatgttatccatctacatctataatcggagaaggggcatgttagaaatgtgaaaagtaccatttgtcacagcattcttgcgtaaagatggctggggctttgggaataagccggtaggggcagtttttcttctcattagctattttatttgtaactgcaggggctgtcagaagcatggacttaataatcttcaagttttcctgcattaatataaaaaaagttgcatgaatttttggcaaatcattgtccccatgagggtatcaaaaatactttgctggtgaatacagaataacccttctttggggagctctcagctgagttaaatatataattgaagcggatttatccagaatgagacatttatgctgatggtgtacacgttttgaagattctgaaccttcactccaagtgtcttttcaattctccacgggtaaaagttagaaggaaagtaccagcagcgctgttaatataataacagagtgcaagggatgcattttgcggttagattatgattatctctttatctgctatgtctttgcatgcatcgtggggtatcaggaggaaacccaaggcccttcattctgtgaagagcaccagaaatatctatcctgcaggatctcagactaacgggaaactgaaagacagaaggaagggagggaggggggaaaaaacagaaggaagggagggaagaaaagagggagggagggaagtaaggaggaaggaagcagggagggagagagggagaaaaggagcgggagggagggaggaaggagagcaggcagatccaaacttccttttctttgctacagctggtgtttctccatgaaatcctccttcccttcgtgtatgggcatcatgctgtcttggttctcctccctatcctcactcgctgttctctctccatctcttgcctcaggattcggcgcacacatttcttcttatctcttttcatacctgtttcctagaatatctcattgagtcctatgcattttaatacaatctctaagctgacaactccttcatttattaatatattcccagcctccacttctcctgtaaagtcaagcctgatacaaccaactgcctcttcaatgttttcacttggaagtctaacagacatgtcaaattcatcttggtcagaactaaactggttcctccaaggtttcccaaactggcttttcctgcacactctcaggccaatgtcgctggtgttttccctcactccctcttatctcccagccccatctaccctgttgggaaatcctgctggttcatcttcacaccatgctccggatccaaaacctctccccttctcccaggaacatggctcctccagctgtttccactcagttgttctccaccactgggtgaagcaggcagattgagccttttatgcttaaatggaataatgttctagcacctctgccaacaactccagggttttgtcatctcacagtgaaatccaaactcctcccctaaacccatgaagcccacttggcctggtcaccgtcagccacccccatgtctccatcactcccccaagccagctgctctttctcagacacaccaagcatgctccctgccgctggcttcggacttgcagtccccacatcctcggctgcttttcccctggttgttcacagggttcatagggttctctcctctcccgtcttttctccaattgctcctcaaagaccttctaccaaaaatagccagactgtgcctacacacatgcatgacactgcttatgatcctctgtttttccttcataaagtgtaacatttccaaacacattctacatgtgtttgtttattgtttgtctccacataaaagcaggaatttaatttttgtgtgttgccatgtctccaaagtctagcacagtacctgcaatagactgggtatggagtaattattaggaaagaaaaaaagagagagggagaaaaaaacaattatttgatttttttcttgtaaatttgtttaagttctttgtagattctggatattagccctttgtcaggtgggtagattgtaaaaattttctcccattctgtaggttgcctgttcactctgatggtagtttcttttgctgtgcagaagctctttagtttaattatatccatttgtcaattttggcttttgttgccattgcttttggtgttttactcatgaagtccttgcccatgcctgtgtcctgaatggtattgcctaggttttcttctagggtttttatggttttaggtctaacatttaagtctttaatccatcttgaattaatttttctacaaggatatgaacagacacttctcaaaagaagacatttatgcagccaaaaaacacatgaaaaaatgctcatcatcactggccatcagagaaatgcaaatcaaaaccacaatgagataccatctcacatcagttagaatggcgatcgttaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccaaccatcccattactgggtatatacccaaaggattataaatcatgctgctataaagacacatgcacaagtatgtttattgcggcactattcacaatagcaaagactgggaaccaacccaaatgtccatcaatgatagactggattaaggaaatgtggcacatatacaccatggaatactatgcagccataaaaaggatgaattcatgtcctttgtagggacatggatgaagctggaaaccatcattctgagcaaactatcacaagggcagaaaaccaaataccgcatgttctcactcacaggtgggaagtgaaaataagaacacttggacacagggtggggaacatcacatactggggcctatggtggggtggggggaggggggagggatagcattaggagatatacctaatataaatcatgagttaatgggtgcagcacaccaacatggcacatgtatacgtatgtaacaaacctgcacattgtacgctagaagtataacaacaaaacaaaacaaaaaacaaaaacaaaacgaaggcacaagtaaaaaaaccatttgtaaattggttaaaaaaaaattattgagcattatttagagtttaggaaataagggtaggtcaatgaatagactattgtttttggacttcaacattgtattgcaatgtccacaagggcccctctgatggcctccttttgcacttacttggaatgtctttgaatcgattataaggctcaccatcatctagcctctgcttctcttcccttagttctctctgctacagccacttagcctttgtcacataaaccaagcccatccctccctccggcctatgggaaggttcttcccacacatcattgcatgattgggtcctgattgcatgtcctcttgaaaagacctccatcaaacctgctatcctcatttctggccattttctatcacataaccctgttttattatcttcatggcatttatcgccatccaggatgtcttgtttatttctttacttttctctcatctctgtcccagcttttgaatatgaggctttgcgggctggggccttcatcagtcttgctcactgccttttcccaagtgcctggaacctggtaggtgttcagtcattattttcttagtggatgagtaaatgaggctgccttctagggtactgaccttcttatgccctcctgctcgcgccccccccccccaccacctgatgtaattgtgaaggaggattgttatagatttgctgttatgtgcacgtcagtgaggagccgggcatctgggaaacaggagactgccagaagttcttgccagaaatttctctaggaagtaaaaaaagaaggaggcataaaatagttgggaaaaaaccatgtacagcaaacctaactaggtgcattttcattcctctagaaaaaaaaccttttcaatagagactccccacacattccccagagcagcaattctcaactcctatgcatcaccccatcagttgtgagtgctgtcatgcatggtagccaaattaccaaactttgtcatttatgttttatgtgatagatgaggtgagatttaaggtcatccttgtggcatccttctcttgcattggttctattatgtgttcttgtgagtctgaggggtgaagtgataagtggtatgttatgagttgcaaatgttgcacagattttcttgatgctgctcagcccttacctgggatgccccaggcagggagacacagacttgactgtcatccacagattcaggaaccccaatcatggtttattaggccattcttgcatcgctattaagaaatacctgacactgggtaatttacgaagaaaagaggtccaatcagctcatggttctgcaggctgtagagaaaacatagtgttggcatctgcttggcttctgaggaggcctcagggagctcttactcgtggcaaaaggtgaagctagaacaggaacatcacatggagaatgcaggagcaaggaggcagggagggtgccacactttacactttacaacaaccagatctcataaaaactcactatggacagcaccaagtggatggcactaaaccattcataagaaacccacccccatgattcagtcacctcccaccacaccccacctccagtactggggattataattaaacatgagatttggtggggacatatatccaaaccatttcacatggtgatcacctggatttcacctgctccatgcccccacataactctgaaaacactcaagttctattatacaataagcacaatgttaaagtttaacaggtaatcattatgtaatcaatccttatactactaatttggtagacatcactatttttcattctatagcttatccagcatttcacagaaagtgaagaactcttgttgaacacagataagatgcttctctgtaaattttgcattttcttaatttgggataaagataaaaaagttgtcaaagactgaaagcccaagtcagagaatcatctgacatgaaatgatatcatttctaaaattaataaacctgacttggggtcctcaaagtatcccaagcaaaatggtcattttttatagatttttaaaaaataaaatccagttatgcatatttcttttgtgccagactcttcctgaaaataatttttcaaaatgattgtcacagctctgccctagaggaacttgcaatcaagtaggagaggaagagatgttcaataaatgattctcaaaggacatagccagcgactctaagtggtccaatgaggcttacaaatgaattggaaagggacagttgttgggaaataaaatacaaagacaggtagaaaaaatgccaaccttttgagaactatagtagttaggatgctggagtaaagataagaccgcaaatttccattggcttaatttaataaacacatttttgctttgtaaagtcaggcttaggttggccaccctctttcatcttgaaactacaccgtatggcaaaatgatgtccaaggttgcagtatcagggtaaagcagttaggcttcaccctaacctggcacttcatgtccactcccaagcccactgatatggtttggatttgtgtccccacccaaatctcatgttgatttggaggaggggcctggtggaaggtgactggatcatggaggcatatttcccccttgctgttctcctggcagtgagtgagttctcatgagatctgattgtttaaaagtgtatggcaccatctcccccaccactcctgctctgccatcataagatatgcttgcttccccttcgccttctgccatgattataagtttcctgaggcctcctagtcatgcttcctgttaagcctgaagaactgttaatcaattaaacctcttttcttcataaattacccagtctcaggtagtcctttatagcaatgtgagaatggactaatacaccccttgtccagaattagtcacatgaccccaactttattgcaaggatggcttggaaatgtaggggaacacgtggatatttggtgaacaccacttctgccacagtagtggtggactttcagtgaatttgattaattttgtcttactagataagagaaatagcagtggagttttggactctagatgaaaagaccattgtttgacctcttttgggggagtaactgaataaatttggcacaagtttatgtaatcacttggaagctaaactatttttgtgtgccttgcctgcttcatgggatcaagcaatttgccctggtgtatgcggatgtgtttcataagctgctaggtgtggtgaaaatctattctagtatcattatcaccactgtcatcaccatggtcacctaagtgaaaggggcagaaactgcccttgtctgtgtatgtgaccagagggaagtaaagtccctgcttatccttctagttccatgtctctcctttttccttgaagtaccatgaactccaaacttgctgaatttttgatgatttcccaaacatgcctgatctttcctgtacctttttacatccttctccctctgcttataatgccttttctctccttttctcctctctttacccagataatacccacctgtctcccaaagcttaatcccagaaagtacctatgtgtctcccaaagtctaacccaagattactcaatctgtaaaggttttccttgatccccaattgtaggacagcttgggtacctccctacatacatatctcttgtgtgaaactttgcctacatatcacttaaccattcacacatctgtctccctgattagcttacaagcatcttaagattggggactgagtcttacttttggttcagtagtacaggatcaggacttgaggatgcattaattccaaacccaaatcaaacacttactggttgtatggcttcagatgacttatttcatctgtttttgccacggtttcctcatctgtaacatgaggaaagcaaaaggtacttacttggggttgtcatgatgattaaattaaaaatacatgcagactacttaataatagtgccaaacacatagtagaggctcaacaaatatttggtgaatgaaggaataaatgaatgaatgagtgagtgatcaattgactcagtcttatgatggtattacttaacaaataagctaactaactaagactttgggggaagattatctgctcaagttcacacagctagtttatactgactgactctaaaacttgtcctctagctgctgtaggtggcctctagcaggtgctcagcaagcaagtgaaataaacatcagaactgatgaaccaagacaagcatggtgggaaggggaaaagctgtagaaacgtcttaagaacacttcctagcttctgctgaatcttggtcattgtgttttgttttgttttgtttttgtttttgtttttttgcttgttggacttttctgattcctttccagcaggtataaaaagaaaacagcctgggcagcaggattggaagcctctgggcacagagcagggatttttcatttcacaggtcacacaccacactcagcagcacagcgcacaaagtcagtcttgattcttaatgccaggaggaagcaaaacagggcttgttgttctgctctgggcctttggtccaggctcactggagagtgattacacttttgtcttttgctgctttaagaggggaggcaagaagtcccaggacatgagccaaacagtccatgggttgggtgtgactcaaacactgggcactctgagagccactttgacaagccagcctcctcaggcacctgaatgccagatcagccatgcccaagtaccttggcttaagctctgatgccaaaagggataaagcagtacaatataaatgtaaaacacccttgacagtttggctcactttctttccctgggaggcaactcctgtaagtaataagcagaccttcttgccagtgccctgtcttatacctataccttagataccttaggcatctaagcggaaccggagcttgagaaaccagtggcagttaaggacagacagcagaggaaccagatctagtgctgctccagtattgaccagctggggagcaggggtattgcacataagttctacacctcagtttcaatgcctctaaaaggaagtagaggatccctcattgaccctcctctcaggattgtcagcaggacattaggagcactaaattgccctccatgaagttctttgtaagctgttgtaatttgtgcccacagataactgtagaagataggcaagcattgacttcagacatcgtgctgtacctagttcccaatgccccactgggttctctttccaaaacaaaggtctcctctgtaaagaagagaagaatggagagaactcatgagactgttaaggattttacaagtgcttttgttttaaatatgtttcacacatactttgttttttcctgaattattctttccaagagagcagtagatctgtacttgggttttcacccagaaggaagaaactaaggaaaccttcacatttccttctagaagaagggagaataaaggaaatcattggtttcttagtaaaaactacattgtgttttccttctccctgtcaaactctcccatagtttgcttgctttgtcacaaagaataaaagggttttagaagtcttggtgtttctaagagccttagttcttgcaacagtctcaccacatgagtaaggaaaactctaaaaagaaaggaagtccctctttcacaaaagaaacctagacactcagccacacacacaggcttataccaatcataaaaacgtaaactgtaaaaacctcaaaaaggcaataccgaaatatgagtttaggaatatgagtaacattatgattgacaaagcaccagcactggagtgggcccagcacttcatttacatcatcctgtttcatttttagagcagccctaaaatgggctttatttttgaacacagagactgagtaactggcctaaggccacacagtcaaaaatagagaaatgggattaacacccacttgtttgactcctaacctgtgctcatccttctaggccttcctcccagccctgcacaatctttgggaaggtgttcagcagccctgacactccctgcttgagccattctccatcccctgacccacctgagtcatgtgattcccaacggtggcagaactgggattccctctaccctgggatgacttcctgttgagtgagaaaaaaatgtgctcattccatagtacaatttgagttaacacaatgcctgttcatcacatgctggctccttttctcacccagctgccaggtcctttgtctgtttcccctgaaggaaaatcatcaacttccaatggaggcaccaacttctctggacagtagcagaggccttctggacatctgaccagcagcacagcatgctggagcactcagcgaggtgtaggaaggtgacttggctggggtggaccacaatcaatttggaaagccacagccctcagacatttacgataaagcaggagtgatttgagaacctctttcctagctactcatcttcccaaggcagctctatcaccacagtcacacccagccagggagataaaaggctgacgcttgctatctgctcctacacaaatgagctacatgggcatccttcatatgggctgttcttctcctggtccagtatagaaaacaaagttagtgactggggagagggccgaccatcctgtaggggcaaatgcattccccttaccgtttgtggcctagtgctccgtccagctttcttacaaagtaagcatagttgggattgggtttttgtgctatgcagcttcatctactttggcaaataacaccttgaggcttatttgcaaggatctttcccaagtcacaaaggatagcagcacagtgcagtggttagaaatgcacgttttttattattccttttacacaagttcaactcccagttctgttgcttcttacttgggaccatagaaaaagcatctaagctttctacacatcggtatctttgtttacatatggtgataataataaaacctgcttcatagaggagatgctctgtggaattgcccagtatagggcttagcataatgaaagcattcagtaagtgctactactattgtttactattattgtccagcatttactagagtcactaactaaaccatctggtcccagttctgatatgtttttctcccaggaaggctttgccaacacagccctcccaccctagtctggattgagtattcttccttggtgtattccgcagcccgtgttcttcccccataagagtgaaaatcacccaggcttgaaggaagggactatgtctgctttgtttattgtatctgacatagaacctggcacacagaatgtggacactcaaaacatatttgttggatgaataaatgaatgactataaggaaagcttgaggtcctcgccatattgaagaacccaagaaacaatcaggcaccaaaggctctattaaaggaaacggagggtacagtggcagcacagtgatgagaaggggtggcaggaccattacgcatgtcttcctacccctaaatcgcatctgtgccttttatattgtatcatgttagatgagggtctctcctgcctgtgagagtggttagctccccttccacggtcatccaaatggttttctttcgagaactagcaattacttcagtccttctctcacgcaatcacagcagctgacccgaagccccttgctccagatgcatggaaaagcctgctaggctggagaacttcttactttctttcaacctgtcaaaaatgacagctgtgtatcactttggggagagttgagactggcacaaaactcatcccctgatgtgtcataattacatttctggctttattacacttcttagtatgtagtttgggtctggacactaggatggggtggccatgctgatgtgatgtcctgagctgagagacctcagggtacatgagggctttgtgaaggtctttatgatggaaaaagtgtagcgtccagatagatggatagcaagggagaccctacagaagttcatctgaatctgtcctaatacttctgagtcggatatcctcttctttcttggcatctcaactgagctttgctcttctaattcatcttagaaagtgaaaataacaatttcatgtcactttttgtctaccacatgggcaaagctatttttttaaatgataatacatagtgtttgtaaagatacggaaaaagcagaagcccttttaagctacttgagaaatataaattagcacagctatgtgttccaatacattttttcattactcagaactagcataagcctttagcaaaatcatcaatgataaaacacgcgcttcccttaccccagtgctggagacgagaattcctgcaaggccagctcggggtgtttaggaggggaatggaaattatgaggcaagtcccattggggtaaaagttcgtttctaaaacccctactaagccatcttgttcatcaacataaaagtatcatgatactccatgggtttaggatggaggctgagataaaatgagaacatcgaggatattaatcacattttgctacatacaaaatttggaagcacagccaaattcactcaagcttggactttaaaatgggtttcctccctgcaggcactgtgcacagaatatttgttgttattttgtgatcatcagaggaacgtgagttgtgcatggtgcatcattctgctggacacccctgccccccaagtttatgatcatttaccttgagagctaaaatcagatcgtggcattccacacaaaggctatgctgctgtaattaatgcagagtcctcacatgctgtatggtatgaattgtattgctaattatattattatgaatgtggtttagagtattattaatgcaggaaatatcaatacttaaaagcctcactggcatgaagatttttacttcggtaggcatgaactggcctggaagcattaaatactctcttgcttagaggcattaatctgtattccctttgaatacatttaattaaaaatttcacctttccaggaattgttgtttttatgcaaccccaaaatggaattttactggagggcaggtcttttacataagcaaccatttgttcagccagggtgacgtccctcagacaaggtgtctggtaacgttagggatatggtgaaggagctgcccttctctgtcacagtcttgctttcttgagagaagtctcagctttatagacaaaaataaaaccatgttcagagtcaaatgcagggacacaccatccaggatacaatttcattgtgtcatttgtcattgcttttttaggacccacttaagtccatcttaatccactttggaactcagcaaccagggctctgaagtttgcgatttcttgtatgtgtagatacttgcagatgtgattttgctttgtatcctcagatccatgaggtagctattattatttccatttttgcagacatgaatggttttttaactttagaagtgggatccttaacctcagactagaggttaatcacatgttgatagcaccgaggcttgaggagagtcacacagctggtaggacctggctgggatttgaacctgggtctgtctctaaagccaagtcccttcctagtttccttcaggctcaggccagtgactcttccatctagggtaacaagccaacccactgaatgggactgagaggtttcctgggatctggaacttctagttttaaaatctgggacagtcccaagcaaactgaagcaagttggtcacactaattccatcccctaactcctcattttactccatcttttcagctgattgagatgttgagtttattatagacaggatattggagtctgttgactggctccctttctagaaagtggttcctatgctaggaatgtcagactggcacacagagaacatttgccacagggagggatagaaattccttgaagcaaatatgaccgaagaagtcccacaacaaggggcatggatcagttaccacaagatgctaataccacagtagatgatttcctgcagcattgggtttggggaaccataatggttattattcggagcaaggtgtcatggagacaaataaacagacatggtctattagggtaatgggggaaaaaagcaacatttatcaagtatttacctctccaaataatttgcagctgatttaagaagctcttcgtgaccacacctaagagtaccagactctaagactttactaataaagttgaaaatatgctagtgttaatatagctggcacgaaagaataggaaataaatgcctgaagtttgtcagcttattaatcattcctttgtaagcggtgcttttacttttgttgttgcaacatctaaccacagttcattggttaaaggccaagctagcttttgcattggcatatcaccatgcgcaatggctctgtgcttcttgtctatttattaatgctgcagacttcctacaattcagtctaaaaatagcatcagttctgtgaaaaatactgcatttgtgctttagccatggtaaggaaatatggaagggtatatgtgtgtgtgtttgtgtggacccgaagaaaacattgtggtgcctaaaatccataattgttacactcctgaaaaccttacttttttggcatacctaaaattaaaagaaaaaaactcaaagggagtaagtggaaagagaagggtgaagagagaggctgattccctcccccggcccaaatcctagctatgcataatctctgtttatttttagtacacaaaatgatcatgctaagctagaatgaaacctcagaaaaagccttttattagagggttttatccttaaatgaaactgtgttccctcatctcaggtcctctgctaccttcctccatctgtttgaactgcaaagcatccatggaaaaactatgggtgggcatatttccttacacaatgtctggaaaaaatatattactttgggtgcttttggacagaacattcctagacaaaatttattctaactgtaaggttttcctaaaccatatccctggtttgaaggtgtctagctatctatttagccatgccagcactcaagcatgaatgacacagtgataatttctctaaatccatgatttattttggacccacaagaacttgaacaagacaattaaggtttgagaagccatgtgaacctgagggagttgccagggacacaggtgaagagtgatagaggatgtgtttcatcatcaaaaggaagaacagcaatagtgataaggtcctatggctgcacaaatagagaaagtgaatggtttgcctatcaggcgtatcaggtgttgggatttgatgcagaactcctgaataatatgttgtttgccttttggaggaattaagaggaaggaaatgtcattcttcaccttcacacatgattgtgaagagagatggtagaatgagaaattgttgtttcctgtttctgaaagatactgacagggaagtaccagaggaactgggacagcccaaagtggcctgagaaaagaggacttggcaacatgctttttaatcagccttggtatcagaactgtgtaccagacagagggataacagttttgtaatagtagagcgtagtgggaagaacttgggctgcagaatcatccatttgttcaataggtgtttatggagcacctgctgtttgctgagcaccttcctgggtatgggtcaaaagaagttacactgaaacctggttccactactttctagctatgggtctggggcaaagcacttaacccctctagaaaacaccaatgatggtctctgaaaataaggattctaagtcctaatcttgttgggaggacaaaatgagatcatttatgaatggtgagtcacttaaatctctgtaagccttaggttgcttatctctaaaatgaggataaaattacccaagtcgtagagctatgatgctgtctagatggagtaacagagtaactagttgtgtgccagccccctaaaatagtagatggcattttaggaggctgtgtgttggctcaggtgaatctatttcagaaagaacaaacttcaggagagtctctgtgaggatagatgggaaactgtcactttgggaaggttctgtacctcaaagaaagcctgtatcgtgcaaaagattccagaagaagggaggtatatgttaacccttattttatgttttcagaagaaaggaatatgtattttgaatcagaaataaactagatcctttttcagatagtaggttctgcctcagatcatgagggacatagtgacagactttgctttcagtgtgcccttgggcagcttactttctgctgctgggcaaactgatatttgcccatacataacagcattggaaaacagaaagtcctgaatgtcataggagagttatgggtttcaagaactttccaagagctagcaaggaagtttgagactagacccaactgaaagcaaatgtcctatttgaaaaggggaaagtgttaccatgtgtcatggcatggtgaaaaggacaagaccttgaacaaggagagcagccacaatttcaaggctgacaccaaggcagcagtgcgaggtcaggcagaccctcttaaacccaatgaacttcagctgtcactactgtaaaactgtccaggagtatgctaactttcaaagttctataatattaggagtcttatgatatctgcttgctggtttataaataatttgggaaaccgagactccatcaaatgtagtggcccagagtgaacttgtgattgtgttttcttgcctttcttactggaaggcacctgggttatttctgtcaattagaccagccatttccaatgaatatgctcaccccaagcttctcactgctccagagggcataaagaacacattctttctcacatctagagactcaatgcctgaatgggcagcatcagacagatgtcaaccatgaaactttacacatacacacacagaaaccaaaaaaagtggaggctgaagccgcaatatattgcatcaatttacgggctagaacagaaacagattttcaaacaccatatacagatcttccgtaaaggacccaggggacaaggatgctctcaaagcatggaagaatgaaagggaaacaatgagataggacacgaggaagaagacaaggaagagaagctccctatgtgattaaatgcagataggtggaggaaaaataaaaacaagcttcaatctctgatccctctcaaagttttgaatactctctgtgggaaaacacacaatgaaattagaagtgatgcacattgaaatgacactggagaagtggtggcagaaggcagggtcctcagctccgacccatttctgctgaggatgaagggacatgggccctgctgcacctgcaacctggcctgtcagtggtttgcctcattcattcattcaacattaatttgtttctctgcttgcctactaggatcccaggctcattagggaggcagacacatattcagctcattataccacaggatgatagagatacattcccaagcatgggcataaaaactaagatgggggtaattgattcggtctggggcccaagttcaaggaggacaaatctattgagtcccaaaaagctgcatccttgggcccgttactcattccctctggtttccctttcctcatctgtatagttaatggtgccgggggtaaggcactgagcccagtgcctggtaccctgtaaacaccaagtactggtaatgattagaggtagtgatttattaagcttctaaaagagttttatagtcatcattttttctcttctggcaactgttccaagaaaatccaggtacggttgaagattgaaatgtgtgtggcttcttgggatcttggtgtagactctgctgctctgaactaactgagtagacaggtgtcatgacacgtgtctctcttgctgagttccagaatgatgaaactgggctttgaacataatgtcttcagcctcatgaagcccctatacgtctgttcttcgcccacgtcccttacgattggctcacaaaccagatttcttctcatgaatcacttttttcctcttaacatcttctgctctcccaccaggcacttctctataccttactggttctggtggcaggtggcactgcacaagtctaccaatttgaaggcctgctgccctcccagcttgtgtgcgcctcttcagcaaggctggccgaaggccctgccctcaggttgcttaccgtcagcctctctccattctcaggaggccccaaatactggtctacctctattcaaaatcctccaatgtcagccaactctctcagaccaaaggccaacatcctcattatgatgtttgtaatccattaggttggtgcaaaaatgattgcggtttttgccattgcctttaatgacaaaaacctcaattaccttatttaaaatattttttatttccataggtttttgaagaacgggtggtatttggttacatgagtaaaatttttactggtgatttgtgagattttggtgtacctacacctaagcagtatacactgaacccagtttgtagtctttaacctctcacccgcttccctccctttcgccctgagtccccaaagtccattgtatcattcttatgcctttgcatcctcatagcttagctcccacttacgagtgagaacatacaatatttggttttccattcccaagttacttaacttaggataatagcctccagtcccatccaggttgttgctaatgccattaactcattcttttttatggctaagtagtgtatatatatatatattacatgtatatatatacaccacagtttcttttttttcacttttcctcccagctttattaaggtatacatgacaaaaattggatatgtttaagtacacaacttgatgctttgatatatttatagtgaaatgattactgaaataaagataattaacatattcattacctcacatagttaatcattttgtgtgtgtgaggtaagaagacttaagatctaccctcttgtaaatttaaagtatacaatatagtattattaaatatagtcaccatttctgctttttgggtttgactatataccacagttctttatccactctgattgatgggcatgtgggctggttccacattttcgcaattgcaaattgtgctggtctaaacatgcgtgtccaagtgtctttttcatataatgacttactttcctctgggtacatgggactgctagatcaaatggtggttctacttttagttctttaaggaatttccatactgtcttccatagtgattttactagtttacattcccaccagcagtgtaaaagtgttcccttttcaaccgcatccacgccaacatctattttttttttatttttttgattatggccattcttccgggagtaaggtggcatcgcattgtaaaaacctcaattacttttgcactaacctaatagttccccacaatctctctgaactcatcttctcctgctgtttccctcattctcttcactccagctgcacttccctcctagaagtttctcaaagaactcaagtcttcactcttgctcttccctctgctcctgagaattctgccccagcagaaatgctgtccctctgcctggaatgtgttccccaaatatctcgctgtctaactttctctgagatttggggtgccagataaaatacaagatgcccagttacattcgagaacagataaataataaataagttattaataatgtattactttaataagttattgtttattatctgaaattcagatttagctggacatcttgtagttttatttgctaaatatggcaactatatcagagttcttcacttagaagttgccgtttggatgcttatattggttttctattgctgctaagacacattactacaaacttagtggctgggaacaacataattgatcttgcagtagatcagaagtctgatacagatctcattgcactgaagtcaaggtgttggcaggattatattcctctctggaggctctcagggagaatctgtttccttgtctttcccagcttctagaggtgtacacattccttggctcctggcacccttttattttcaaagacacaatgtcaggccaagtccttctcatgctgccatctttctgattctaccttctgaatccttcttccacttataaatacccatgttagtcagggttcaccaacaggatggatggatatatagatgatagatgatagacagatagatgagagagaattcattaggtgcattggctcatgtgatgacagaggctgaggagttctgcagtagatatctgcaatcttcagccccagggaagctggtaatgtgactcatggcaagtctcaaagctacagagccagggaagccaagggggtaattctcactcccagaccgaaggtctgagaacctgagaggtgggggtcgggggagcactgcctagtgctagaatccaaaggccagagaacctgaagttctgatgtccaaaggcaggagaagaagggtgtcccagctccagaaaagcgagagagaattcacctttctctgcctttttgttctatctgggcccccagctgattgtgtggtgtctgctcacattgacagcagatcttccccactgagtccactaactcacacaccattctcctctggaaacaacctctcggacatacccagaaataccactttaccaggattttaggtatcccttaatccagtcaagttgacaccaaaaattaacgataacagtacccttgtcattatattgggaccacctggacaattcaggctcctctctggatctcaagggcagttgattagcggctgtaattccctatgccatggaacctgctgtagtcacaatttcgaaccattagaatgtggatatctctgcagagccactattctttctatctcagtggctttagccaaggtatccacattttcaaccctcccaactccaacatttcatatccctcttccctacgttaccttttctctttggtacttatcactacctgacatagtatatatcttttgtttatttaatttatttattatctgactccttcattaaaatgcagttcccttaagagcagtgattttcttttttcctgcttatagcacccccagcacctagaacaaataaagagcacgtagtacacattcagtaagtaggtgttgaatgaatgaattagtgaatgaataattgaaccacaacctctgccaactccattttcatacagtgctggcatcatcaacatgaatcttacttttcaccaaactcccttctatccctgggaggggagagggctgcagatacaagcgcacagtgatggaatggctggggagcaattgagcagctgagtgctgcattattgagaaatctttcctttcctttgcgtcagagcagagctggagagctgttgcctggtagaagctcccaagaaagcagccaagaagacagctgttctaaatgcagccacacttggcatgcccagaaccaagagagagaagaccacatccccacactgatcagcagccccgaaatcctcccaaacagcagccttagggacacagccccaaaccccagcacaaagctgtctttaacagtcttgcgggtacttatcccagggcaggaggcaggtgtaaccactcagtcaatgttcagaagggattataactgcatgaacaagatagtcatgttccttggaaactgtcactgacagctctcaaggaacatatccaaattcccttatttgcagtattgcaattataaagctgcatttataaatgttagtgtttaaatattaccttaccgtaagtacctagtctctcaggtccctgggaagaataaccaatatgctataaaagctgtatatttccagtgaggcaaggatggataattgcaaagggttcctatgctgggggtcagtctccaagcagccattgtttgccttttgggatatttggtgctttgtttcaccaaacacatcaaaatgctgatgcttttctcatgttcaggaaacacggatgaaagagcaatattgcgtttgacacatttcagtttaatgtaaaccctaatggcatttgcagagggtttatcacacacagaatgtttttgcctacatcatctgtgcctctcagctcctctatggggcagaaagtgaggctttgatttaaccggatccctgcctgcctgtccactgcagctcaggctctcagcccctccctcatactctctttccacgatgtggtggtttccaatgccctgttctcttgcattcacacgtatatttcctctgcctgagataccctccctacctctatcttaggaatcttctctttcacctggctgactcctaattcatctttgtatgtctcaacttaaatatcgattcctcaggcagcccttcctgacacgctttgcccttctttattatgtgcatccagtttggaatccttgtttatcacctgtctctccctccaacagggagcctcaggggagggagctgcaactgctgtgttcaccattgcatcccgagtgccactctccttcctgagcatatagaaggtgcctgataaatactatgtgatacatgcttgaataatgtgccccaggttactacagttatgaaatggataaagcaagatctggtccatttgttttccatcctaccgcatccctattttcaagcattcattccttccacaaacatcagacctattgcttggtaacttgaaagataaataaaataaactcacaggatacagcccagccctctaattgtttatagtctagtggggagcacactaatagttaattttaattgtcaacttagctagggcgtaatattagttgctgcaggtctttcttacctatggttttgtttcctgcagtttcggttacctatggtcaactacagtcagaaaatattaaagagaaaattctagaaataaactattcataagtttcaaattgccattctgagtagcgtgatgaaaccccacactgtcctttgtcccgcctggaacatgaatcatccctttgttcaatggatacacactatctacactatccacccattagtccctgagtagcctggatacacactatctacactatccacccattagtccctgagtagcctggatacacactatctacactatccacccattagtccctgagtagcctgcttggttatcagatcgactgtcgcagtatggcattccaggtgttcaagtaaccattactttaattaataatggtcccaaaatgtaagagtagtgatgctggccattcagatatgtcagagagaggccataaagtatttcttgtaagtgaaaggtaaaagttctcgacttaatgaagaaaaagagtcctgaagtgactaagatctacggtaagaatgaatcttctacctgtgaaattgtgaagaaagataaagaaattcttgctatttttgctgttgtaccttaaactttattataggtatctacatataggttaaaaaaaatggtatatatagaatttggtactattgacagcttccagcctgtggaaactatggattttgggacttggtaacccataaaatcacatgagccaatttcttaaaataaatatgtacatacatgcatacgtacatatacataccccattggtactgtttctctaaagaatcctgactaatatagtgacagacaatagacagtcaatgtctgaggccatttagagtaattctgggccactggccttcatttttagtgccttggctgaactgaaggacaataattcgtcaataagaatctttaaaacttaccataaatttgcttgtacctctctaggtgacacacagcactccgcagatgtttgttaatgattgtggtgtatttccaggcagatgattcctctttcttttgtaaacctctaactactgtgccttagaatttagagatgctgctagaacccacagatgggatatttgaggcaatagcccaatggtcagaacaagttatatataccatagacagagtgaccaatattttttagacatccattgtatcatcaaaatctaattttcaggttatgtgtgtgtgtatatttacatttctctctatatatacagagatacatagagttgttcctcagcatccataggggattggttgtaggacccacagacaccataatcccccatataaaatcgtgtatttgcacatagcctttgtacttttgctcatatattttaaatcatctccagattacttataatacctaatacaatgtaaatgctaaataagtagttgttatactgcattgtttaggaactaatgacaagaaaaaaagtctgtacatattcagtattgacacaaccatccattattttttcaatatttttgacctgtggttggttgaatccacagacgtggaacccccagataagaagggccaactgtacatacatacacacacacacacacacacacacacgcacacacaaacacacacacacggcggggaatatctatacaattttaacaagtaggtcgtgccaagttttaaagtgtcttctgtgaaacccctgcccccctcttggtaatagtccaatcatattaaacatgtatagagcactttccataagccagaacctaggtaaatacctcaaataaatgtgcttgtttctgctagttaccccactagttagttactattgttataccaatcttgccgatggggagactgaaacaccaagagattaagtcacttgcccaaggtcacccccttattaagtagctggagtttgaaccgcagctgaatttgcatacctagccacaacacacgaggctcccagacacccaaagtccttcatcttgcacatattgtctaatttcttataaactatgtatgtcaatcagagtccacccaggaaaacaaaacccacacctcataatttaatagaggaaatttaatatagcatatgcttataaagatgttggagctggacaaacaatcacaggaagatgaggaagcactaagattagcaattgccactcctggggctagaagaacaaaggcagaaggtgtagggtcacctggtatcagctggaactgtagtggatgtgtctgatgacagctgctgaaaaggctacctgaactacagagaaggcaagaaatacccctccttatttccttaaacatagagtaggttgaataggctccctcaaaattcatattcccctggaaacttagaatgtgaccttatttgggagtagagtctttgcagatgttatcagttaaagatctcagcatgaaatcattctggatttagggtgcaccctaaatctaattactggtgtccttataagaagaggagaggacacagacacatagggtaaaggccatgtgcagatggaggcagagattggagtgatgcagctacaagccaatgagccccaaggattgcaggtgcctgccaccagcagctaggatgagacatggcaggattcttcatgggagccttcagagggagctcggccctgcctactccttgatttcagatttccagcctccagaacagacagcatacattcctgttgttttaagccacccagtctgtggtaccaggatatggcagtcctaagaaatgaacacaacctgcttctctctaatctccctgagtacctccaactggccaaacctcgcctgaagccagttggcaaagacagctgggaaataatgtgcaggggcttgtctcctgccatgcagagctggaaggaagagacagggctaagagcaaagaggcaaataacccaagcattgtggaagggggtgcccaggcaggaagatatggcagagaaattatggctgtagaatcagaggtaaagaacagaacagaaggggccttgaatggtctcttcatgggcctaacggatgcagcagaaatcgtgagcttggctagtctgacagggctgccccagggtaggaaaacagtccaagcacttctcccctgggtgggtcagaaaagcagtcaatgacctccttcccaacagcctcaaaagtgaaatcaggaaagatcactctggaagaaggatggtcccttcaagactggagtgacagctgccgccactctcctctgcctgagaacggagggacaccctgtctccagggttggacgcgataactttcatgagtaatcaatttgcaaacagactgagaaaaggcaacacatcccccggttgcatcttcagataaaaaggagtatgttttgaatttgacaaccaatctacctttaatcctatcaggaaataaacctcaatcataatctgatgttttggacttgcatcgcttctaagggaaagtgtttcctctatcccttgttcttcctcttcagagcagagtgagtttagtcatgtggatgcctgttattcattcttatctgcttcttagtggggattatttgcttttttgtttttttttttcttttagattccatatattttttcattatgtgtttcttaattagagagactccttcactcttagataagagtttgttttttaatctccccccacccccatcatctgatgtctttctggtacggatttagccagaggagtaaattactggcggtggggcggcggggaggggagggtgaaaaaacctggctgtggagttgaacatttggtatttatcactgaattctaaatatgggttattatcggagacgttagctactaaaatgccatgtgccattggcctgattactactctttggggcattcattgttatctagtgaccctaagacttccagagaccatgtgacttacttcccaaagaagcttctcagtcccataatacattgagcgcctggctcagtggggctggcctttaaggccatagcatttctcatcacaacagtgttcatcttttgcgtgctgacctagttccaggcttttgtattaagggttacttactttgtttcaaactgtcagagataagtagtattatccccattttctagatgaggaaactgagattcagagaggctaaaattcttggccaagaacacatagctagataatggctgacttggaggggnnnnnnnnnnnnnnnnnnnntagtggaaccaggtttcagtgtaacttcttttgacccatacccaggaaggtgctcagcaaacagcaggtgctccataaacacctattgaacaaatggatgattctgcagcccaagttcttcccactacgctctactattacaaaactgttatccctctgtctggtacacagttctgataccaaggctgattaaacagcatgttgccaacaaaccccccccagtttgccatgtattagctctgtcgatcaataccatttgcaaagagaaacacaaaaacagtgaaaggctttgaacttggtatcttagaagtcatttaagccactgatattcagagaggtaaacaacatagcagttacgagttaatagtacagggttgaagtcagagaaacttgactgaacctcttctctgcccttcaaatagctgtactgccttggatacactgtaggaaccacattctttatcactagttctggatgatttaatgggtttgggtatgagttttctcacctgtaaaagtgggccaaaaggtgggggtgagggttaatgacataataatttaaggtgcatactccagggatagacatagactaggcattctgtagatattattaattaagttatgactcaacaaatatttgagtatacctaataccgtgttaaataaaaagaaaagtaaaatatagcttgccgtagataagaggtgaacgaggccacaagaaaggaaaatttctaatgcaaatataaacactgggatgtgcaaagattcacgataagtgctatagaagcaaaagagtcccttgcaggataggatggtcggagacagaggtgggatttgagctggaccttggaggaccttaaatggttcagatggtgtgacttagtgtgggcgactggttcgcaacaagtaaaggagctctctccaggacataactcaactatttcactgggcatattgtttagttgatctgatacctttttaatgcaaaactttctcaataaagtaagcagtgaattgaacatgctctgcctcaagctctttatcctattatggagacgtaacaagtcatttgcagccaccttcttggaatagtaccgatttagttcaagggtcaacaaactttctgtgaaggacaagatagtgagtattttttaatttgtgggctgtccaactactgagctttgctgtagcacaaaagcagctatagacagtaagaaagcacggatatttagtccacaggtcatagtttgccaaatcctagttaagatgactgagaaagaggagagaaggccttttaaaagcaaaaaaaaaaacaacacaagcaaaggtctgagcaacgcgttgacctagcaactctgaagagacctacatacaaagagtagagggttcaaggccataggatgtcacacaaaaaacatggaattaaaatgttgatggtagacagagcctagattgggagataatcaaatactgctttgtagttcacagccaactctgacaagcaccacctgttcctgagattcgggcaatgagatgccccagaagaatgggtatgagtgtgtagtgaaaagaatcaaatttctccaggagaactgtcagatgaaaagcaaaacaagagcaaaacactgcactgtctacatttgttaggtcctctgttaatatgaaaaggcaggaatcctgggactgaactaagagcttcctgcctggccaggacatacatatgcattgtgcaaagcattttgcatgcaggagacaatcatttattcatcaaatgaacaaattcatcacttcagagcacacaggaccatgcctgatttgtctgtcattaacaaatgactccttgctataaatctggccaagctatctattatccatccatccatccatccatccatccatccatccatccatctccactcattcatcaagttcctgttgtgattacaaaatttcataccaaagggtcagtgttggggccagaatctccagaaaaaagaggtcagaagcataggagagcaagctcaacctaaaacattcactaaatctgcaaaaaggtgtccttggaactttgccaggatgaacaatggctttcttagggatcctatctggacttgacagggacaccatgtttatgggttttatattcaaagagggatctcgggccttgctgatcccttccctttccacagcgtcctgggattcctcatggtattcttcactccggtactaccccaggaagagaccaaacaaaagtgcaagcctgcatgcaggctgctgcagatgttgcagacatgttgtctttggcctttctttttaggcaaagggaaaaagtccagtgggcactttgtagctgtcctgactgtgcagattagtttttttcaacatcaaaggaccatgtgttattatgctcagttctataatgtgcatttgactggtgtttttttatgtgtatgtggagtggggtaatgaggaaaaggcatatatcttgtaacctggctcatacttattacaaacaggggactcttcctagagtcgatggatggggctatagaggattcaacaaccaccagaaattttgtacaaaatttgaaagacaggctgtatagccttcaccagattctcttgagggtctcagacctcagggagggtaggaatggcagctcccaacggatttgactagcaactaagggaacccactccccaaacctgcttcctgatttcatttcataatgccctaggcctttgctgttgccaagatgcactggcttactgccaaagaagacaggctcttatctgagttagttctgccacctacagcacagagcccagcaaagccattgcatctttgcagcagagaagaagcctcatttgcatacatgaataaggggagggctgcctctccagccccggactctccactggaagaaaaatgactttggggattctcgattagcattcagagatgcaagctcctttggggtgggttacagcgatgggaagatatttttacattaaagggaaagggataaattttgaggattagcacctgaaaaagaaatgttgctgaaaacccagagaggaaagtcactgcaaaaaaggaaaagacaatgagctcatgggtcctcacaataagtgtaactctcccattttatagcatgcccaatgctgatagtcctttctaggtccaaacaggtcacccccaccgtctaccttgtcgtacaatgaaaaatacttgctttggaagaatgtgatttcctaagacaggatagttttgttaatatacttaaagcatttttaaggattccctctaagggcagagattgtgttattctcatttttgtgtccccagcaccgagcagaatgcttgatacttaggaggaagctcaataaatgtttgtttgttgatgtaaagtaatagaaatgtagtttgtattgcaacctatgcatgcttgctaatatataattaataatatctacagattattaaatagtcatgcattagacatattaactcaaattctcacaacagtatataagatgggtattgttttgcaggtgaaactgaaacccagtgtttttaaataacttacccaaggatgcatatctagtgagagtcaaaatccatacctaggctgggcgtggtggctcacgcctgtaatcccagcactttgggaggtcgaggtgggcagatcatgaggtcaggagattgagaccatcctggacacacggtgaaatcccgtctctactaaaaaaaatacaaaaaattagctgggcgtggtggcgggcgcctgtagtctcagctactcaggaggctgaggcaggagaatggtgtgaacccaggaggcagagcttgcggtgagccaagatcacaccactgcactccagcctgggcgacagagcgagactgtctcaaaaaaataaataaataaataaataaataataaaataaataaataaataatccatacctagacttcttagcttgtaaatccatgtttgttccactccacccatgtattttatctccagcataagctcatttacaataagtggtaaatgaaccaaatgaaaataatttgaaaatgttgaaaagatttttaactgttttaaatactaaaaaaaatactctaaaatgtttcctagtctttaggatttctctgaagcttttcttaccattcttgcttaataatagatgcagtggtacttctttgagggataacccactcttaaatctacttgcacagatgactgtggaatctttcactccttttggtctggtgagcactgatggcttggaaaggcaatgaagtagtctgtaacttacactttgatttgtagtagcaaagcatctttttttacaatttttattttagattcaggaagtacatgtgcaggtttgtgacacatgcatgttatgtgatgctgaggtttgggcttctattgacaccgtcactcaaatagtgaacatagtacctgataggtagtttttcaaccctccctcctgcttttggagtgcccagtgtcattgttcccatctttgtgcccatatgtacccaatgttcagctctcttttgtaagtgagaatatgcagtatttggttttctggttttgtgttcagtcacttaggataatggactccagctgcatccatgttactacaaagaacatgattttgtacttttttatggctgtgtagtattctatggtgaatgtgtaccacattttctttatccaatccaccactgatgggcacttgggttgattccacgtcttcgctattgtgagtggtactgcaatgaacatatgagtaaaggtgtccttttggtagaaggatttatcttcatttggggatataccctgtagtgggatcagcaaggaattcttaacagagtaatgcacacagagtcttcataatgttggaatatggagttaactctatagtaatcttgcctttttcacaggtttttccatattaacactttagatttcaaaaaggacatcaaagtaagcaagattgaagatccagcattactaacccaggtctcattactttacagcctggtttattagggttggtgtcttggcccctgtgatgtgcatattccttgtgttgttcaggctttaatcttattgtcttccagagaaattacaaatgaaagaaaagtgcagctggcccttaaatggggtgagtggtttaagcaagcttaggtcagtaataggtacaaacaactgaagaacctttctaggtaaacataattatcatgcttagacttaagaaggaaggaagagaacatgagacagttggtggaagtgagaagaggatggatttagaactggacaccactgggggtttgtgcaagtcttgctgtctctattatctgttcgaaagccctggatatataggtaagtggacctcaaattctagtcgtgtttgtcagaattatgtgagggcatagggatacaaaagtgtgattccttttcttacctattataagggtcactcctataacaaaagacaagttaacaagagaaaagtataacatatttattgaatcaaagttttacatgacacaggagccttgagaatgaagacccaaagatacaggaaaaatgattcatttttatgtttaggctcaatgaggaatgcacaactgtgttggactgtgattggacaaagagagtatgacctaatgggaataactgaatagggaaacgcagcaaggcctgtctgttcagattcttctttgtctctccgttcagcattccttcctcctggatatgggacaggatccttgctggaatgtgggtcttatgacctacttccaaagcaggtcacagaatttctttatggtcagctcttatacagaaaggcagggaaaagttagaataatatgtttagattttatgtctacctttggcggggataggttctggtttctatgaccttccttggggaagaggcattctagtttctatggcttgctgtgggggcgaatgagggatggcagagtagggcaggacaaagtaaaagacaaactttgctttatacagaggccttcacttgggggtatcattttctgagccccaacaggggtatacagatttggaaccccacctcaagacccaatgaaacagaagtggcatagccctgaaatctgaatttttaacagtcagcccatttgattctgatggaagtgtttcttagatcacacttcgagaaacgtcagcataggaagatcctccagactttctaagaatcactctttaaatgcatctattcgtttgagttaaactaggaacacagagataaaaggcgtagtctcagccttggaagaattcatggcctagtggtaaaggcagacttagaagcagatggtttcatagcatgaatgagtgagtccatacagcagaaggagctgggtgctatggagaactgaagagaggcacgcagctcagcctgtgtggggagaggtgcacatctgggaggaaggcttaacagaagaagtaactatgtcttcaaggatgagtgagcattttccaagaggaggggagagaagaattccaggtagagatgtgcagtcttcagagatatcaaggctcagagctcagaggaccaaaagcagggtggcctctagggacatgttcaagatgagggattgcataagaggaggggctaataaggaagataggctgatgacgctgaagactgcacatgtctttcataaaaggtgatgctttttcacagaagaaggtgcatggccgatatttatatcattgtaattgcaatagtgattaatgtgcaattccaaattgtggtctctgtcctcataagtacagtattctcaatgcagtggtattctgatgagcttccaattgagaaggaattcggaaaagtccaaggcaatcctaaatggttttatcttcttgttttcctcattaatctttgtcatcagatgtcttagaccaaagtaaggctgaaaaaattctgaccaaaggaaggaacaaggtggctgtatgcagaaccacaaaaaaacctcccacattgaatgaatgttgacatatgttatttacagtatcatcatgcataaaatacagatgagtacatgaataaaaataaaatagtattcaccatccacctttctaagagttaagatcaaaaagtgcctgtagttgccactctgttctccagtttaaaagatggatttcactaccaatctgcataaactagcattgtaactcacagcgtgtggttatacaaacaagaacagaaaccagagtagaaatcgaagcatgctgaaagaagaggggttttttttgtttgtttgtttttgttttgttttgtttgtttttaaccagaaagagttatttgaattcagaatagagctacatatatccaccccattgtctgtacaggtgtgtgtgtacacgtatatgtgtgtgtttgtgtgtgtctgtgtgtgtatccgtgtgaatcacattcagctgtaatatattataaatgataattaagtagatataatcaagtttttgtaatatttatttttcctcacatttatataaagaaaatcaaaaccaggaaaataaaagtattctcaaagctgtctacttgattccagctgttagcattatttattgtaattagtgttatgaagtagtgaaatgccaatgtctttgaacttcttgcagttgtgtgtaatattggagccaatgcaggaactgatgtcgagacataaaacttacaacctcagtccccgagactgcctgaagacctgcttgtttcagaagtggcagaggatggtggctccgccaggtacaccctcattcttcactctctctctaaacacgttttcagaggtgtcttccagggatgaagtgatgtgaaaaagaagaaagtgatcattaatttatcaggacaagtagcttattagggatattctgaccatggttgtggacataaagacaatgaatttgtgacaggcaaacatccttaagaattatctacagtctcctcacttaccagattaggacctgcaactcagagaggtaaaataacgtgttcaaggtcatcaagaaggtcattggcaaagctgagatcagagccaggggttcctgtcttctaatctagtggttcttccactgagccagactgctggcttctcacggcctaatgttttaggtttttgttttttaagaatgacagacattatgaaaaggaaggaagaaagggaagataaggaagaaggaaaggagaaaaaagaagggatggaaagaaggaaggaagaaaggaacagatgaatgaaggaggaaaggatgaaggaaaaatgaagtttgctctgtttttaaagatatattgtatcaaaagttctgatcatgaagagaatatataagcaattccatttccctcacttccctagaatgcagtttagatactatagtctcctgctggggttctgaaatcaccgattcaagtcatcattaattgtcttcctatctaatatactttcactcccaggcgtgtgttgagcctcattcatcataaaagcaaaatgtagccatttgctaaaaattatttttataaaaagtaattattaacacgaggcacatagctttctgaatcacaaaatataatggtcaccttcggctggtaagtggccaggggttttatgtaaaatgaatatagcaaatttaatcaagtacatatttagaaagctgagaaaataagtgttattttatgtagaatagttacatccccatcttatgggaattttagacttttggaatattatttttcaaatatattaaatgtgcttaaattggctttattttttcttttaacgctaataagactttatggagaaaacgtaatccactcagcaagtgctatattttctaacataggcatatataattgatatattattcattaattccttcattcattcaataattatttattgagatttattaggctccagacatggttctagccactgggagttacaaaactgaataaagcatgcaaaaatattgaatccttaccataactttaaatgtattatctccattttatatagtgcactctgagacttagggtagtaatttgacacagccagtctcatggctaacaaatgaaggaggactgtgtcaccaaaaggtttttatgtctccaaagtctattattttactaccacagccacctactggtaatgggaatagtccagaatacgcattttaggtacacttgccccaatttcatggtcaaagtataaataaaaagagcaccaaatttatactcttaaggtcaaagaaagaagatacttgtcaggagtgggcctgagtatctgctggactttagaatgtcctcctcaaccctttattcaactccatgacctggaacagttctatatcctgttcctctcatccttcagagcaagcaccctgaactcgatggaaggaaatgatagaccatttgatgaaaatctttaagcataagagacaaaatatttagggacgataaaaaaatagtaggtgagtagaaaagtcaaaaagaagtcagggatactcattggactaagtgatctttgaaatgagccttagaggaagatccttcccattgtccaccagaagtggcataggtgtttttttggtgtgattttgtcttgctttgctttgtttttgagacatggtcttgctctgtcacccaggctggactgcagtggcacaatcatagcttactgcagcctcgacttccgggctcaggtgattctcacacctcagcctcaagagtatctgggacccctggtgcgtatcaccacacctggctaatctgtgtatattttgtacagatggggttcaccatgttgcccaagttggtctcgaattcctgggctcaaacaatccacttgcctcgtcctcccaaaatgctaggattattgccatgagccatggcacccgtccagcataggtgttttaagaaaatgctacaaggccctcttatttggttccagtgtagccctgagttgccttctctccatcacagtcaggtctaaaatagagctggcaaaaaggatgctcttacttgccatttccaacttattcagtaactggcaggagaaggcttctgaaactttctcatttatgaaacaaagattacaataatagttcctaactaataggattttttgaatataaaatagtgcattggaaacattaagaatagtgacaagcattacataatgttctataccttataagtaaacaaacaaataaataaagaatatttctcttatcacactttaccttgggtctctatatttctattaaagggttgccccatccttcaagtccaaaatatttttctctgtttctgaataggcctttctttaagaggtctagtttcccctcagtaatatgctggctataccatgtactcagacatatttttttctagcaattttggaattagtagcatttattaaacagcagggcccaaaccatgggtattccttctgaacttgggaatccctaagctccacatccacagctgatggaactgactttacttgagaattctataaaggtataatagaggtgggttgcaatatgacatttcaccagtagatgctgctgttgcacactggctcatgaatttggctatttaaagttcatacttcactcgtaccttggagttagttaccctagggatcccaggagtcctctctttgttttaaagagaagatacaccagaggaaaaaagtttcccaaattttctaatggcaaaatattttaaatccaattatgaaagtggtacttgtagttacatacctaaaaaatatttttacaaaattaaatacataccattagagagaatgattaaataaaaattatttgatctacacacaaagaaaagagtgtcacatattttgtgctaaaaacacatctacagttttctccttttattctttctaaagctataagaaatggaaaatgtttaaatagtctactcttcagtttaccaagacagcttccttagagtaaccatactgatgattgccttgttgcttttgccctagaactgatccctcttcccttttccatattgcagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgtaagtctcgctttcctcttaggcccgaaatcctaactgtctgcttcctactcaaagggcccaaattaaagtctcttttcattagaaaaaaaaaaaaaatcctgggcaggttggaggtgggggagggataaaagacagggacagaggttgggatgggagggaggaactctgccatggaaaccttcccctgcaaactgggaattagaaaggaatattaagagtcgtgctgcaatgggacctgaattaaaaagccatcagagtcacagacaggagatatgtcacttaaggtttaattaaaatatcacttagcagcatgcctggtggcgtattaaggcctctcagcaccatcattggagaccctgtgctccactggaaactagctcccagcggctcagtcccatattgtaatttgactgggccttcccaacatgggcgtcccctcttattttaagactcaggtaattaaccagcagccactaaacatgtagctcagtgaagctctcgcttagcccattgcattagctaagggggaggatcagcctctggtttggtctcaactctctcgaacccttggcccctttctttcatttctttatcttgacaaagaccattaggaaggggacttctttgaattccaaagctgacagctgagggtaatcccatatagtgaaaactgcacaggaactttcttcatcttttattcattcttcttgaattctgtcccttctgcctaattccctcccatctcctaactccccagccccttattagactatctcctttaagtactttgctcctttaaagtgcttctgttccttctctgctgtccctgtcataccaccctatcaccaggtgtttggccatcattcaaatcctgagattttcttagtgcttcatggataccttttagatactctgttttccaaagttgccctatttcttgttacatccctcaaccagtacaattttaccttttccgtctttcccacgtttttccccctcacccttcttgctctcatccttacccttattgttctgatcctgctccatcgcttccatgtgcgagtggaccttcgcacagggattccccacttacttccaagtgtgtctttcacatctgcccccacctacttgtatctactttccactggtcagttctctttggccaaaaccaaccccatcagtaccctgaggattccttgggccattgtttctcttctcctgtctcccacagacagggggtatacttttcattcccactgcattagaaagaaggggtcatggggagaatgaccagcctaaaatggaaggtgccatgttacattttacaaggttacaaattgcagtcttcaaataatgaaaatagtctccaggtggtcctccactttctgagctaggctttatacctaatacctctgaagatcagggggaaaaagccaaaagaggaaaataaagagtctctttattaaaaaagtatcaagttatgcccacttctggtgaaattttgaatagagaaaatggcctgatttagataaatcaactgaaaaagtgtacacaggagcccatttctttatccaatcctggagttaaaggcagtaacattcgttagtttcctctagcaaataagaaaaagtgcatctcagaggattctgaaacggtgatatagctacttaaaggcactgtagctgcaagaatcccaatcagttcaacagatgttttctgagctcctactatgtgcccacactgtgccaggtactagcaataccaaggtgaaaaacaacaacaacaacaaagccctgtcattgaagagctcactgtctaatctagggatggcaaggacattttctctctcctgccagccctcagagtatggtattgaggaggattctaaggtctagtctgggtttggtgggccatccattagtgatgtctgacatggttgtagaagttgagagtagcagcttacatgtcatatgttttgacacatatggtctagtcagaatcatttcaatttcatttgaaagaggatatagcttctgtactctgttatgctcctgtcttccaaatcaacaactgtattttactggaggttacctgtatccagagggtttgtaacaagtagagaccctttgcattttgtgtgattaagagcaaggcaccgttaggaaatgagagttggattccatcactatctccacactatgcagttaaagatgttttaataaagtaaaattgtcagatgttacagagaggcagaaagaacaaccagattaggaaaatgtacaaattcatatgtgtcctggagttgaatggacattaaatgataagcgttggatgacttgtggtgaccatatcttttaaccctgtctactgagttatcaacactattctactggttaactagagatgctacctgcaggcatccactgtctggtccaaaggcatgtgccactatgaccacagctgtggtctgtgtagctgctgcggcagcgatgtgtgtgtctggcgagggctagggtttaatccttggattctgcttctcactccatgagcaggggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggttggtggtctttgcacgggggattagtgagaagatgtgaaatgggtgagagctggtggcacctccgggcttccagcaaggagcagaagttggccttgtggggagctgagggcatatggacctctctcagatggctcgctgttgtctctcgtggacacacaggatagagatgggaaggaaatgtactctcactgccaatgttggggggatttttaacaaaatgggggggaaatgttgctaacaacccctaatcagaggcagcctagaatgtgcatcatgctttatttattttgtgtgagaataacaaatcaagactgccagagcagataatcactatcctagtctagaggcttagaagaaccaatagaaacatgcacataaatttttaagtggccttaactgtctatgtgcatatgaagcccttaacttgccatttgtcaattatgcacgcacacaaacacatacacacacacacacacgctctctctctctcacacacacacacaactaagtatctagctagggatattttatataattagtaaaacatatgtggcatccctttgaaatttagtacatttaaaaacacctatgcctagacatcttttccagctgctcctagaacaaagattcaccgaacagattacaagcctgttggctccattggaaatgattcaaaccacgatgttcatagtacttttcttcaatgattgttgttttctaattcaatgaatgcatttggagtgttgagagcttttcttttaatatcatgcttaagttggctgctttttattttcctcctcctctttcaaattatgcttcctcatactctcccatcctctctcaatgactttggagtcacgatactaatgcagacccacttggttggttaacatccttctcctgccctgtgacgccttacgcatgtgttttccaagcccttcaagtgtgctggacacaagtcatgaaatgagattaaccctcaggtcatgctctgtacaacctagccctattctttccatctccctttgttcttgatcataagtgtcatctcctaattgcctataactcagtggcactcttttatcctgaacatccccaaacaggtaacactgcagctgcccagctaactgaataccattcatgcctctgtggtggccacactccatctaaaatcctgtcatcctttctgccagtcagaaggacggtatctactttgcatctcaccttaacagtcttcatgagtctcgttccatgtcactgtcatttctggttcttcattgcataataaataaataaatcttggaagcacagagatgaatatcccctggcatttttattgctgggtttaccaagctcacattttaggcacttacttactccatttgggacatttctttttaaaatcatttttatctattcacaagaatgattagtcagaaaacatagtttggaaacctattaattatctcccctaactcaagaatggtggggagcagaaataaataaaacaaggttttccattgtaaaagactagggggtaactaagggatttgttcaatggacactttcaaaatcccactggtccttctcctgacagtaggcagtattccattctactgtcccaggaaggccttctctgggcaaagctctagtaaaatgaatttctgcccagttgtcaaaatattttattgaattagcctttctactggaaaccccaccctctcatctccaaaagcatctggctagccctaccttctctggcctcagtggaggctgatcacagttggtcactttcctgaagttactgcacttttaagtggagtattgctcagagcctgcccagaagaatccacctgacagatgtcctgtcccatgccaaggtccctcatcaaccccatatggtcccctttgaacaaagaagctggagctctgccctgtgtatgcattcttcttccccatccctggcctctccagctgtggcctccccatgctcccagctacagtaggtggcttacttatttgcatggaaggacaatttgtacttaaaagagtgattagatggattcttcttgcacgcttccatctctgatgactaccagcttcatcaatgtaattataattagcgttcttcatcttccctttatggcaccagctggacagaccggttctctttactgcccagatgggtggcagggttgcctgtgtggtgataggtgacaggcaccatgaaataacagatggtaaattcaaggcttgttggcaatcagcaggtttttgctaatgacttaattagctatgcaaattgtcaaatcagtgtgaacattgtttttatcgaaaactttacctaaattaattaccataattaagtagcagaatgtcaaggatattggctgcataaaagggcctggctgagtagagaaaagagagattctgtcttcaattaaaatgtatatcatccctgggacagagaaaataccgtttggaatgagttgtgtgaatattgcagaattgcaccttacgtgtgtctccggtcactgctagtttccaaagccactcacaggccctaaataaaagtggcagatttttggaggtattgagaagcacccagcagaaggttccacagccctctcaaaagtccccaatgtcggcaagttgaaagcatggatttttttaattttgaaaaatacatttttttatttctgcagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaagcaagtgaatctggctatttgtgtgagtacgtgtgtagcaatctgctcacaattatcagaagtattgagcttagattcatggcccagactccaaatgaagtggaaccataaaatctgtgtgaagtaagttcactgtgcactggttaccaacttgtctgagtccagtgagccagaagacacttacttacttatgtgcaacaaattacatggagcaggtttattacttacagacaggcatcaagaaacaacagaagcctaggattcatgggacctagtccccaagactcagaaaagctgcccagggcagatggtgcaagccccatttgcaccacagctgagggaacctggaaagcagccggacctgggttttataccctggggtcatgtgacacgctggactaaagcactgaagggcatcctgtttctatgaggggatgggttgggaccagagctcaggctgtttcagccaggcaccccttatcttaggatgtttcattcccagctcatgctacagttattcttgagaactaagagcaagaaagaggagagaattgggtcagttcgaggccacagaagcactgtcctacaacctgtgccatcttttatgaagtattgtttctttccttgttcactgcagcttcttgagcaaacacagaaatgccttctctgtgctgagtcctgtgctagccgaggatacaacatgaaaagacagactggatggtgttcttggaggttgtagtcaagtagaaaggcagtagcttccagtcactgagtgcttgctctgcactaaagaactctacttaaggctcattatttcaattaatcctcatgataactccatagcataagcatgattattaccattttaaaaatcaatgtctcacctgcctatttttctatacagagtaaggaaaattcactggaggatcttttatgtttaaagaacattactcatatttttcactttgcactaatgataaagaaagatgagagaggaaatctgttattatttattgggtgtttgtttattaagtgccaggcaatttcaatttatcatctcactgaattctgggaaggggatttgaaaaggggaagctaaagaaaggttaagtgtcttaggttcggatctctagaagcagagcctaaagctgggattcagggacatgaggtttattaagggtatgttctacagaaaaaaaaaattatatatatattatatataagatcatatatatatatgagagtgggaaaagcaggatagggaaggagaaagaactaaggaaagctatgggcctccacagtcagcttcctgggcctaatccatgaggtgaaggctttgtagacctcactgaagagttatccccgcttgtgctacagcccagccttttggcacctgtatcaatatcaacccttcattgattgggaaccatccccagaatgtatgagggatttgtgaccttcacagcaagatggcttcatcaaccgaggggcattctacagagaagaaaccaactagatgcaacagtaacagtatcttgggaccagtgttctggcttaataaaggacatctatgtgggcacaaatttgcttactccattaagtaagttgtccctggtctcctacatcaggaatgcaacagttgggattttaacctggatcttccttgactgtaaagcctggtttggttttgttttgttcctagaatattacattcccttcctagaacattcttactttttatttttatttttctgttttaatgttttattttcttttttcttttattatactttaagttctattgtgcatgtgcacaatgtgcgggtttgttacacatgtatactgtaatagcaacagaactaatgaaaatatagagaaacagatactttattgctttcccactgtgtacttttaagataacttccagtgcatccctcaccctcacctcaccattttaggttttcttttatcaattctttaaagtcatttatatatacaatcttagtccattttctgttatatcagaataccacagactgagtgatttataaataaaatcagcttatttagctcacagttctggaggctgggaagtccaattgaatggtatcagcatttggtgaggggcttcttgctgcattgtgacatggtggagggcatcacatggcaatagggcaaaagcttgccagctcagatcactctttctcttcttataaagccatcagtttcaacatagggaccctaccctgatgaccttatttaacactaattacctcccaatgtccccacctcaagatgccatcaacacataaacttgggagttcagttttcaatacatgaaatttgggggacatattcaaactattgcacaatcattacagatgatgcatagaacaatttatctaacacctattccagttatttgttgttgcatagtataacaatccaaaacttattaactcaagagaacacttgattattattagttacccttctgagagttcactgctctttgccaggtgatttataccttagagtgtcagatggcagctgggggagaagtcatcagagccttgactaggctggacattgtagatggtgccctcactatgctagctattgggtaggagcttaaccagtgctgttcactgaagtgcattttgatagcctctctatgaggttatcataatataatggttgggttctaagagagggtgttgcaagagacagcatcccaaaacgtagggaatagaaattgccagtgcctagaactggcactgaagcacctcttctgtatgctatccaccaaagcagccacaagccagcccaggttcaaggcactaaaggacagactacacttatgatgggtaaatggcacgtgcataccaggagggaagaaattgatagctgtcacctttgggaaaaaaacatctacaacaaccaaggcaatttacaacccagcctcagcttaccttacagttttattttcactccctccccacttagacctgattaactcactaccctagattactattttctgaatacaccaaatgtttatgcctcatgtgtctttaaatatttatcctcttaaaatgccattctccaccttcttatgtaaccaaagctactcgtctttaaaaactctgtttgattctcttgtcctctgagacatctccccacctctggttaggcttgactgccccatctggggtccaaaagcacctgattcttgcttcattccagcatttcctttcaaattctgttgttgctgaatacccctcactgtcccattagacttctttggctctgagaagtttaatcattgtaatctgtattcttaatatctaacctctatcatacataatggttggattgaatgagtgaagaaattccaagtaagaaatcatgacaccactttttgccattgtattagtccattgtcacactgctataaagacatactcaagactgaggaatttatgaaggaaagaggtctaattgattcacagttcctcatggctgtggaggcctcaggaaatttacagtcatggcggaaggtgagagagaaacaaaggcatgtcttatatggcagcagacaagagatagtgagtgagcaaaggggaaacagctccttataaaaccattagatcttgtgagagctcactcactatcacaagaacagcatggaggaagccaccgccatgatgcaatcacttcccaccaagtcctgccatcaacacgtggtaattatgggagctacagttcaagatgagatttgtgtggcaacacagagccaaaacatatcactctgcccctcccacccccatacaaatttcatgtcttttcacagttcaaaaccaatcatgccttctcaacacttcccaaagtgttaactcatttcagcattaactcaaaagtccatagtccaaagtctcatctgagacacaagacaagtcttttccgcctaggagcctgtaaaatcaaaagcaagttggttaattccaagattagtggtaatatttatccctgtaagtatataaggtggcaagagatagacagagatgagtgtgtttaagtttctcagaactcaaatcagcacaaaacaaacattttgcaagggattggaccaagcctgccttttagtatagaaaccccataagatttgtccggaccagaataagtgtaatgataaccattcgtcaagaacattttatctaccagtcacttgccagatgttttaccttggtggtcttaaactgggaacttaagtgtaatgcattacttggattttgctttgtaataatttcaaaatttcaatggctgatgacaagcaacactttcttttttttcactcatggaactaactgttcatcagctggggcaactctgctgtgggtctgtccctcatgtttctttcagaaacagtggccctccatggaatgctcctctcttggcacagggcagaagtgatagagaccatgtcaaatcacacacacacatgcacacacctgctcacactgccattggccaaagcaagtcaaaaggacaagcccagaatctgtagggcggggaaatacactctgcctcttgcaaagtcaaatggcaaaggctataagtaaacaattaggaatccaatctaccactggtggcctatataatgttgcctaaacagtttcttattatttgccagcacttgaaaactgatgaatttcctataaaaattgaagtatcttatttttcttaaaaaatcggatcagacaacagcctcacacttctgaattgctggatggtaacagttgcctggtgttgagtcacagttgccctggttggctgctctccagcttgtaacattcagcctgtttcactcactcttgctacccgcctggctgctgttggctactgcattcactctatgcatggtcattactccttatagccacatttggaagtaggtatcataagccccatttgcagatatgaagactgatgcttacgcaggttaagtgacaccctttgtcacagagctaataagtggtgaagtgagctttgaacatgggtcctcaaggtcaaagcctgtgctcctttcatgaaaccgtactggtctaataagagtcacagtaatggttatcctccatgggttaagttaggagcttgacaagcatgatgacactgaatctgcaatgtcctggtgggtatcttggtcagtttgggttactataacaaaataccatagactgggtggcttataaataacgtaaatttattctcacagttctggaggttgaggtctgagatcagggtgccagtatagtcgtgctctggtgagggtcttttccctgcaaactgtcaacttctcagtgtatcttcacatggccaaaaggagagagcagcaggggtcccttttataagggcagtaatcccattcataagggctctaccctcatgacctagtcacctcccaaaggccccactttttaatataatcacattggggatcaggattttaccatatgaatttggggaggacataaacattcagtctttaacagtgaggtgaagttattatcccccattttgcaaataagacagaacaattaaacagttttctcaaagttgcagaactcacaaatgacaacatgccatcttgactctgagccactttattagacttgctgtcatgtcaggtacacagtctgcaggtcagcatcctctggcctgggagaggggtcctgacatccaccctgctgccattcactatgtattttgtggggttgtcaaagagtacatcagaggtcaagactctgcttacctggtaatggcacaagcagggaggcccctttttaacaccttgaaatctcaagggcatctgacaagggacttataaataagtggcccagtcctgcaggaaatcctttctttctctatttctctttaaccttggggtgaacatttaatgcaataggataacacaactcacattggtgctatgtggggtggggtgctgtgagaacaaggccatcaagatcaatttccctaaagcaggatttgcagcaaccttaggaaattcattttataatggaatatcccctccatcctccataagaaaaaattgctaggctttttccctctgattgtacagtaatacatgctcattgtacatcatttgaacaaagaggaacaataagaaagtaatctcattgctctaatgtgatcaatactaatactttgatacatatcctgcaagtcttcttgtctcacatacattacaatactgatcatattcagagtagacaattacagattctacccctttcattaaataatatatcatgagctacctcattaagtattctttaaaaacataatcttagtttctatataatggtccactaatggaagatcctgtaatgtattaccccacttatttatgactggtccattcccttttttcatcctattagaatttatttatcattgataggcttgttgaaggttcaaaagagtttgttaaatcaaacttcatttattgggtatctgacatatgcctaacaccatgcgaagcattactagagattcctgtacctagcctccaccttcaaggtgctctcaattgacttgggataagggacagtgcataaaatgctaaccacatacataaggctgaataaactcaaggtgtcaacaaagcacagaagataaaagctctaggagtttagaggtatggatctcaaatgtattgtgcacttaccatgtagcactttgcatttaatttatccttcactgcaacctggggatgcaagtgttttgtatatgaaactcagagagggtgaataatttgccaaggtagcacagacagaaaatagcaaggtcaagtttgaatcagtgcaggactccaaaatctgttttttctctgttaagcctcagatttctggggaaaaggcaaatgctgtgattgtgtattgtcaggaaagactaagagagatggtggatggtaacacattaatacacatacacatagctgggtgtctggttgtttccacaaagttcctctctggccacctccttttattcatcagaagagttaagatggtgtctctgatcattgggagtattgggaagtttcggttttaaacaaaacctaatgcatttgaactgttggtgtttatataaagatgttttttgcttgaagccactgagctgaaaaagacattgaaaagtttttaaaactatacattggccaggcacagtggctcacggctgcaatcccagcactttgggaggccaaggcaggtggatcatgaggtcaggagctcgagaccagcctggccaatatggtgaaaccccatctctactaaaagtacaaaaattagccaggtgtggtggtgcatgcctgtagtcccagctactcgggaggctgaggcagaagaattgcttgaatccaggaggcaaaggttgcagtgagcccagatcgtgccactgcactctagcctgggcgatagaggaagacgccatatcgggagaaaaaaaaaaaacaaaactatacattaaggaaattggtgaagcaacatcaaaagccccaccaaaccctaccttttttctcagtttctattcactctaaaactttaccattctagacaaatgaaacatttctcactttccagtagccttcaaataatctcctgaaaatatccattcctggccaggagcagtggctcacgcctgtaatcccaacactttgggaggccaaggcaggcagatcactggaaatcaggaatttgaggccagcctggctaacatggcgaaactctgtctctactaaaaatacaaaaattagccgggtgtggtggtgtgtacggtaatcccagctactcaggaggctaagacagcagaatcacttgaacccgggaggtggaggttgcagtgagccgagattgtgacactgcactccagcatgggtgacagatagagactgtctaaaaaaaaaaaaaaaaaaaaaaattcctcagataagcaaactggttctccttttgatgccttccagagctgacatgctctatcttcagccctgttctctgattccaaatttaggtcaatccagtaataaaaagtcattctctctctttcaattatttgttacaagtagtttactcttttggggtttacaaactcctctgtcatgttctagtgaaagcattaatgccgtaagagagatcttcaaaaattcacaaatgagcatgaaattgttttaatagcatgggcttctgagatatagctgaaatccattgtcacaaaaatgaaaactttcattttgcagaaaaaggaaatttgggaaaacgtaggccctataagggatcaaacaagttttgttttcctcaccatctaagatggtgagtagtctctcgggaacttgcattgggaaagcttctgaggtagtaacttattcagagggaagaaaggtgtgaactcagcagcgcctgccatggcaaagcagcagagcttgtgagcgggggtttcttccatttgccatctccacattaaatcacaaggattccaaaagcaggggcctatgagattcattacaattgtttcctcataatcaggtgcccaaccaatggaatttttttccattctatgctctagtaattgctacatttctgtacactgatgtcttaattgaacaattttactgaattttcttattaattctaataattaattttctctgtaattctcattccattctatagaatttttaaaaaatataattaattcatttgtaaatactgaggatcttctctctcccttttcaatggacttatcttttgtttttatttctttatttaatccactgcctaaaagttaaactgtgctaaatagttgacagtggtaacaggcatctttgtattattcttggttttagtaaaattgattctagtgtgtttattcatttaatatgatgttgtcaatcttatcatatgtaaagaaaactatcttctaaaaagttctggctgggcatggtggctcacgcctgtaatcccgacactttgggaggccagggctgggcctagcctgggagatcacttgagtgcaagagtttgagaccagcctgggcaacataaggaaggaagacctccatctctaattaaataagtaaataaaaataaattaattaaatgttctaattaatgttttttatttaatcactgacagaagttaaattttagcaaatgccattttccgactaaggagatgatcaagtatacttttgcctgttgtactattcacaagaattattttgttgatttatttcctaactttactaggttaaactctacttgatcgtggtaaattatttccatgatatactgttacattttattttctattatttcatttccttcatgcatctgtgttcagagtagaattttgatgaggattatattgaatctgtagatcaatttggggagacttgccacgttagcaatattaacacatcatttttttgctggtgaacatccaagacagttaactgagagcattttcaacaggttcccaagttggcctggtacactatcaatatacaaattagcacctttcatgtttgtcaaaaataactgcagagaagtaaaatgaatgaaagcaagaacgtatataaaatatgcaggaataattttaattttaaaagtataaaatccatataagcaaaatgataaaaatctactatgatagagaaaaagaacacaattggaaggatctctcatacataagcagtagagtcagacctgagtttatgcctctaatcagcgatgtggattttggaaattattcctcttggcctgattttttaagtgaatatcataaaagaacctattccataaggttgttttggaaattaaatgagatattatttatgttgcacttttgaaacatcaaaagtattcaataaacaccaagtactattatgattatgtttctacaaagatgtatatttatcttgaattaacataaatattcaatcaaaatcccaaaattattttgtcccaaatatcatttgacatttctttaagaaatacaatcaagcagaattgctaaggagtcttttaaaaaataagagcaattggtgaagagcagtttttctctctttaaatgcattataaagcatcagtaattcaaaaaatattgtacttatgacaactgacagattgttgaatcagaatagatagcttaaaaacaaactctagcatgtgtaaagattttgtttatgatataatggcatcacaagtctaaaggaaagaattatttgattaatgatatctacacaattagctaactatgggaggagggcataattgtaaattctcagcactcagaagagaaaataaataaatttcagctagaacacgcagctaaatgtgtaaaacagaagtgtaaaataagaagaaaatatagttgtattatctttcttgtctgtgattgtagactgacttgtcaagtataaaagcaatagattaaaatttcattaaaaagattatttaatttttgatatggtttggctgtgtccccacccaaatctgattttgaattttagttcccataatccccacatgtcatgggaaggaccttgtgggaggtaattgaatcatgaaggtggttaccctcatgctgttctttccctcacttcaatcagcacttctctatcttgctgccatgtgaagaaggacgtgtttgcttccccttctgccatgattgtaactttcctgaggcctccctagccatgctaaactgtgagccaattaaacctctttcctttataaattacccagtctcgggtatgtctttattagcagtgtgagaacggactaatacaattttattttgtaaaaatacaaagcttgtttgtaacatcaaactaaaagaaaattattaactgggagaattatcacaaatctaccaagcaaatagttatcattgttattaaaataaaaagcattgctttatcggaaaaaattataagagaaagtagacaaggaacattagaaaattatagaactgtaaatcatgaataaatagacaacaaatgttcagccccactagtagtcaaaacaatacagtgtctaacaacagtcatctaccaattcttaaatgtcaggtgcagtcatctacctaggctcaaactcccagttttacagcctgaggaattctaatgcagtccccactacttctgccaaccatgtacctccttgtctcatggctctgtgctgtctttccacatctgcacatgctatctcatgtgaacctggtcactgacatggattgtcttccaaccttgcagtatccattccctattcttctactagacaacagtcttgtttcctttggggagatcagttgttctgctctcctgtagccaaaaatacagcttgtgatccagatagaccattcggaatattggtcccagggaatgtagttgggggaaaaagaagataaataactgagatattagatgatgaggtggttcacaaagagtgcaaacaagatagcaggctagaacctacctacaactgctgtaggtacagggcccaggtcacagtaggggagctttggcaagctgggtcaccactagcacaaaaatacagttggcacctcagttccattgaagtcaaacagcacctaattttaaaaggtttcattaagtgaccagatccagtgttcatgaaagctgatgcttctacctaagataaacatactgtttctggccttctgtgatttttacactcagatatttttttaaaaaaatgtttagagggatagcctcttcctttctacctatattgtgcaactgaacttcataatttgttgcaagaattcaaactgtggctaaaacaatctttatttttgctgtatggttcagagagaaatgaatgattgtctattttgagtattaatcttcggttgtttccatggatacctgattcacttagaaaggaagcaatgaaaaataaaggactcagaggccagagaatctatatttggtccctcatggaggaaaaacctgaggcttggggaggtgaaactgtaaactctctaacaatgggcatgaattggttaaacaataaaactccagctgctgtgtttgggagagggaaaagcatgtttaatcatttttacagctgttgtaatcacttctgagtttctgttcaaaggaggaatccattttcagatcacaccccagtcgaagggttgctttcccactcctcagctcttattgtggaggagtgtaaaataaacacagtgttaacgagactcaaaaggaagaacggcagaggtagaaccttcacagagacagagaggaacagtactatcacaaaacagagggaacccttgcctagagcaacaccttttcagaaatgcttttcattgagtgtctgtatttaaagttgcatttttaaacaatagtatgcagaaatcaagatttttgtctgtaatttcatattatgtctatcatcaaagaaaagcacatatgctggtggctaacccgggataaaagtaataagagacagacctgtgagactcagcagaacctgagcaacaaatgaagagaaattgggacaagaacaaataaagacagttcttttattcatgcctggccaaaggacttcactggctctatctaaaaaaaaaaaaaaaaaaaaaaaaaaaggaaaagaaaaattataccagtccctttgtattttgtttatattttgctgtgtatcattacacttgttaaccatcttatgttttgggttgaaaatttcctgaagatcaaggcaaagggtgaatcatgaattgtgatttttatatgttagagtgagagggattctaatcaataaaaggagccactttcctgacaaaattttgtatcaatttaagttgaatatgagttgagttacgtaaatattcaaatatcatagtgctactgacaatgctgacgtggaaaatatggctgatgtatgcaggaaggaagccttcctaaactgaattggagagacttagccagccagtcagaggtggccctgcagccctgaagacttgtcagagaggcctactttgccatatgacagcaaaccaaacagaacccgtgctgccttcataagagcaatgagttgggaagaggctgcactcactttcccttctcaagttcattgatccagtaagtcactccactgcccagacaggaagtgacatggtttggctgtgtccccacccaaattttgaattgtagctcccataattcccacttgtcatggaagggacctggtgggaggtgattgaatcataagggtttttcccatgctgttctcatgataatgaataactctcaagaaatctgatgcttttataaatgagagtgcccctgcactagctctctcttgcctgctgccttgtaagacatgactttgcttctccttcgccttccaccatgattgtgaggcctccccagccatgtggaactgtgagtccattaaacctctttcctttgtaaattacccagtcttgggtatgtctttattagcagcatgagaacagactaatccaggagggtagagtgaggtcagaagcactatcttagtgggttctattacccacccccaccaacagtagggcccaaaaataaaaacaaatcagcttcccaggaaagccaactttctttgtactgagacttgaatttccaataccatgatgtatttcaaggcagcatactccttctgtgtcctctaaggccaaagccctcatattgacaacaacaacaaaaatgattgttgagattcattcattggagctgaactgttgctccctgcaggagagggaacctgtctcttaatacagggctctgttaattacaaaggaatcagtaattaatggtgaagtttcagagcctgtggtattggggacgaagggagaacagcagcagccagagagcctggaaagcgtgcatattttgtaaagggagttcaccgataaaagcctaattctccagacttggaatatgagaataaggacttaactaacattgagtattgagtgcatgctcttttgcaggctccactgtaatagctcttgtcctcttcttataagagtcacctaagaagctgacccaggaaagtagccctttgacagcatcacagcacgagacacaggtaacagcatagagtttaactctctagaatcctaatgttttttgcaatagatgtcatgcaggtttccagacaagttttgagaaaaaatatgtgttgaaccctttaaaagtttctattctttccagtattctcttcacctgcagatacattcccaaccaaaaacaagtaagcatgaaaagtgctcctaagtcaagttatctgtccagaagatggtgactatacttcaagtctctcagcaattcatttcaaaaattatttttagaactcctactaagtgcaagaccttaagacaaaaaataggtcttgccttccagaagcactcaatctactgagagtttcaaagccatccataagtcacctccccacttcccaagcagaacacagattaaaggctatgatattaaagaacacagaacatgtgctatggaaacacagagagaaagagatagttcttctggctggagaagagatgagttttacactaactcttgatataagatgaggaattgaatagaattaagtttgtggtttatctcgtcccttagagcaaaattgttggctagttaaggggagggttagtatagaaatagagctgttacatttcagagagcatgccacattattttctgtattggactatctaattctgctcagaacttccattcacaggggtcagtgaggggcccaagttatccatcatttttttctgacttctgtatggtgactgcccctggatgcttcattacatgtttcagtcacatctaacgtgtgggctggagatacggtgagaagcctggatcagtttccttacaccaaggactgatctcctaaggccactaagctacaaactctgagctggtcaattagagtaaaactgctcagggatccaaagtcatgcatagatgacctttggaattggaggcttcttgcaaagatgtctaggtagcatagaaagccccccctttctgtggctaacttctatacatcgctcaattcttgttttgccccacacttcctctggaagcttccctaacacccttacaccaagctagtgaccccttctctgtgcttccatattaccatgtacttatctccatcacagaacttacatactacctaccatgtacttatctccatcacagaacttacatactaccttgtagttgtgtttttactaccttcctttcccaatggtagtgagtatgttccatgatagcaaagactgttttgtggatagctgtatccctagactccagtaaagtgattgccccatattaggcatcttaataaacacttgaatgaaagaacaaaccaactataccattgagtttcagctcttttgacactggagtacacagtaggtcaacagaaaaatcaaagaaataactcatcattgctacagaaagaaatctggaatgagataccttctcttcatttatcataaatttatatttctgctaagataggaattggatggttgacattgccaccactcagcatggagcacctctgttagctagagttcactccaggccacccagcaggtggctggccatcccacagccactcttcagggtcagtcacctttggctcctatgctgatgcactgtccacagctggagctcaggcaataggcctgactgcatctccatatcactagtcttagcacctgattccaaagcaaagtgtctaacactgcaaggtctagtgaacgtcaagcctgtaaagactccattgtgagctcttcctagaagtagcctccaacaagctatgtagccacagggcacaaactaaaacacaaacagaagtttgaaagtcccaggacattaggggctgcagtgattttgtaaaccgtaagttctgaagttggaaaagttccttaagtgggctccagtggagatggctggatggagtgaacagccaagagaagggctcctgcaagactcaagaactaaagtcagatgggaattcatcagtgtatctgcaccaactttctcctgtaaacagttgcatacccattgttttttccctagagaagggcttggcctggaatacattgcaatccaggctgaaattttttaaagagttttaaaatgccagtaataattccatattagattttcacaagcatacttaaaggttcttccttatcaaactttaaagactggcattagcattttaatttctgaaagatttattacatgatcttattctttccttatcactaaacaaacatcaacatttagaaatggaaacgtatacttttgagattcacccccgtttcatatgaacaacaagaaataactcaacaaagagccatttttcctgagcagtttcaagatccccccaacaccacccgcatctgaaagtcatgacttgcctccaagttactctggagaggctgtcaatgggatgccttatttgggtctaaacaaactcagcttttggcccaggcaaaccccacccttgattataaacaatgctggcactctccgaccagtatttgcagacacatgggggcaagcaaaggaaaaagctgccagtgatggactaagggtattgtataagggcatgcttactggtaagaatatccaagaactcactccaggcctctcctcctccaggaagtcttcctagactacagcccacagtggtctctccccagggaacttcaatttttttattacccacatatcaaatgctcatagaaacatagaagtcagagctgcatgggatcttgagacatccagaccatggtccccagatcattaccaacaagaaacggaacctacagatgtactttctttagactgtataatttttaagaaaatatttagttatcagttagaactaggaaaatttcgcattaaaaagcaatctagaattcctgctttcttgagaaataagtagtttttgcaatgccagtcatgctggttattaaaccactgactcttaatgccaagcccaccctttcttacaccggtcgtgaggcagatgctggaactctgcaaacatttctcttttgccatctgattccctgttgggttctgctaataagaagcattgcggagacagtctgaaatgtagaggagaaagaaaggacacataccttcctgtgtctttcctcttcatcattgtcacccaagcaaaagttcttgaccctgatagagtagtgattcccatttgtggtttttcaacatgcccccaaattagcgtggtcactccccttcactgagattcaagcaccagccatcatcccactcacctccttggaggtctgggtttctgaaacatggggcctctgctccaagcttttaagttagtgctgtccaacagaagtataatgagagctacaaattaaaatcacctatgtaattttaaattttctagtagccacttttcaaaagacacaaagaaacagaggaaattaatttcaaccataaatgctacttaattcaactcacccaaaatattattattccaacatgtaattaatatttaaaacttttaatgaaatattttacattgcttttttatacactaggactttgaaatctagtgtgcatttcgcacttatagcagcacttccctattcaggctggctgcttttcaggttctcaacggccacgtggggctggtggcctctgtattggaattggcagcactaggctctaagaaccacattctctctttcttgttgctccagccactagcagtgtagcagcatcctgcagttaccagctgagtgttatcttagtgtgatccttaagcctttccgtccgttaacttgtttaattattccttgtaataattctccactttgaaatgattgatgtatcagttttcccaatagatcctgatcaatacagtttgtactaataattgttgaataataattggctcctctgatgtgtccagagctcaccctttaatgccagatcccacaactccccagttctgaggctagagagcaaatgggttgttatttgccccttggcttctggtagaattatgaagaaagtgattatcccactatccttactttgaaacattgaaaaagttaaaaaagaactgattgtgtatcagaaataatgtaagtgggccatattgtttttgcaagaagtcaagattattcccatagtttaatcttcacccaatcacattgtctccctggctctctatggacactcaggccacagagattgccctggttccaaactgttctggttatgagctctcagaggatgggattctcatcccagggacaaacactaagtccttgtgactcagacctcactggtaaaacagagctgttgttggccatgtcctaggcaaggctgagaataggtaatggtaaccatgattgtgatttagactttacaaaatacctttgtgtacataatttcattagctggatatattcatggtgcattcccgtgtgcaacctgaaatgtagacaaccttgctgcccacttcataccccagtctgccacactccctgcctttgcaaaacaaactgccctgagcagtggtttggagtaaggactctgagaacacaatagctgggctgtaattcaaatctaccatctctagctgtggggcaagatccttaacttcctctctctgcctccatatccatattcaaaaaatgggacaataaaggcattgaccttattgggttgtgtgatgattaagtgtgttaatgcatgatcatatgtgttaatttactgtgtgcttagtatacagtaaattctcgataaacattcagtgatatcattgtcatcatcatcatcatcaccaccaccactttctggcctgattatgccagcagaagaggatagagattaagagcttaaatttgaattttaaattcaaagtaatgttcaaatcttggctcctccacttcccagctgtattaccttaggcaaattacttaacctctctaaatatcagtttcctcatctataaaatcacaatatatgcatcaaagaagatttttggaggataaaatgaggtactacatgagtgtaatattaggtacaggagaaaggctaaaaagaatgtgtgttgttgttatcaacataatcaccaccatcatcataatcaccatcatctttcctcatggtaaaatacaagtatgggaaaatgtttcatctgtttagtttcactgcatttgaggtctgggaaacctacgcaaattagtatgatattcccactaaaccatgaaccattgcccaaattactccacagtcttcataagtaaattaagatatttggactaaaattctaaagctctttctagctttaaaatgttttattctctaagcctttaaacattcccatgaattagtttattaggtaagtttcagatatacaaagagcctctaatgggacacaatacaggaagaataagtttgggtgataggaaaaaggaagaaggaatgatcaaaatatgaatggatgcatggaagaatagagatagatagatagatagatagatagatagatagatagatagatagatagacagacagacagatacatacatacatacatacatagatgatatagatagacagatagatagatagatagatagatagatagatagatagatagatagatagatacataaatacatggatagatacatagctaaatggctaaacctagcaggttcaagtttcatctggaagaacagaatcctgggaggaaggttccgtaatgggaaaaacagaaattacaaatttactgggcaccttactccacaggtcaattagaacttgctattttatgtaattatttttcctatcttacagttgaatccagagattaagtacccaaagccacagcacttgtaagcagcagaacctggaaatgaaccaagaaatattgaacttcaaagctcaagttctatttctaaacagctgagtctgccagttcaacatgaacctggctggaaaggcagccacaaacctgaatccttaattagaaaagcaaaaatgaaataagaaatggtgctcagttaatttcataggaagctctctccccttccaagtgtgggtgaaatgaactgaaatgaaactgtcatcttgaaaataaaatctctgccttgcagccagctgagtctatgtgcaatatacttgtgattggccctttggaaatttaagctgggtcaggcagtgctgacctccttacccaattttaaatccaggcaatatttaaaacatttcactctcaagaaacaatcttcctcataaagcaattaaagaaactgaacaagaactaggaccccttctctaggaataaaagataaaattgcttgtcctacattttcactacttgtttactcaaggtttttcccacaacaaacagagttcacactacagagaattctctagcatccaagttaatcaacttctttgctccacagaaaccttctctgctcaagctaatcctctcatcagctagacaaataatatcttagacctttctaaaagtggtccaattggctttattgttataagcttgttactttcattaccaccattgtacattttgatactcagacctcagcaacagcccactcggctaaggtaaggcctaaagtcagaaaaccttggggaaggaaagtttctgtgaaagttcgaatggctggcccagaatatccaacagtatcagaaactaggcagagagaggccagttgaggttattatcgtttcacagtgattgagacgaaagcgagaaagtggctcccagtcaccagctggtgacaatgtccatgacagaatcaggacccagtgtccctctttcacattccacttcttcaggctgttgtgttctgttccatcaatgcaccagcacacatgatgcgcaattctccaccctcccacagtgccttgttttccaacccatgccaatgcatgccatgtgatattcacaactctgagagatgggcattgctatgggttcaatggtgtcctccataaagctgttccacttctaatccccattacctgtgaatgtgaccttattttaaaatagagcattcacaataagactgcatccttaggaaaaggagtttgggcacagagccaggcacacacagaagaaaaatgatgtgaagacagagccaaggaatgcctgcagctaccagaagcttggagaggcctggaacagatcccgcctcagagccctcagaaggatccaatcctgctttggaaccaatatcttgattttggacttctggcctctggaactgtgggacaatacacttcttctatttaagacacccaagtggtggtactctgttatgagagctctaggaaactaatatagggatctatggcatttttcagttgaacaaagtgaagtctagaccttctgtgattttcccagcttgtagttaatgtaattaggtccagaaataataagattttctggctcccatatgagtttcacgataatgggaaaagaactaaaaatagtccgggtgattggacggggccctaaatctatgacaccctggtttccaaattgtttcactccattgtctgccaaaagacaaacaaacaaagataaaacttgtttgtctgctctgcaagcatctttgggatgtggcccttgccagccttcccagaattacctcctggcctcgcagacttgaacgctatactctagcccagggtttgccagaacgtatgtgtcaggtaagattatattacgctgcatgtaacgaacactcgtctataatggctcaactgcaggcagggctacagtacctgcaaaatgaaggcaacagggaccaggcttcgtctagctttctgctctgccactcagcatattcctttcatcctcacagaggtggctaccacacttccagggactgaatccaggctccagaaaagaagaaaagggagaaagggataggatgatgaaaatgcaaaaggcacctgccaactaaattttatccagtaccatccagtaaacttagattttattggccagaatttggtcacacaggcaactcaagggatgtctgcaaaggagtttggagaggtgagcatttttaaactgggcacagtgcttcctcaaacaaaatgtatttctattactataaagcagggaagaagacatatttcatagtctactagcagagtcagagacaacacagggcacataacattggtgacacatagaaaactattttttatacttataatagttaagcatgtattttagtatgtattcaaaaaatgattaagatatcaggcttgagattttacaaatatttttgtctagaacgatattaaggttgggagcagagcaagaaggtaaattgatttcaataagataataagtaaaattgtactgctggtttgaaaagataacacaagatacttaaatcactacaatttgggatatgctgggattaacccattgtatttctgaaaacatgtctgaccactttaattctctgtgcctttgcatatgcatatgtcatcctgaaatttccttccctgggcttttcttcctggacaaatcctaaatgcctgcaaaactcttcctaaaggtcacttcgtttgtgatgcattcctaaaagtctccagttaattatcacctcctctaagtttcctccagcatttggtatatatacctgtatctgcctttatctccttgtataagtcagcattgtctataataatgctttatcacatacaatctccagagcttaaaggcgtacaaatacaaataactatttctcactcatgttatacctgtggatttgatgctatagccctgccagactgtggttgagtttggggtctgacccacaacttttctcaatttaagtgtcaaggctgaaggagagtctactttccacctgcaatcataaatgtgaagttctcatggtagagggcagaaatctgagagaaaatttgaaatacctcttaaaacctttgcttggagctaccaaaccatctttttcacccacaattgcataaatgaaagcaggtcacatcaccaagtctaaagttaagcaggctccctctttgtggggtgtgagagtaggtatgtgctggataataatacaaacctccctactcccaatgttataattatttatacccctgtctcatcactagactgtgctcttccatggcagaggctaggtctagtggacatttgtcatggctttcaaagagtcttatcccaagttaaaatcctaaaactcactttaccaggttcccttgcagctagaatagctaggcatgtgacctggtctcccccagtcagatgaactcgtgggagccttatgttcagatattgtgtcccaaagcagggaaccatgctgaatccatttccaacaagatggatgtctgactttcagcaatggccgcaggctagggagcttcttatcagtggttgccgcagaaggttcattagagcaatcctgcagtagaaactggcactgtggctaccactattggccagtagctgtcccaccagagattctatcagctagcaatatctcttgaaaaattcattttctgcctaaattagctacaatagattctgctgtttgcaactatgagcctgactgatacactaggtcttaccacaatgcccagtacagagtaggtgctataggtttgctggaagaaagtaattaatatgattgaaaatcactaacttattcaagcacttactgtacaccagatgccattctaaaatatatcttaattaattttttattcaatcttcaccacaaacctttgaggtagatgctatttttgttcccactgtacagatcaagacactgcagcatagagaggttaagaatgaataatgatcaaatcatgaaatgctgatcaatagttcttctaagagatattatttctttagcactgcttgaataaaaaaatgtggtccccacaacttctcagacatctgacctagtcaagaccaccagtcctgaagggctacatggaatctcatggcctttttttttgtcaacccatttaggaaacatttagcaaacactcaatttgattcaatcacttaacacttattatattctcctccagttctcatttcatcacataaaattatattctccttgaatgatctctgggggactgaaggactaaaaaagcttttaagaacattgtttcagtagttccaccagcctctttaggaaaatggctctgagataactcaggtgttatttttaaattgttgcttagtgaattaactcttcagcacctttcaaagataggaagtattatcaattccactttgctaatcttctgttccaagatcaaatacgcagaatacaggtggagtgaattctgaaatatgctggaagattataatttagagaaagttttctgttgcatcttttaaaattatttcagctgattttattgatgtagggtagatgtcagcagaaaacggaaagtgagatacaaacaagtttacaatctggataatttgtattgatagacttctgtgcaaggctgtttctccccaaaaggcatttacatgaagaaaactgactctttcccatggactgccaggcccttcttctcttctgtgtgccctggttttgagtttgctccttgctattttttgttcattaggaaggaagaaagctaacaatggtaagggccaagtgagtgtccacactgagtagtattgagtaggaaacataatctcaattttcacaatgaccattatggaccctattgaaaggggatgaagctgaggatcatagtcattaaatgactagggctagtgaaaagcagatttgagattggaacttctagtgcagtgttcattgtattagaccatgtggttctgagcccagacatatcaatgcaactgaaagacatctgcacttagaaactgaaggatgaaaattcttgtaagcacaaacagataaagtaaaaggtgggatcagatgcaaaggggtcccctctgagcgtgttggcctacaggtagggcatagacgatctactacctaggctctatatgctttgtgaactactgtgagttgctcttttgaggttagagtgtttcattcaagaaaataattcatccagacactgaaaaaatctgaaaccaaatcaacttcagtgcctgttgcaggatcccttcaagctcccacataaatggcatctccttcaagtcttctacctaataaagataaaaaggatctttgaaaatcagggaaggctaatacttagaacttagtgaattcatccattgtaaatgggtaatcactgacacagcaaaatatcctgatggctacaacatacagatcagcatgcctataggttaagagcaagggttctggagctacacgacctaggtttgagtcctgcctctgccacctctatgtgttcttaaaatcttctatatccttatcggtttttcttcctacctgttctatcaactatagaaagaggggtattaaaatcttcaactatatttatggattgtttttatctttagccattctgtcaggtgcttctttatatattttgacactccactattagtggcataaaagtcccaaattgttttgtcttgatgaatttacctgtttgctagtataaaatgtccttcttcatctctggtaagattctttgctctaaaatctactttgtctgatgttaatgtagacactcagcttttttgaaattagtgttagccttttatatttttccatgcttttgcttttaacctatatgtgtctttaaagtgagtttatctaaagtgagtttactgtactcagaatatagatggaccttaccttttcagtataaactgacaatctctgctaaaatgattcttgacctgactacgtttaaatctacctcctactccttgtctattggtcctatctttcctttgcctcatttttctttcttgttgcctgcttttagattaaacatttttatgattccattgtatctccttcttcgctcattagctatagctctttgttgtgttagtatagtgattgccttagggtttacagtatgcatctttaaattaccacagtctactttaaataatattataaaagttcatttataacatgagaaacttacactagtatacctctatctttccgacaacctttatgctgtggattttttacattttacttttacacagtgtcagaaattatacactgacttgttactatgtttgtttgaacaataaattttgttttcttgaagtttttatttttagatcatagtagattgcaagaaataatacagagattccatatacttttacccagttccccccagtggtaatattttgcaaaactatagtataatatcaccactgtaatatagacatgtatatgagaggatctcaaaaaattcacggaaaacttgaataaaagataaaataaaaaatataaactttatttctcaatataagatccatcaagttcaatacacttttgtaagcagtgatatcagccatttagtatagccctaaagaactgagcatcctgggaatttaaccatgtcaatgccatctttgtttaaatgattagctgaaaaatgggtgtcctttaaaaattttttaagattaagaaaggaaaaaataaaagaataacccaaatcattcacctgtaaggtgagtgcctaatgattttccattgaaactctcacaaaattgccctagtttgatgaaaggaatgagcaggaacattgtcgtggtggagaagaactctttggtgaaggttccctgcttctgctaaagctttgactaactctcaaaacactctcataataagcaaatattatcattctttgggctttcagaaagcctacaagcaaagcacattgaacattccaaaacactattgtcatggcctttgctcttgcccagttagcgtttgcattgactgggctacttctgcctcttggtagccattgctttgattgtgctttgtcttcaggattgtactggtaaagccaagtttcatctcttgttacaattttgtttcatctcttcttacaattcttcaaagaaaggtttcagaatcttaatcccacttgtttacaattcccaaaatttccattgaaagctctgctgttgtctacagcttacttggacacagtggttttggtacccattgggtggaaagatcactcaactttaatttttcagtcagaatagtgtaagctgaaccaattgagatgtctatgatgttggctcttgtttctgctattgatttctggtcctcttcagttagaacacaaaaaagatgaatttttttcttgcaaattgatgtgggtgatctgccactgtagagttcatcttcaacattgtcttgtctgctgtggactttatcttcaacattgtctcatcctttcttaaaacaagtttcccattcgtaaattgttatcatttttccactgcctaagggacttcctttaagtatttcccatagtataggtatgctggttgtaacttcttttagcatttgaatatctgaaaaagtctttactttgcctttgttttctacaattttttctgaatgtaaaattctaggttaacagttttttttgaggggttagtattgacaaattgttgcttcactgtcttcttacttgcattctttcttcagaattctgtcactcttcactttgttcctctaaatataaattatcttttttgtatggatatttttaagattttccctttacctgtggctttgagcaatttgacaatggtacatctttatgctgttttcttcataatttttgtgctttgggttcattgaggttcttggatctgtggatttacagatttcactcaaatttgtacattttccagccattatttctttaactatttgatctatttatctttctcttcttttcttcaggactaattacacatatattaggccaggggagttgtagcatggtttaatgatgctctgttcatcttttttattactatcattcaccctttactccatgttttatttttaaatagtttctatcactgtgtcttcaagttcattaatctttaattctgcaacatctaatttgccattaattctgtcaagtgtattttttatctcagacattgtagtttttatttctagaatattatgttgggtcttttttatatattttatgtctgtagttaattttttttgaacccatagaatgctgttacaactgttttgatgttcttttctactaatttgacatctctgtcagttctattggtttttattgattgtctttcctccttactatggatcacatttttctgtttctttgcatgtctcataagttttgattagatgccagacattgttaattttaccctgtgtggtggtggatgtttttgtatttatataaatatatgtgaactttgttgcaggacacagttaatttacttaaaatagtttgatcctttccagtattgctttttttccccagtattgcttttaatgtttactaatatatgacaagaacaatgctcagtctaggcttatttattagcgattactaaggcaaaatccttcaatgtactccacccagtggcctatgaatcatgaggtttttccagtttgacttgtgggaacatacagtattctgatcctctctgagctccaggcactgatttccctaaaccaagcttgttcaacccacagcccatgggccacatgcagcccaggatggcttttaatgcagcccaatataaatttgtaaactttcttaaaacattatgagttttttttgcaacttttttttagcccatcagctttcatttgttttagcatattttatgtgtggcccaagacaattcttcttccaatatggcctagggaagccaaaagattggacatccctgccttaaacctttccagtgtttgttcccccccgcccccctagaggcctcaggtactttcctcacaaatatgcattgatcagaattctgttgaatacttaagtgggagtccctctgcagttctctggttttctctctgtgtgcagctgtctcctctctggtatgctatcttgtgaactctacctgctttgatcttcttagactctaagcttcattacctcatttattcatctcctcaactcatgaagtttgccaggctctacctgggttctctcccactatgttacagcctggaaaccccctcaattcaataagctggagaagctgggctcactttattgtgtttactgtctcttgaagatcactgtcactatttttctaatgtccagtgttccaaaaatcattgtttcatatattttgttacgtttttttggttgtttcaggctacagggtaaatttgatctcttttttcctgtcttggtcagaagcaaagagccctttttaaaatcaatgtaaaattatacggtacttaatgttttgggtccataattattacctttccatttggtaaagttcctttttctccactatccaggcaatattcaaatatcctcaattaacccccaatctttacatctaaatcatttaaaacaatatccaatccaatacagcacagttcatgctgtttattcctttaagtctcttttatttgtaagcatttcctattacttaaaaaaatcttacttgttaaaaagactggacacgtcgtcctgcagattgtcccagctggtgaatttgtttggttgtctcctaggggtattatttagcttgttcctttattctttgtatttcctgtaaacttgatgtaattaatttagataattttgactagaacacatgatggatattgtagtatactacatgttgcatcacatcatattcaaaaatacatattctttgtttaacctaccattatgggctgaagtgtgaacccctacaattcgtgtgttaaagtcctaacccttagtacttcagaatacttggaatatttggagataaggtctttacagaaataattgagttaaaatgaggtcattaggccctaattcaatgtagctgatgtctttaaaagaagaggaaatacgaacacagttacctggacacatagagtaaagaccatgtgaggacatgagaaggtggacatctggaagccaaggaaagaggccccaggaggaaacaactgccgacaccttgatctcagatttctaacctccagaactgtgagaaaataaatttctgttgtttaagccaaccattttgtggtagtttgtagtttgttaggcagcccaagcaaactaataaacaccactatggaagctaagattgaatactactgaactcaattttagttgtcatttttcacctgcatccagaaagcaacctatgtggtgtttattgacattattcaaacatccagttgtccatcaaatgttcatctaatgactttaacatctatggaaacttttcgctccaaacaatattgtcaagagggtttataaattaaagtttttaaaaattcaatcactcctttcctatttacctatacattggatatttatatcttaatctgatgttcttttatacactggagatttatatcttaactagggctatttagtaacaccaaagcatagattctactggaaaagaaagatacttgcttaacactatccatgtaattaccaattttcaaagtacagttctctctcattctctgtgggggactggttccaagacccctgatagaacaaaatcactggatgttcaagtccgttaaaacgacatagtatttgcatgtaacctacacacatcctcccatatacttcaaatcatctctagaatattataatatctgatataatgctgccacatcacttaatttacgtgaattcaatgtaatactcatcatgtagcaaacaatgtgttgctttttaaaactttgtgaattttttttccaagtagtttcaatctgcagttggttgaacccgcagatgcagaacccatgaatatgaagggcagactgtaatcaattgttttaaactgcctaaaatgataagaaataggggttttcttttcattttctaaatattactatagacttgtggatttttattgactgaatgtttaaatctattacaattattactgtttttatgttcaaattctcataacatttcatgacactttgtaagttggctcctgggtcttttttatgttacagtagtaaactttgaaagtttctttgctttttagcacaatgaaaggcctttagttcatcttgtattatcatttttttggggggaggggggtgattgcctcagacctgaaatttgccatttttctaggaatctctagttcctttcactgtggaattgaattagtgatcataatatggattctagaggtgctcattgctactatttccatggtaagagctacaataaacaatgcatgtacatgtgtggatgcatgtgtgaatgtgtgtatgaactctctgtctctctctctctctctaatcatgtattcttttttaaaatatccaacttttattttaagttcaggggtacatgtgcagaatgtgccagtttgttacataggtaaatgtgtgcaatggtggtttgctgcacagaccatcccatcacccaggtattaagcctagcatccattgtctgttcttcctgatgctctccctcctcccatccccaatcctctgacaggctccagtgtgtatttttcctccccacccacaatgattccacgtgttctcatcattcagctcccacttatgagtaagaatatgtgatatttagttttctgttcctgcattagtttgctaataatagcctccagctccatccatgtgtctgcaaaggacatgatctcattcctttttatggttgcatagtattccatggtgtatatgtaccacattatctctatccagtctatccttgatgggcatttggattgattccatctctttgctattgtgaatagtgctgcagtgaacgtatgtgtgcatgtatctttgcaataggatgatttatattcctctgggcatatacccagtaacaggattgctgggtcaaatggtatttctgcctttagatctttcaggaatcaccacattgtctttcacaatggttgaactagtttacactcccaccaacaatgtaaaagtgttcctttttctccacaacctcatcagcatctgttatttctggactttttaataatcaccattcttactgacatgagatgtaatctcattgtggttttgatttgtatttctctaatgatcagtgatgttgagctttttttcatgtttgttgactgaataaatgtcttcttttgagaagtgtctgttcatgtcctttgcccattgtttaataaggttgtttattttttttcttgtaaatttgtttaagttcctggtagactctgaatattagacctttgtcagatggatagattgcaaaaattttctcccattctatagattgtctgttcactctgatgacagtttggtatctgactttggtatttgacttgaggtatttttatttttagattttattaatggtaatacatttgcactatatagaaagttctacccagaaaaatcttgtttctaccccttattctaccccatctgccctctttcgtagtttaccattctgtagtagtttttatctttccaacatagtgtttgcctgtttccgtagcgtaaatattccttaccatgtcaatttcaaaataccatgtgtatgccaactagccggaacaaatcctgaaaatttaacaatcagtccttacaagctggtacaaacttcctccagaacacgtctacctgtcttcccatgccccctttacacaagaattagtaagctgcactgagcctttgtttttgttctgtgtttttacttaatagcacgtggtcagatactatgaactggttgtcatatacatcatcagaacactttcattaatatctcatattatgtagcatgatttaccactttttcctaagacttggggagagagtttgaatttggaatcagaaagatttggattctaaccccgaatcaggccttatcttgccttatctttctgaacctcgagtttttcatctatgaaatggagaccataatataaaatctgtgatataatcaaagaaataaaatgttcagatataatattaattataatattaatagtcagcacatataagtgccctgtttttgccagatactgttcttagcattttactcagcatttaattctcacttctaaatgtgacgtgtactattattattcccattttacagatggaaaaagtgagtcacatagaggctaggaaacttttctacgccacacagcaagtaagtgatggaacaaacattacacttaggacatctacctctagaaaccactctctcttttagaactaccctctaaaacatgcttagtacatagtggtaactcaacagagtcactgtcctccactacctctagtttcttagtttcagctgcaacctcctcttggtgatttgaggcaagaacttccacatttgtgggcctcgtgggctcctgtattagtctgttctcacactgctaataaagacatacctgagactgggtaatttataaaggaaagaggtttaattgactcacagttccacatggctgaggagacctcacaatcgtggtggaagacaaaggaggagcaaagtcatgtcttacatagcatcaggcaagagagcttgtgcaggaaaactcctctttataaaaccatcagatttcatgaaatttgtttactattacaagaatggcatgggaaacaaccacccccaggattcaattacctcccaccaggtccctcccacaacacatgggaattatgggagctacaattcaagatgagatttgggttgggacagagccaaaccatatcagatcctctcaccaacttcctagctttctttttttcttgtctcagtctccaaaatcctccccacccactccaagttcactgccacatccatctgtggagaacatgacaaacggagaggaaaggctagaccagcagcactaccctgaaccttccccagagaccccctgaactgccctgctctggttattcagctcagcagggaacttccatggggttttcacactaatagcttggtgtctttgctgggctagttattaaatactttgaatatttaagaaggcagtttctgttgtatatatccccattacgtaaatgaggaagctggctcagaaagattaaataacttgcatgaatcctggtagaatcaatgctaggattcaaactcaaatcaatgttactaccaaactcttacaacttagcagtttgagaatgaaatgaaaaccatcatttccaagagtacttggggcagaggctgattttgatcagtgtagacttgactgtccagttacaaatggctttagcctcaacactgtcctaaatcagagttataatcttaatcactagcatttggcttggtctcagaatcctaggactggcactgagatttaataatttaccacacactcagcactgatttaacagagactctgctgccttaggaatggatgaaatcagctgatgagatcacgattcatgctaacattcttgcagggattaaataagataattcatgaagagcttgctatggtgcctggaatatagtcaacactcaggaaatgctatttattttattattactgcagcaaagattacatgagagaaaatgattgagaacttagatctgagttttaaactcaggactgatatagaccttaagtagtcctgtatgtctctgagtgttcccatctttaatttctgtaaggagtaaaagagatgatatacataaagcatctagcacacagtaggcactcaatataacatagcacacttgactgtatttgcctagcagcaaaaagttaataaagaactttaacatgcatgcaaatggccaaacagaggggtccggagacttgcattctagtcctgactctgactttaactgaacaaaagagccaagttatggcttgtgtttccttttcctcctctgtaaaatggatgatttggagcccatgcctccttcctcgttctgacaagttattcttttttttttttttttgagacggagtcttgctctgttgcctaggctggagtgcagtggtgcaatctcagctcactgcaagctctgcctcccaggttcacaccattctcctgcctcagccttcagagtagctgggactacaggtgcccgccaccacgcacaggtaattttttgtatttttagtagagacggtgtttcaccgtgtcagccaggatggtctcgatctcctgacctcgtgatctgccctcctcagcctcccaaagtgcagggattacaggcgtgagccaccgtgcccggccaccattattctttagaactttctgccaatcttcccaacaatgctgtgagtcaacaggggtgtgtccatcttacagatgtggaaccaagactcagaatgcttggactcagaatcatagaatctcagggtcatcatgatccttagagaatgttagttcagtggttctcaaccttctgagaccctttgttcacactctctccttcaatcctactctctcagtggggagtgggggagaatgcttggcctctctttgttgactcttgagagtgtggcagaaaaagtcagctgctatggtagctgatgagttataaagcaggctctgcgatcacatatagatgcaggaatggtgagaaacagcataggatagcaataagaattcaggagcttttagttgatccactgtgttcatggccacgccagcaggaggtacgagttcccaggttcagtaaagccatctatccatcactgagtctccccgcagatgatgttattctccactgtctgcgcaaacgttttcaggttctatcttcattcttcttgtgattttaggactgtcaaatttgcttaatatcctctttctaattctgttaactggattctatttcacatacagaagatctttaaacatgcatggctacatataaagtctcctcagtatatgtttatatcaacttaaaataatcaaaagggtcagaatctagtttaaagagagtttattcaagcgcaattgtttaaggatagccacccaggaaaggcaaattccaaaaaatggaagtcggtgtttcaaagggtagaagtttgagattgtttatgtagacaaagtttaacatcttcctatataaggcttaatgtatagttacaatgatctaattagtttaagtagtcttttttctttcaggaaatgtatatgtaacatttcacactgaaggtgtagcagtcatggggtcttttgcagtgtctagtcggagttaggaatgggacaataaaggaggcagttaatctataacaaagatcactgaccggaatggggagggcctggtctctggtctcccctagtcagttacagaataagaacaatgaagaagtgagttaatctatcatctaagacacagaattgcaaaactgctctgtgactcaatctccagggcttaattcttccttagcataataaatttagaggcccctgaaatcttatttttgtctacattccatacaaaaagttatctctaattttacacaaaaacttcacccatctattttggacatttcacaaacacccacccatttggtgacttggctgcaaggactcatgggacttggaggcagttgtacctgcatccttgctttagtgtgctttatgtgttctctctctcaaggggacaatcatatagaatgtgctccttcctccagcaatgaaatgcagcaatgtatgtgaagtgtttctgcctaacaaagcacacttaagacccagtgtccaaggttttcacgggggggctggtcacccaggcatctgatcactaaagaaagcagaatacaaagtctagcaagctggtacagtgccctaggcacacaaaacagtcttatcagttaataacatagggaatactccaaagccaggttcccagaggccagccaatggtctactgcaaagcaagcccatcgaaccagccacatcaagcctgctatgtacactctttcctgcatgccaccgttcatgctttcttggaacaaatgtaaatatcccacatgcttattgagtttttgaaatttcacaatggataaaatagtaggactatactgagtgcaagtttgatatctgctcacaaagagttgtacaatgtgacagcatttccccttacatatttcagaatcactgatctactgcaccaaccaccacccctcagtcacaggcgggccttaaactcaggccttctaaactccctagagttatttctgtatacaccatgatcacctaggaagctttagaaactactaggcctgggtccccttctgagattcagatgaaattgatctggagtgcagccttggctttggaattttttttgctttttgagcgggggaacagagtcttactctgtcatccaggctggagttcagtgacactggcatggcttactgcagcctcaacctcctgggctcaatcaagcaatcctcctgcctcagcctcctgagtagctgggactacagaggtgcacaccacactcggctatgctttggaatttttaaaactcctcagttaatcctcaaagttaagacccactcctccttaggaccaacggttctcaatgtgtgttttctagaccaccagcatcagcatcacctagaaacttgttagaaatgcaaattctcaggcccgcaccaggcctatgaaatcaggaattctgggtgtggggcccagaaatccatgttttagtaaaccctccaggtgattctgatgcccattcaaatttaagaacccttgccctagaccaagacacaagtcttctatgtgcccccctaggttcttggtcagggccactgctgacacagccacaggaagcctgaagcactacacctgaatgcctccaagagccactacttagacagatttacttagcatcccctttccttcaatgtttcccaaaactggctttacatgtgggggagtgggacccaccttgtcagactcatggataagtataggaagatgagtgagtgaacaaaatttgtagaatgtcgagagggacaaagcagagagtgtggacattatatagtcaagcaaaagtgcctgataacagcagagtcaagaagccagcaaactgagacctgaattctactttctgctgcctctcttcttgtacccaaatgtctgtgtctcggtttcatcatctgcaaaatggagacaataattcctccccgatctaattcagaaaccctttttgctggctgcatgaaataatgtgtggaaatttgtagggatctgacaaagataaggtattgttctccagtctgtagggtgagaggcagggctgagagcaatagcattgtctgtctgctgaagggtttattgacctaatccttcatttaagatttatgttcgccaagtaggctaactagtgtctggaaagtggaaaattctgcccagtttctatattggtatcatgttaattcacaaaactatctcaaccatttcactaatttcagtctatatatttttctccaatttagtgaacttgattatacacatgcaaatatagctcttgtctgctttcattgatactttcagtggggaagggagggagggaaagaaattagcagttttccagtacttgacatgtaccatttgccttccatttcttttcctttttttttcttttttttttttttttttagacagagttttgctcttgttgcccaggctggagtgtaatggtgcgatcttggctcaccacaacctccgcctcccgggtccaagagattctcctgccttagcctcccaagtagctgggattacaggtgcctaccaccacgcccggctaattttttatttttagtaaagacggggtttctccatgttggtcaggctggtctcgatctcctgacctcaggtaatctgcctgcctcgacctcccaaagtgctgggataataggcgtgagccactgcacccggcctgccttccatttcttaacatttcattcctactataaaccatagaaagcgaacatgatctgtatttcacagataaagaaacagaaagtcagagaggttaaggaacttgacaagaaccacacagatggctggaggcaggggcagcactgtgcacaggtctctgcagttcatatgcttcccaccagtccagtgtctgtcatttgcagacccactccaactagggggtgaaattggtgatactcattaattagaaagactggcatttccagccacataagatttgtctgtgatcatggagccctccctgcagtgtctaagccaagtgaatgagagagagcttcacagaaagcaaacactctcttctgaagctctgctcattgcactttccaaattgaaacatggaagatcccataggcactcgaggaaatcgaactcttttgtacatggagaaaaatcagtgtaaatctctcatagatttgagtcaccaacacagagaaaggggctttggagcataaacagccttcctcaagaaatcaagggactagatacattgattaatctatcttcaaagaaaacacactcactctcctgagatatcttgatatctgctttcaaatccaggaaaaccattaccacagctagaacacttggatttcctccttctgttccaatgcagcaggcatatgcctgtgggcacttgtccctctgagtcatcccctctctgaagctttagcggcttctgcagattctccaaaccagggcaatagaaaggagactcttccttgaacccttaattgcagttgtcaggatgtcttaataatggtttttttattatttttaggcagtcccatttcaaactctttcctgctaatttcaactttagggttaaaaataatactgtgttatacttatccataggatgaaacttacgtggccacattttgagaacaatgaattgtttaacacctacagtgtacatcacctagaactacaccttgtcctgaagttaatgaaacagaacatttaaacctaacttaagtttacagaacctctggaggactcaatcctatttgagtaaataactatgaaggagctttttagtggtacaatttataggtgcccctatttgactccggagcccctcctcatattcccatatgccttccacttccctttggggcacataagaaattaagtggtgctgttggtaagcggtgctgttggtttacttacctgcataccctgcaatatcctcagctttttgaggtctggaaccatgtatctgagtcaccactatcttcccagaacctactacatagtaagtgttcattaaaaaaaatttgttcaaagaatgaatgggacaaagaattgcttgtgagttaaatatttataaattaaaatctattttaactctattaattgagcactttgggaataaacttacttttttttagtaaagtagtttcaaatgggtaaaaaatcctcccctttctgatctgccaacagagaaatttagtgactgggacatgaagtaagtgtgtgggcaagaggtctagaattcgatggaatcccaggaactggaatatggcctgaggggttgggaggctgggctaggaggtgatgcattgatgtgatacaaataatcaacaaaaactaaatgtgataaaaagtttctaaggtgataaacccagtgaaaggtgccttaaaggcaatgtctgtaagataggggccattattaccacccttccacagataaagaactgaaaaaggaataaagtaggttacatggtttttggatgtgctacagctagggagctagtggagttgggtttcaaagtcagaccatctgcctccagaagccccactgctgaccccagctgtccctgagctccacaggcaggctggggtagggggtgagtctcctcagaagggtgcccaaaaggaatagcaagttcaggcaggattctgactacattggggtccaggaattttaatgcagtacccaagacagtaaggtcaggtcacttacaggtaggttagggactctcctctgagagcccataatatcttgtgcatatctcttccaccaattacacttaccacatttatacatgtgtatgaatattttaaacttttgtgttttaattgtttttatttcttaaacaaaatattttaactatttattcagccacagatatctccctccaacccaagccactaaaagtgctcgtcaagggcaggaatcctgtcttactagtatgggggatcagaatatgccatccccaaagatgaagcattgtttaggtaaaggcaattaagaagaagcaaatgcaggaaagctctccaccttccctctatttacctaaaagcaggacccagatttacaaagtcaaaaggtatctttccctccttctatcagagagtgccactgaagataaatttagaccctgtcatctggagatggcaccaaagaaatctatatgaacaagctctactaactcacctttctctgctatgtatttgccttcctacaagttgctgccctgagagactcacagtcctttcctttgtcttctcatttctctaaaaatgtactgttcttttaattgaagatgctatacgacttggaattcaaagctacctcttggagaattactcattccctgggtgtctctcatgtacacatgaaatatccatgttaatttgtgcctgtttttctcttgttcatctgtcttttgttgcaggggtccattcaatctgagaaactatgagtgctgaatttaaaaagtattattcttccctttcactagcaaaaacggggtatccaattgatgtccagtaaatgtttgccatgactatggacaggtggatggtagacggatagatgataatagaaagagaatagaaacaagtagagcctccaagggtatttttccaggaactcaactcatatgaaaaatccttcctaacccctgcctacagactgtgtgaggaggtgagagaatgagtaggatgagcaaagaaaaaagatctcatcctgaggaagaagggagtgttatggaccagctagattctgagtcaaaaatgagccctgaactcacagagtacaggggcacatcaaaggttgaaccagagcccataccccatggcctgggccaacaggaggcagtcctgccataacttacggttgggatgaacagcaaactctccacactactcagcagctaaggagacccatggagaaagaacacagagagacccagtagtcgctccacctgttagtccagcaacaggaggcaaaggaggtgagagtgatagggacaggaggcagggaaacactggatagaagagggtggttccctggcaaaggcaccaccctcaagcctagagacctgaagccctaaatggaacaggccttcctgtttttgtgcccaagtgtttccttttgggctgccacaccccactatcctgtacccatataaatcccaggctcaagaatagatgagcagaggaacagaagagcagaagagcagcagagtggcagaatggcagagcaacatggcaaagaaggagagaacagaagaatctgaacatggagaggagtttagttgggggcaattggagagatcagccgcaggatggctgaactccaggggaagatcatcttcccactccatctcctctccagctccccatcccactgagagtcaccttcatcactcaataaaatccccaaattcaccatccttcaagtccatgtgacctggttcttcctggatgctggacaaggacccaggtaccaagagggcagagtgtaaaaagctgtcaccctgaccttccactgagctggtttaacattcagccctccacagatggcaactgctaaaagggcattaattgtaacacactcctagatgctaccatggggccagagcccaaaagcacttgccttggctcctgcacctgcctgtctgcatgctccccttcccgtaagggatttgagtgcacagtggctgagtaaatgagccacactcctgtcacaagtcctgagagcggttcagggaactctcccgtttcaagaataatagttgtatgcttgacatgctcatgtctaacacattccatacccatgagctgtgcatgcaaaggcagaacaatgaaatagtcagaagcatgattgttccctgaggaagatctgagctagctcttaagaaaaagaggtgtttgctgggtgcagtggctcatacctataatcccgacactttgggaagccaaggttgggggatcacatgaggtcaggagtttgagaccagcttggctgacatggtgaaaccccatctccattaaaaaaaaaaaaaagttaggcaggtgtggtggcacacacctgtagtcccagatactcaggaggctaagcaggagaatcacttgaacctgggaggtggaggctgcagtgagcaaagatggtgccactgctctccagcctggatgacagagcaagacaaagaagggaagaagggggaggggagggaaggagaggagaggggaagggagagaaggggaggggagggagggagagaggaaggaaggagggagggagggagggacggagggagggaagagaggtgcaaagaaggtgacacaaacaaggtcagagagtaagcaaatgctagcctagggcatcatggctgggagcacaggcctgaggccttgcaggaatcatgccattgtggaaagtgactccaaaatattctagtcagccatatacctttaatgtcactatccacagagggtccatttctaattggcatcatcctagttaacaggccaatttcatcactgaaaaactatttcagacattcactaggttattcaagaaagcctgagttattgatccaatatggatagcaaatatgaatgtctgcttcacctttgtcctgtgtccttcagaatgtgggcttcctgtttggtgttaatgaagcacattggaattgtgctctcctcattagaatgtgtgtagcatgtggatgatagctgaactacacacacacaaacacaccatcactcttttgtactgaagtatgtttaatacaggcatacctttattgtgctttgcagctttagtgtatttttttttactaattgaaggtttgggacaaccctgcattgaacaaatctgttgacatcatttttccaacagcatgtgctcagttagtgtctctatatcacattttgctaattttcacaatatttcaaacttcattattatctctggtatggtgatctgtaatcagtgacctttaatattactattgtaattgtttgaggtcaccagaaactgtgctcatataagacagcaaatttaattgataaatattttgtgttttttgactaatccatggactggccattcccttgtctctctccttctcctggggcctccctattctctaatacacaacaatattgatgttaggccaattaataatatctcagtggttcttaagtgttcaagtaaaaggaagaatcgtacatgtctccctttaaagcaaaacctggaaatgatttagctcagtgaggaaggcatgtcaaaagctaagaaagaccaaaagcgagacctcctgtgccaaaccattagccaagttgtgaatgcaaagcaaaagttcttgaaggaaattaaaagtgttactccagtgaacccatgactaataaagcaaaagagtcttaatattgatatggaaaaagtattaagggtctggatagaagatcaaaccagctacaacatttcctgaagttaaagtgtaatccagaacccctaattctcttcaattccatgaagactgagagaagtgaggaagctgaagaaaagttggaagcctgcagaaggaggatcatgaggtttaagaaaataagccgtcttcataacataaaagtgcaaggtgaagcagcaagtgctgatggagaggttgtagcaagttatcctagctaagatcattgataaagtcagctacactaagcaacatattttcaatctaggtgaaacagccttctattggaagaagatgccatataggtctttcacagtaagaaagaagtcaatgtctggcttcaaagtttcaaaggacaggttgacgctcttgttaggggctgatacagctggtgactttaagttgaagccaatgctcatttaccattctgaaaatcctagcaaccttaagaatgatgctaaatctactctgcctatgctccagaaatggaacaacaaaccctggatgacagcacatccatttacatcatggttaattgaatattttaagcccactactgagacctactgctcagaaaaataggttcctttcaaaatattactactcattgacaatgtgcctcattacccaagagccctgatggagatgtacaaggaaattaatgttgttttcatgcctgctaacacagcatccattctgcagctcatggatcaatgagtaatcttaactttcaagtcttattacttaggaaatacttttggtaaggctgtagctgccatagattgtgatccctttgctggatcttggcaaggtcaattgaaaaccttctggaaaggattcatcattttaaacatcattaagaacatttttgattcatgggaagagtcaaaataacaacattaacaggaatttggaagaagtttattccaatcctcatggatgactttgaggagttcaagacttcttggaggaaatcactacagatgtggtgaaaatagcacgagaactagaatgagaagcggagcctgaaggtgtgctgaatttctgtgatctcgtgataaaactttcacagatgaggagttgcttcttatggatgagcaaagacagtggttccctacaatggaatgtactactggtgaaggcgctgtgaacattgttaaaatgacaacaaatgatttacaatatgagatgaacttacttgagaaagcagcagcaagatttgaaaggattgtctccaattgtgaaagaagttatattgtgggtaaaatgctatcaaacagtctcatatgctacatagaaatcttttgtgaaaggaagagtcaatcgatgtggcaaacatcattgttgtcttaagaaattgtcacagctaccccagcctttaacaatcaccactaagatcagtcagcagtcaccaacactgaggcaagatcctctatcagcaaaaagattatgactcactgaagaagacagcatttttttttagctattaagtattttaaaattaaggtatgtacattgtttctgttaacatactgctgtctcacactcagtagactacagtatagtggaaacatgacttttatatgcactgggaaataaaacatttgtatgacttactttattatgatattcatgttattgtagtttgagacaaactgaacgtgcaatatctataaagtatgcctgcaaattccagatgttgtcattaatagtatctaaatctcagattgacctgacctgcatagttgcctgagattttgctgttatttccagatctttgggagctgaggcaaatagcagtgtggctaagtgtacccaaaagagggaagcagatgctaccagcaggtctctgcaccatgtggtcctaggcaaggcaaaacctcagaatggtgtcctcagccttggaaaccccttataaatatcttccaactcttgtaacaaccctaagaaggagtcactaagaagttagaatttttttttgttttttttagccaactctagtatctgccagttgagccacatttgatttggttgagaaaaaaataattttttaaaattattattatactttaagttttagggtacatgtgcacaacgtgcaggtttgttacataagtatacatgtgccacgttggtgtgctgcacccatgtccaacaatgatagactggattaagaaaatgtggcacatatacaccatggaatactatgcagccataaaaaatgatgagttcacgtcctttgtacggacatggatgaagctggaaaccatcattctcagcaaactatcacaaggacaaaaaaccaaacactgcatgttctcactcataggtgggaactgaacaatgagaacacatggacacaggaaaaaaaataatttaagcaacattccctacctcttgactatgatgggtcaaatgcatattcattttatatgtattatttaatttaattcccacagccaaactatggtgttggtattaaatctccccattctgcagtagagcaaactgagattctgagaggttaaggaaccttcttgaggccatacagctagtaagccagggtgcaaccctaggtctgcctgattctaaagtgtgtgtgtgtgtgtgtgtgtgtgtgtgtgtgtgtattctcatctccaaaggctgacttttacattaagtggcaaggagctatttaaatatattcaggccacaaagtgttaataaaatacagaaaaaagtcagaaaaaatttttccatttttattgccatttctgtccatttaaaattcctttcctgctaggttctagccttttgacccttatcttcgttaatgtaatgactggagagccttgattgtttaattagaaaatacggcactgttattcaaagagttgtcactacctaagctgtaatggtcagaggacagtcttaaaacaagaaaaaaaatacttgacatatctctctaatttaattgtatttattttcatatttctaaaaatatcctctctgaaaacagcttctgggcacaaattcaaaactataaattggtcaagctgacagcactctcctcctcagcttcttcatttaggaaatgtccaaaacgtcatttgtaccttgtattttgtttcatcataccgtaccctggatgatgtctccctcctctcccatctaaaacgtccagctgtcagctggtgcagtaagcactggatgaacacgggctccaagccccaagtgggagaggtccaggattcacggatgtctcagacatagtccctgttctcaggaggttgttgtcttaagaaactgccgcacccaccccagggctgggcttcttagacctgaggccatctcagattcatcccaccattgagaattttcatgctggtggtcacctgatcacactttaacaatcctggtgtagggaccgggcacagaggctcacaactgtaattccagcactttgggaggccaagtcagctagatcacctgaggtcaggagttcgagaccagcctggccaacatggcaaaaccctgtctctactaaaactacaaaaattagctgggcatgggggcgggtgcctgtaatcccagctactcgggaggctgaggcgggagaatcgcttgaacctgggaggcaaaggtggtactgcactccagcctgagtaacagagtaagactctgtctcaaaagaaaaagacagaaaaaagaaaacaatcctggtgtagggagacgaaaaggaaatttcaagggcacttgtcagaaagttgaaatgattgccaccataatagctaatacctactgaacgtttactctgtgtcaggtactgcttcgtgagctcaactcatgtattccttaaaatatttctatcgatgccatttcacagatgaagacactgaggcacagagttactaggaaacagagaaaaggattcctagggatggggatggagaccaggtgcttcgggctgaatcgttttcatccaaagttcgtatgttggaagtcgtaacctctggtgcctcagaatgtgtctgtatttggagacagaatcttcaaaaagataattacagtacaatgaggtcattaggatggacccaaattcagtatcactggtgtccttataagaagcgaaatttgtacacagacctgtggacacacaaaggaagaaccagatgaagacacagcaggaaaggggccatcatcaaatcaaggagaaaggccttagaagaaaacagtggctcacacctgtaaccccagcactttgagagtcagaggtgggaggatcacttgaggtcaggaatttgagaccagcctggccaacgtggcgaaaccctattaaaactggaaaaattagccaggtgtagtggcacacacctgtaatcccatgtagttgggaggttgaggtaggagaatcgcttgaacccaggagatggaggtttcagtgggctgagatcgtgccactgcactcagcctgggtgacagagtgagactccatctcaaaaaaaaaaaaaaaagaagaagaagaaaccaagcctgttgacacctaaaattttgaatttctagcctccagaactgtgagcaaatacatttctgttgtttaagccaccctgttgtttaagcctgtttaaggcactttgtcatggaagccaaagcaaaacaacacagtaggtgttcaacaatggctcattaaaatggcatgaagtagtgttgccgacctggtctttttaatgactaggaggtcccatacctcactttcccggcatcccttgattaagacatagcaggaattggccgggcacggtggctcacgcctgtaatcccagcactttgggaggccgaggcaggtggatcacgaggtcaggagatcgagaccatcctggctaacatggtgaaaccccgtctctactaaaaatacaaaaaaaattagccgggcgtggtggcgggcgcctgtagtcccagctacttgggaggctgaggcaggagaat

SEQ ID NO: 11927 - DNA, 15585 bp, Human
  misc_feature (1)...(15585): n = A,T,C or G
tagtagctgggactacagggtcctgccgcagtgcctcaacatttctgtttattaggactaagagagtgctactggcatgtagcaggtagaggccaggcatgctgcttgaagtcttacaatgaatgcccaaggcagccccccaaccatgaagaattatccagcctcagctgtcaacagtgtggaggttgagaaaccccaccttagcctcatagttgaggttcatggagcatggtctcaaattctcctctgcccctggcctgctgtgtgacgctgaaaaagtgattccaagcccccgtgcctcagtttccccacctgtaaagcaaagtacttgtattaataataacagtgtcagctgggcacggtggctcacgcctgtaatcccagcactttgcaaggccgaggtgggcagatcaactgaggtcaggagttcgagaccagcctggctaacatggcaaaaccccgtctctactaaaaatacaaaaaatagccagtcgtggtggcagacacctgtcatcccagctacttgggaggctgaggcaggagaatcgcttgaacccaggaggtggaggttgcagtgagccgagatagcatcactgcactccagcctggggaatagagactctgtctccaaataataataataataataataataataataataataacagtgtccatctctgagggcgtcatgagaattgaatggatatatgtacagagttggaacatggcctgacataagggctgtagtctgtggcatattgcagccatgccattagcatgtgaccgataaactgcatatcctcaacatatcattagtgtgtggcaggttgcagacatgtcatccaagtgtcacaaacatggccttgccatgtggggcatgatgtgggcatagcatccacccctgtggtccaggggtgagatctggctgggtagggctgtttgacagggacacagttcacggcctgggacttgccaacaaagtcaccctgtagttcaggtgacacacaagtggatggggagggtgagacccaggatctcttctcccccaggtccttatgaggggctggaggagacagaactggggtgctggaccctcagcataaagaatgctataggctgggcatggtgactcatgcctgtaaatcccagcgttttgggaggccaaggcgggcagattgcttgagcccagaaatttgagaccagcctgggcaacatagcgagaccccgggcaacatagcgagaccccatctctaaaaaaataaaataaaattagccaggttggtggcacaagtctgcaattctaactacttggatgggctgagatgggaggatcacttgagcctgggaggtcaaggctgcagtgagctgtgattgtgccactgcactccagccgaggggacagagtgaaaccttgccttaaaaagactgctatggcccgagtccctctgctgtgccgggcactgtgctgggcatgtaacaggcatattcttctgatctttacaactctcccatgaggcaggcactatcgttagcccattttacagatgtggccatagaggcccagagaggagaaggggcttacctaaggctatagactgttggtatctggagataaacccgggatggtgctcactaaactaccttgggtgtcagtcctgcttcaagactccagagagataaagagagatgacctcagagacaaagagactcagacccagccagaggcccaatggacagtgggaggggtgggtggaagaaggctggtctctgtctgaccaagcccccccagaataacgcaggctgcccccctaggtggaaacaatgacacaatcagctcccaataccaagggcctgacatcacaaggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaaggtagggctggagggcctccctggcctggcccacacgtcctgccaggccagagccctgagcttggggtcccttgaaccccctcctgcctatcctatgtgacttggaaactgagaggggaaaagggagtgatatgggataggggctgcctgtctccccctgaacatcccggagcccccagctatggttggggctggaatgggggggcacacagccacacataaacagagggggtcagtccattgcaaagatacccacctgatcagtcttctgttaacccttcgtgttcttggggggaacaacatagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccaggtaaagcaggtacagcgctcggaccctggactcaccccccatacaccaggatgggctcagcttctcccagctggagaactttaagtttccagcccactggaatcgccccaacagtattgccgagggaggagttcctgccccatttgacagaggggaacactgaggctcagggtggcttttcccagggtcccatggtgaggaagtgggggactgggttggaacctgggtcgagggatctcggggctggaggagggggctggtggggggcgggtcctcgggcgagagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggccaggtgagggggccgcccctcccacctccccccactcacccgggagaagaagaggcagcccggtcccctaggggctgggagcctggctgggcttgggcggagggttctggagaaatgggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcagacagagatactgggagcctgagacaccctagggacagacgggggagggcgagccaggagcgagataagacctagacaaggatggaggggcagggagaggagacagagccccaccacccccaccccaggcaggaaacctggagacagagaaagacctagagaggcagatatacaagacccaggagccctacccctggccagacagggactagccacctagagagatggggacccaagactgggccaagaaaagacagcgctggggaagagagagacagaggagtcggggggataagagggagagagacatacagacgtgcaaggggtgggggctaagacagagacaagcccccaccactaaccagagacagagccctggagctgaagacctgggggacacggagagacagagatgtatgaccagcactcctctgcaagccagcacccagggacacctccttagacatccttcttcccttcctgaggtgccctctcttccaacagggggcacagagggggcagggctagaggaagagaagccccaagtttggcctgggcgaaaaaccagggtgccgggtgccacccctctagctcagaggatccagctccccacaccccacccctcatctacattccctggtgccaaacctcagaatgcccggaatggccccctgggcaggtgccacctcagccctggctctcagcccgccccagcccccatcccccaactatggatctggggcaaaattgccttagttgggaaggacgagggagatcaggctctaggaagttcagacaggacccagggagcccaggctgcccccaatgcatcctcacccctttctctgtgccccctgccctcccctcgccccagctggcccagaagtatgaccaccagcgggagcaggagctgagagagtggatcgagggggtgacaggccgtcgcatcggcaacaacttcatggacggcctcaaagatggcatcattctttgcgagtgagtgaggctctcgaagccgagaccctgcaacatcccccaactccatgcagcccctcaacccccaaaacaaccatgatcctggaactgagttgaacactttctattggatacctttggggtggccagtaatcattgtgcccatttaacaggcacagaaaactgaggctcaggtgaaatgcattgcaccaagtcccacgtggtttcaagggaaatgactctagaatcttaaccaccatgctatatagggtaggcccatctgtggccgccagagtccccagaaagagcggtcacagctaaaaggcagcagccaacagctgttcatggctggcttggtgatgtgaggagagatgtgcagcaataattaaaggaggccctggttttctttctgttttctttttgtttttttgagatacagtcttgttctgttgcccaggctgcagtgcagagacacaatctcggctcactgcaacctccgcctccagggtttaagtgattctcctgcctcagcctccccaatagctgggattacaggcacgcaccaccatgcctggctaatttttgtatttttttaaagtagagatggggtttcaccatgttggccaggatggttacgaactcctgacctcaattgatccacctacctcagcctcccaaagtgctgggattacaggcacgtgccaccatgcccggttaatttttgttttttttttttttttttcagtagagatggagtttcaccatgttgactaggctggtcttgaactcctgacttcaagtgatccacctgccttggcctcccaaagtgctgggattgcaggcacatgccaccacgcctggctaatttttgtattttttttttttttttttagtagagacagtgtttcaccatgttgaccgggctggtctcaaactcctgacctcaagtgatccacctgcctcggcctcccaaattgctgggattacaggcatgagccacctcgcccgaccttcttcttcttcttcttttttttgagatggagtcttcctctgtcacccgggctggagtgcagtgacatgatctcagctcactgcaacctctgctttccgggttcaagtgattcttgtgtctcagcctcctgagcagctgggattacaggtgcccaccaccttgcccggataacttttgtatttttagtagagacgggattttgccatgttggcctggctggtctcgaactcctgacctcaagtgatccacccgccttagtctcacaaagtgctggcattacaggcatgaaccactgcaccctgccggccctggttttctcctcgcctcaaaacctcattgctgagggaggtgaaaaccctaacagctcccaagccccagttccactgcaatcttttttttttttttcagatggaatcttgctttgtgacccaggctggagtgcagtggcatgatcttggctcactgcaagctctgcctcccaggttcaagcaattctcctgcctcagcctcctgagtagctgggattacaggtgcccgccaccacgcccagctaatttttgtatttttagtagagacggggtttcaccatgttggtcaggctggtctcgaacccctgaccttgtgatccacccacctcggcctcccaaagtgctgggattataggcgtgagccaccgcgcccggctccactgcaatcttaatgcatagcagggccctaaacccagcctgcgcccgatctgcatttgagtctgacccagggcagagtgactgtgagtggcctcgggaagactttgaaggtgcagcttcatcaagtcctagatgctgggaagaaggggtgtggggggtgtttaccttgttccattcccatccactaggaacaaggaattggcaggtggggaggtaggcatgctggtgtcccagctcaggcagaggactgctcagacgtcaaacagtgcagtcccagcctgggcaacatagccagattccatctctacaaaacatttttgttttaattagcttggcatggtggcatgcgcctgtggtcccagctactcggaaggctgaggtgggaggatcgcttgagccctggaggtcaaggctgcagtgagctatgatcgcgccactgcactccagcctgggcaacagtgaaaccctgtctcaaaaaaaaaaaaactaatgtaaacgacaagttgatgggtgcagcaaaccaacatggcacatgtatacctatgtatcaaacctgcacgttgtgcatgtgtaccctagaacttaaagtataataataataataataataataataaaagagtgggccgggcgcggtgactcacgtctgtaatcccagcactttgggaggctgaggcaggcggatcacgaggtcaggagatcaagaccatcctggctaacacggtgaaaccctgtctctactaaaaaaaatacaaaaaattagccgggcgtggtggcaggcgcttgtagtcccagctactcgggaggctgaggcaggagaatagcgtgaacccgggaggcggagcttgcagtgagccgagatcccaccactgcactccagcttgggtgacagagcgagactccgtctcaaaaaaaaaaaaaaaaaaaaagacctaatgtaaatgacgagttgatgggtgcagcaaaccaaaatggcacatgtatacctatgtatcaaacctgcacatagtgcacatgtaccccagaagttaaagtataagaaaaaaaaaaagagtgtagtgcagtcacccacgcactccggtcattcactcattcattcattcattcattcacaaaagaagcatttatgagttcctgctgtgtgccaggctctggcctaggcactgggaacagtgaacagaacagactcgactcagagctcaaggacttttagtccagttgaggagatcaatcatataattgatcaaataatcacagatttgtggtcgtaagtgtcctggggaaaactcaagcggaagggaagatgggagggtcaggtatatgtctgcgggtggagagtctgcagtttcctagagagtggtctgggaggcctctctgaagaggtgacatttgaacagaaccttagatgaagtgagggagggctcaggggacctgaggcaaagcagagggggccaccagtgcaaaggcgtgaggtaggatcgtgcttggggtgttcaagaaacaagaaggaggctggcgtgacgagcaccaaatgattgagcagaagtggagatgaagtcgcagagtgaactgagagtcagatggtggagggcattttatttcatttatttatttagagacagagtcttgctctggtgcccgggctggagtacagcggtgcaatcatagctcactacagcctcgacttcctaggctcaactgatcctcccaccccagcctcttcagccccagcctcctcagtagctggaactacaggcacacatcaccacgcccggtgaagttttcgggttttttttttttttttttttgtagagacacgggtctcaccatgttgcccaggctgatctgaaactcctaggctcaagccatcctcctgtctcggcttcccaaagcactgggattacaggtgtgagccactgtgcccagttctacagagggcattttaggcagaggacttaggatttcattctgaaggcaatgggaggctcctggaggatttggaactggacggtaacttgaactgtttaaaaaaggccattctgggccaggggcagtggctcatgcctgtaatcccagcactttgggaggctgaggtgggcatatcacttgaggtcaggagttcgaaaccaacctgaccaacatggtgaaaccgcgtctctactaaaaatacacaaaatttagctgggcatggtagcaggcacctgtaatcccaactacttaggaggctgaggcaggagaattgcttgaacccaggagacagaggttgcagtgagccgagatcccgccactgccttccagcctgagtgacagagcaagactccatctcggaaaaaaaaaaaaaaattctggctgctggatgaagaagggtgggtctgtaggggatgaagtggaagttgggagctcattacaagaggccaggaaacagactctggtggctgagacccaggtggaggtggcggggagcagtgggtggttttctggactcattaaaaggcagagccaaagaactttggagggactggacatgaggctgagagaaggagaaagggggagttgggggcaagtccaagggctctggctgagcacctagaagggggcactgctaggcagggaaggtggagggaggggggagtctggagggggaagctgcatgtcaggagtctggagcagggtgagtttgatttgagacacccaggcacccatggagagagctgaatgagatggtaagaaacccaagctgcagggagatgagggagttgctggcatatggaggcacttaaagtcaagacactgaatgaggccaggtgctgtcactcatgcctgtaatcccagcgctttgggaggctgaggcaggaggatcgcttgagcccaggagttcaagaccagcttgggcaatacaaatacagtgaaaccccctctctaccaaaaaaaaaaaaaaaaaaaaagccaggcatggtggtgcgcacctgtgatcccagctactcggaaggctgaggtgggaggatcgctggagcctgggaagttgaggctgcagtgagctgtgattgcaccactgctctccagcctgggcgacaaagccacaccctgcatcaaaaagaaaaaaaaaagaaaagaaaagaaaaaagaggcgagatcattaaaggagtgagtcagagaagaggcccttgtgggcttcctgctgtctacaagagaaaaggatgctgagacacgcctgccagtgaggcttcggagatcccagagactcggacacaccttggataagcaggctttctgactgggacctgagtctagctccttggcatcagtgtcccatttgtgtgtgtgcttgggtggtttggaggggctgcagctgagagctgactgcagggagaagtgacgctagggtatggcatggccccttgtggtcatcccgtcaccctcctcctgctgggctgggctggagagcgggagtgggggacacctttctttcttttttttttttttttgagacggagtctcgctctgtccccaagctggaatgcagtgctgcaatctcagctcactgcaacctccgcctcctgggttcaagtgattgcctcagcctcctgagtagctgggagtacaggcatgtgccaccacgcctggctaatttttgtatttttagtagagatggggtttcaccatgttggccaggatagtctcgctctcctgacctcgtgatccacccgccttggcctcccaaagtgctgggattacaggcgtgagccaccgtgcccaaccctggggggacacctttcttaccccttccccactcttctcagattcatcaataagctgcagccaggctccgtgaagaagatcaatgagtcaacccaaaattggcaccaggtgagcccagacacaatctcttccatccttgcccgcaagcccctcagacctcccctccccacccagtgaccaccacctgcccccctctagctggagaacatcggcaacttcatcaaggccatcaccaagtatggggtgaagccccacgacatttttgaggccaacgacctgtttgagaacaccaaccatacacaggtgcagtccaccctcctggctttggccagcatggtgagtgtggttgcaggctgggcagggggtggtgggcagcctgggctgggatgcaggtgtggccacttgtgctcctgagcccagtgaaggtggcggagcggggggcagggatcggggagcaggtgctgtcaacagcgtccaagggggccgggcgcggtcgctcacacctgtaatcccagcactttgggaggccaaggtgagcggattgcttgaggccgggagtttgagaccagtctggccaacatggtgaaatcccgtctctactaaaaatacaaaaattagctggacgtggtgacgcatgcctgtaatcccagctactcaggaggctgaggcaggagaatcgcttgaacccgggaggcggagtctgcagtgagccgagatcgtgccactgcccagcctgggtgacagagccaagactccgtctcaaaaaaaaaaaaacaaaaaacaaaaaacagtgttggccgggcacggtggctcacgcctgtaatcccagcactttgggaggccgagacaggtggatcacaaggtcaggagattgagaccatcctggctaacatggtgaaaccctgtctctactaaaactacaaaacaaaattagccgggcatggtggcaggcgcttgtagtcccagctactagggagactgatgcaggagaatggtgtgaagccgggaggcggagcttgcagtgagctgagatcacgccactgcactccagcctgggcaacagagcgagactctgtgtcaacaacaacaaaaaaacagtgtccaaggggactgtgcagcctggaggcccccttgtcagtccctgctttccctgccccacctaggcgaagacgaaaggaaacaaggtgaacgtgggagtgaagtacgcagagaagcaggagcggaaattcgagccggggaagctaagagaagggcggaacatcattgggctgcaggtaccgccctgtcctcactgcgcagaggtcatagaggccaggagggcaccctgatgtctgaaggcttttggggacaggatatttggcattaactatactataggccgggtactgtgcttatgctcatcttccattcacaaactcactcactctgccaacaccccagcagacaggtgcttgttatcaacataccctttccgcagatgagaaaactgagacccggagaagctggctcgcttttgcacagatcttccagctgatgcgtggcaggctggaacttcaatgctagaagtcagtcatgtgataggcccactctgggcctcagtttccagtctcgaaaggatgcctcaggcggggtgcagtggctcacacctgtaattccagcacttggggaggctgaggcaggaggattgcttgaggtcaggtgtttcagaccagcctgggcaaaatagaacccccctccaccgccatctctacaacaaatttaagagtttagccaaatgcagtggtgtctgcctgtggtcccagctacttaggaggctgaagtgggagaatcacttgagcccaggagttcaaggttacaatgattgcatcactggactccagcctgggcgacagagtgagaccctgtctctaaaaatgaaaatgggctgggtatggtggctcatgccagtaatcctagcacttcgggaggccgaggcaggcggatcacttaaagtcaagagttcaaggccagcctggccaacgtggtgaaaccctgtcactaccaaaaatacaaaaactagccggtgtggtggggcacacctgtagtcccagctactcaggaggctgaggcaggagaattgcttgaactcaggaggcagaggttgcagtgggccaagattgtgccgctgcactccaacctgggcgacagagtgagatgctatctcaaataaaataaaataaaacaaaaaaatagaatagaacaaaataaaatataaaaataaaataaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcgagatggagatttcagtgagctgagatcatgtcactgcactccagcctgggcaacagagcaagactccgtctcaaaaaaaaaaaaataaaataaaataaaaattgaaaaaaatgataaagcggcgcctcatcctctcccatcagctatgcctcatggcccatgatgaggtctgtaattattggtgtgattctccttctggcttcctagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggtgagtgggggcccccgggacacgccgtcaaggcccaggaccctggccaccccacggcctgaccacaccacccttcgcaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcctgaggcctcagagctgctctgttttagatatgcgccatatcccgcacacacatctgcacggacacacatgcccacatgcaccctaagacgtacatacacactcacacgcaccctaagacacacacctcactgtagccactcagctagacacaggacaggcaccccatcacactcacatgcaaagtccacacacacacacacactcccccctttcacacacagatatgcacacacaggcagtacacactccctacgacatgtaaaaaaggcatagccagccgggcacagtggctcatgccggtaatcccagcactttgggaggctgagatgggaggatcacttgaggtcaggagttcgagaccagactggccaacatggtgaaaccttgtttctactaaaaatacaaaaattagcagggtgtggtggcgcatgcctgtagtcccggctacttgggaggctgaggtaggagaatcacttgagccctggagatctaggctgtagtgagctgagatggcgccactgcattccagcctgggcaacagagcaagactccatctcaaaaaaaaaaaaaaaaaaaaaaggcacagccagagagccaatgcgcgcgcgcgtgcgcacacacacacacacacacacacacacacacacacacgacccacactgctctcccagaggcttgtggatggtggtgacaaagagcctgagtactgggacaggctaaatggcatgtgaatcacagagcagctgcctgggtgacctcgggcaatcactttccctccctagacctgttttcccatcaaaataatggggacagtaagcctcttgtggtcatgaaatgacacccccagatggggtgatgttctacatgtttaatcgctggtaaagaccaggcatcaatagagaaaggatgacaagtaggggtcctggtgggccctgtgggcagggtgaaccctttagccccagactgtggggaggggaaaggggacagggagaggggcacttctgagccaaggcaatggccctttactgactggcacagggcaccatagggcacggttaattctgtgcgccccgcccgctctcagccgtcttaaggctgagcctgccaacccgggactctaaaaggctgtgtccagggcctcaacctcctcacatttcagaggggaccctgttatccccgggaggagggagaggtccccaaccatcaggattccaaggaggagaggaggcagagaagcgaggagcgcggcacggagctgtcttctccccagggagggcaggagttgaggctggaacgtggagacctgcggaggcagacaccagaagacccgcgcacagacgcacgcagcccctggggcctcgtaaaccggattccaggcgcttttggcctggctaccgcaagtcgtgctccccctgggccggcgcggggaagctatgctgaggaggatccgggcctggcccagggccctgcctcctcgggaaaacagcaccatattagcacttagcctgtgaggctggggtgggcgggcggcaggaagggcctcgggtgccagaggaatgagccccctttttgctggatcccagagggccatcaccctaaacctaggtgcctgtccaccactctgcgcatgtgtgccggctcctgccagggctagcagaccttacctgggatcttggaggtggcgggataaccagggaagacatgtcatggcagagtgggcctgggggggtgcacaggccagacccagcagcccagtctggcagccagggcttccgggccagctcaatgtctccccccgctgttcacatccgtcagtgccctgggtgggccccagagccgctcaaaccatgcctggcacttccatcctcagcatggctccgggaagaaggtgctttcatcccctgcactgtagcaacgaggactctgaagcacaggtcacctgccacccgggctcatgaggccaggtggagggtctggcactgccccaggttgctgggtg

SEQ ID NO: 11928 - DNA, 10066 bp, Human
  misc_feature (1)...(10066): n = A,T,C or G
agtgccgggcaaagcatgttaagagacaaggatgaatttaagttctataggaatgtggatttattaaaaaacattaagacaataattaattgtcccaaagataaaatgggacaccctcaccaggacgcccacacgccttgcaaagacagccgtcctgtcctccctggcccagacagagccttcccccttcatctcgggctccccctgatccagcgtgcctggccctcagcgggggacttgctccacactcctgcttacttaggaactagcggggccaaggtcacaagcgctaattactgagagaaccctgcccccaacacaacggctgcccagatgctctcggctgccagtcactgggccccggtcaatgggcgcttgggcaaatctgtggatggttcaaaacaaagccatttgcattcctggaaacagagttaaggtgcaggtccccaagaagggctggtcctggctctcagttgctggggtaaatgtgatgaacacgagccaagaacactgtcaattcactctgcataaccttcaccgcccacataccgcaggtacaagacaaacctcctttctccactccagactcactaaggtccccacctagtcttacagccacatgcttctgccggaccctctaaaacttaacatacaaaaccctctaatttttttttacatagtccattctttcaaaatgtttaatgttcattaaactattttgaaacaaaaactataatacagttacaattcagttttccattttggattttaaaatgctctggttcgagtctcgacatttttcttaaaaatgaacattacggtatattttaggagataatttatatggaaaaaaacacacacactaaatgtcggcttgcacctaaattgtttacacgttcatgggaaaacctagctgttaaccttggtgagggctaagatcgccctctacaagataaacacgtttctcccaattccaaggggagcctgcgtgctcccctcccccactctggtggcccggaggacagaggggaccctaggactggagggggacggagacgggctcagggatggagggggacagagagggacccggaggtggaggaggacagagaggggtaccccaaggttagagaacagaggatgactagggggatgtagggaaacagagcggcgcagaagaggacagttggggacggggcggccccgggcatagaaggggacagttggcgaccgggaagcccccggcgtagaaggggacagttggggacggggcggcctcgggcatagaaggggacgggggggaaccgggcggccccgggaccggacggccgcccgcagggtgagctgccggaaccggggctcgcgcggcgacagggcccggcttggtgaccgggacgggcgtggggtggcgggaccgggcagcggggaagagagaccgggactggggacaggcgacgcggcccgccccggctctcccagaccccggctcccttagctccggccgcgggcgcagtgcagggctcggccgcgcacctcacagccgcggactcctccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacatcatcggcgcgcagcccccgggccgggagccacgggattgggccgcgcacggggcgggcgcggggcgagtcacgtgggggcagggggagtggggggagccaggcaggaacggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacaggtaaacgcagccggccgcggttccctgcgggcgccggggcgcgggccgggtcggctgtttggggttcagacccggtgctctctgcggtccgctgggcctgggccccgcgctgtcaccgggggagcgggcgcagcgcccccgccgatcgatcctccaggctgcgatcagcgtccgcccagggaagccccaactcccggcacagcccggccgagcccctggcacgagttcggagcctgtccccgctccagacgccacagctggagcttgtcatggggaccaacttgctctgcctgccaaggtgttttttttttgtttgtttgttttttgttgtttttttttaacggattttgtttttgttttgtttcttggtgcttgtacttaacagttttttaaaaaaatcacattttgcccccagaacgtagaccagctctcttttatttttgtcttttttaaactgtagaccatttccaatgtgttttctgctctttggaatgcctaacatttcccctagatctgccttatttgtcttccctgcttctcttgttgaccaagaaaaataaaaataaaactgtgtacaccccagtgacttgtcagtcttgtgacaatgagcccgtccaaactgcttcaagtcttagtttggaaagaaggacctcggtttccgacattgtcgtagaactggaatttgggggcattggaaatttaagaaacttaccaggtccccgtgcttataggtagcatcgcccgaggggagagagactgacactcctcccattgtctctccagcgatcgcaggagggtttactgttgtctccctgccctgctgtgctgtttgtttttcgtcacaaagtgaattgccagatcaaatagaggctgtgggtttccaagcctcgaaagctttaaggaagatgaaatgcagggtgttgcaaccttcacacgcctgcttaattgttcacagtcctctcctgccttttccccctccccctcctgtttttttcctcctcaaagaagctgctccctaggacgtgattgaaattgatctaagtagtttccttcgggcgtttgggatttgggcaaacggccagacctggctcttggtcgcctttggaggcttttaaactctccgagagcttcgttcaggtcccgggtgctcatcagcgtaatggagattttaaattggccggattattaaagtttaacaagatctccataaatgtgcttttcttttttctttgttaaatcaataaaatacatcgctgctgcctctcttcagaacgctgtagtgtgcattgtaactcagacgcctggtttcgggggaaaggggaaagcatgattctcccgtgtgcttgctcccaccggctgtgtgcgagcctggggagggggagggattgcctgtggcaggagagaggcacactgctaagtcagcctgagcccctggggtaggctgcgctcaggaaggtccctgcccggaaaaatgacgtgctcaccagagccgtttggtgtagaaactgaaatctgtagaattgccagtagtatagacaaccttatatggacatgcaggcagctgatcctcgtgaaaatcagggcagacataatttaatcctaaaatgtttcctaccatttttcttttccagtggctagaaagtttgaaatggtggggagaggggatgctgatctcggcagttgtagcttcttgaaaggttggttgcggggctggggaaggggtactgtccatgccacactgcatgtccatttgagctgggtccttatttggctgctgatgagaatttcaaaaggaagtctcctttggcattgcgtgaaagaaatcagagtgatgactcatgcagttgtactcttggccagtagataaagttcttgttcattgtgggactcccagcagggccgtggagtaatttccccttgcacccttcacaatagcagatggccatgctggaattatttctgcactcctgttgttgaagttccttgtttttctctgaccactgtagaagtaattaaagttctgtgtcatgcaagggcctgcacttgggaacggcattctgtgaaaacataggcggtctgggctacacaggaaatgggtggtttttctgcagctccattcgatgcccctgaatacagacagctgctgtctcctctcccccgagtgtggccctgtgttgtcagccgtgtccccaagggggtccctcagaacacgctgtgtgccgtgcagtctttctgtcctgtgtgggtatctgtggagtgtgaagggtggatggctggggctttccttaaaacacatggttcttgacaatgtcagataatctggttgaacctgttggggaggagtatgtgtatggggccggttctcttcctctggtttcatgagaaacatcaacactggtaactacaacaaaaaaaccggcttagtgatcatcactcattgtggcccttggcccaacattgggaaagccaggagaggtttcaccctccgacttttcctctgaattcttaccattctagaaacagatttcctctaacttccgtaaggacacggatgcttaattacaaaaggttttgcccctgtagtgaccgggcagcaatgttatctgtccttcattcttgcatgtttttggaaattgcttttgcttttacttttggtcgtcatggcaatcacgtgccttctctggttcattttgcacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctggccttgcatcccaccactgtgtgtgttgttgaatttcccctttccgtctgcgggtcagtgaagtcatgggctgcttgtcctgtgctctctccccaggagaaaagccttacagatgctcatgggaagggtgtgagtggcgttttgcaagaagtgatgagttaaccaggcacttccgaaagcacaccggggccaagccttttaaatgctcccactgtgacaggtacgtgcctgaggacaatgctgggcaaggagcgtggggccttgggaatgtgatgaccagggttgagtaggtgtgcagggcacattcgaaggaaggcatgcagtttcctatgtgtgaacatttcttttcaagcctgggactttttagaaagtttctggtgtgctcattgtccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaacttcttctgtgcttctgatttgcccttgcaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagtggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccggaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggtttttttttttatctgggctgatgaatacatttacctaagaaactcatttcgttttacttaagaggggaagtgc

SEQ ID NO: 11929 - DNA, 92227 bp, Human
  misc_feature (1)...(92227): n = A,T,C or G
ggaggtggtgggcggtctctctgtacagagttgtggctttgtttctgatgagttgcagctgctgtgcataatgtagactagatcaaatggggcatggagaagagccattcacaggaccggagtgacggtgctcgctctgatggcagaatactaaattaatcatcttcacctaaacctgtgctttctcctggcctgtacctcagtgaatacctgcaagttgcttaggctgtaacttgaagtcagcctacaatcctctttgtctccagatcctgtccactttcctttccgaaggtctttcagatccatttccttctttccacctccactggcactgccctcattcagagtctcatcatgtcttcctggattgcagcttccttccaggtctctcagcctcaagtcttaggcctcccattcaattttccgtgttactgtcagaggaatttttctaaactagcttaaaacccgtctgtggttctccatggccttccagatcaaatgtgctccctgaagactggcctgtgagccccttcacaccagtaatcctgaccctgcatgcaattcccagaacacaaggcatttgttctcaaatcctgcggctttctttgcttgcttctcctcctgcctgggatccttcccatcctccatggtttctctcctcctttcctcctcctcaagttcagatatttccctcacctgtaccccctctgttgtagcatttatcacaaactacactgaatctcttgactgggcagaagaatgaattgtttcccagcatctagctttgacataaaagttgctcaataaatacttgacgaatgaatgaactctattaaagtagggttcagtcatagttcagggaaggggccctgaaatagctggctctgaaagaaggtaatgccggttattgcgattatgttgttagatgggtagaatttcgcattcgattaagggatagttttgggtttcttcaagctaaagaaactaaagcctataaaaggtgatttaaaagacctcttctctagacttgatgaaacgctgtaattgccatctttggctaacactgaggagttcaggaatgccaagcaagtgtttccagaaatgtcaaacctgctgttttaaaatatgtcattccagggcacagttaaatatacaacttgctccgatgaggtgggagaagtgggccggtgagctgtgaaatgaaatctgcctaatgagggtcgaggccagcacacacagggacctatttgcagtaaaacaacgtggggtgacgcctaagaaatagacaacattaacacaaagggagcctactacgtagcacatttccgctaggcataaaagagacacctttccagaaagcaactctaaaaatgaatgcaccgcctagtgaggtgcgagccttcctccccacgaggcgtcccgtgcaaccgcacgcggacagcggggctccagcggaggcggggtggatgcggagacaaggcgcctaggagactgggctaaggctttgagtgtccgaacgaagattctttcgaacctattgattttttctagtcttatgattctttcgaaccttttgattctttccattctcggttctaagcattaaagcgcagctgagaaaggcagcaacaaagatgggaagagaactagcaggagttctcagagaaaaatgggtgataatttaggggagaagccataaagaagagactaagcgagaagcggagcacacgcagaagacgaaacaaggaggaggagaagagaagaagaaccttggcgaaggaagagagtgaccaaactcgtcccggacgggaggagggcaggcccgcccagagggaatcggctgctttaagggaagccccgccccctggtggtgacgctccaccaggcccgtccgcgattggctgcggccagagggcgggatggggttgctaggcgaggaggggatccggcgggcccccgccgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcagaacaagtgagtgttgcctgccccctccccgtccgtgtgagcctccaagggccgaggctggttccggcacccagtaggcgctcagacaatgctggcataaggggtggcggtggtgaaggtgaagggagacaccctgtaacggggacagggcccaggccgcgtagcctcccgtcctgctaatcatcaaagaattgcctcctagaggctgtcatttgttcaagggatggctggaggggacactcctttctgacatttctggtccctattcttacaggggcatagaatatgagcgagaagagatcttaaggataacctaggtcagctcacacattttatagataagctgtcaatgttgttatcttatatcaaaagtgcctaatgttataggcgctgtgctaattttttctgtgactgcagtatctcactttattttggccacaacctgatgtcatagacaccatcagttttgcatacggggaaattgagggtcagattggttaactgatttacataggagtgtggctgggacttagaattaggcaatctgattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtatgttggtgtacccagttaaactttacaggaattgttcccactggcaagatgtgtgtgggctgcaataacacggaccatctctgtggaagaggtagagcttgagctatctccagagatgggcaggattttcagcaaaaaggagaggaataaaataagagggaactcactccagatggcatagtgtctgaagtgagcaggcatctcttccccttttctagcatcagcttttccccatttttgtatcttcataaggcttttgaagcaataactgatcattccatctggattaaaagaagatttctgagggactgctaagataaagaagtttccctgcgggacttggaatcatttcttctacaagatttcagtcatatatagaagatctagaaaattcttgagtgttaggacagttcctgagtcttttcgtcttctatcttttactttactcctcttgataagctctcttgtagatatataatttcacatagactttctgggaggatttttttttcttttaaatacgatcgtgtcatcacctctgaacatctgcgtaagaaatatgactttgacatacacttattgacagagctgtgatggccagggctttttggagatgatacaacaaatgcaccgtttgcattgcttaaatgtttaaaatgctctgtccttgcacctttaaaatgctgtgatccttgcagggatgtaaattctgtgcctggatttttcttttcagtattagttgtgctgtgaccaaatatgaaaataagctttttcttggtgcaagtcgccttgaggctatacagagtcattttggtctgtggctgtggactaccctaatcatatctgttcttcaaatatgtaactctcattaatcaaaagggaaagtaggtgatcatatatggtaaagagtacatccatcctaactcagtcttcaagaattcactcaaaatgcgtactctgtgctattaaccaataacaaaggacactgatatgtgaataaaattaaaaacacaagcacacacacaatttgatattgatgcctaaatatagtgtcaactttatggatgggatatttttaaatactcaaacattagtctgtatgggaaaactacctttttcagtgtattttgtgaggtaaaccatttgagtaatttcttgatatcctattcacccagctatattcgaattagatttttgttgttatttcgaatatgtaaaattttaaggcttaatttcctccagcttgggaaaatgaagtttattttctttgtttcactttatacttcatccaatggatgttgagacaaatacttaagaaaatatataaaaaaattaactttatcattcaaatgaagattttatagttgactcctatttttttatagttgaccgctatgcttctttaagtgaatatacctgcttaaattttcataggtaattagcatataaatgatatttgaatgtgtttgtgaaaagcattattacagtgttgagagtgggtgcagatgatttttttgggggcttatgtatacatatctatgattgtctgaatctttgaaatttagtttgtcagatatcaagttatcttaatttttttcaagttatctacagggttacctggatagcgtaatagagttaatttagagattaactgtttaatatttataaactcatttgtaatatctctaatatatttaccagctactttaaatcttatgcaaggaatgatatgtgatactgaagtcaagtatgagaaacatttcagagaattgatttgaatggaaaccataaagtacctgtcaaataagattggagttgatttgcaaagttgatttgacaaaaactcaaagcataatcttacagccattgtagtcactttctcttgaaatcttcattgtaagaatgacactggtactttcaaaactgtgtaattacagtaaggaaaatcgaagtgaattttattactcaagtagattgcaaatatttcattgttcaaaagtatttgattaggccattttgacaatatttctgagaagtgttggaagaaatgttgaacaaaatgagaaacagcattttgtagagaatcttggattttaaagttttacttaacatgtgtaattaaagtagcatgctttacttatttagaatatttaattatccattttattttactagaatatgaatgcccagagggtatttgtttgtttgtttcgctcacagatgtatctatccctggaatgtcctttgggatgtatctgtccctgaaacgtcatttggcaaatagttgacactcaagaaatgtttgttgccgaatggattacctgacctgccccagccttcttataactttcccagagtcagtgggggaaaaatacttaaaaattgttttagaattacaaaccagagagtaaattgttaataccttagctataggggagaggtggttagagtggagttagaaagttagaatatttacttagtttttgtttctgtatcattctattacccaaggactggcagtggaagtggggagtagaatgatagtttgtaaggcagtgtttccttaaacaggatgctagatacctccaaagaaatgaacatttgttgagcaggggctataaagtagtctttatgccagattatgtttcatgtgtgttatcttaattttcatgacaactctgggaaatgggtagcattaatccccattttacaaatgaaaggaaaactgaggttcagcgaatttaaaggcagtaacttctcctgattatgttatattactggtgagcaacagatctgggagacggaatgttcttacccaaatttgtctccaaagcctgtgccattgccactacaccaaatggcattcttctctggtgtctggaagggtgctaattataattatattagtttttagctagtttcttttcatggtctatgctagtgtttaatcagtgtccttattggcaaagatctgtcttctgatgaacagattttgtgttacaagtaattttcattgtttgatcttctctgggataatactactcatcatgcttaaaatagtctttcaaattagacatgataggtttacttttttttcaagcatatagaaaaatcttatatatcaaccccctttagaatttctgtaggtcagttaatttcaacaacagaaaggcagaagcaagaaaatcctatttagaatggaaaaagaaaagtatttaatctctactgatagtaatggtttaagctgttatataagggaaagatgcttaaataggactttagcattttttttgcctttaggttttagcttttaccataaaaggaattcttcagtatttctatatagataagtttgaccaaattgtaaattggttcacttaaaagtagaagcattaaaaaaaatgtttcttttacaggagcagccttgcctccatgtcaatttatttttttaatggcccaatcagaaacattgggccttgaaagagctgcttctacagtgatgtattggaggactagtctttgacatggtgtattgtttttctctgtaagcagctcactgaatcaggttgttttctttgtttgtttttttcctgaatcttctcaactatggcttctctcttgaaaatgtgaatttagtatattgtgaaactggagtgaaacacaaaatatccttttaaaaattagacttcctatcttaaaaattctctttggacggtaaatgtaaaaagcataaaagttattaacctaacatatatgcaatgaatatttatatataccagccatattttctgtggaatttacgtattatgaaatacaagtcgtagactgaactatatgaaattgtcatttttttaggtcaaaaaaatgggtgagggccaggcatagtggctcatgcctctaatcccagcattttgggaggcctggcaacatggcgagaccccatcactaccaaaaagaaaagggtgaatattggcaagctcaaagctcatatagttcaacctaatacatgaatttagaattccctaaataagacatttcctgaaatattaatttatactgtgttatccagctattttttcaatgaaggaaaactctttaaagttagtttaggttaacctgaattgttaaaggtgtttgaaatcttaaattgataatactttctttccattttctttttttgttgttgttagtctccttataacagataacagctgatagagttgttttctaggtctccaagagagatattggagtttatttctaaaagattttgtggaatttttttaatgcatggtgttttgtgtccttttttagtgatacgtgatttggttgtattttcaaaggtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtatgcaaagcattgagtttgctacattttcccccttgttcgttgaattttgttatgtgtattctgagcaaaaaagaagaaactctgtagaaatctaactttaaaagatatttatttttattttgaaaatttcaaatctacagcaaaattgaaggactacatgaagacctatctgtccttcatttaaattcaccactgttatcttatcccagatggcttgcctctccctctctctttttcactctctacatgcacgtgtatgtgcatgcacacacacacacacacacacacaaatcacacaatttttttgccaaaccatccaaaagtaggttgcagatttcacaacactttacctataagttcctcagcatgtatttcccaagtacagggacattttcctgtttaactatatactattaccataactgagaaatcaatgataatttaatattatcataccacatgccatccgtaactcagatttcccccattatgtccaaagtagccttggtagcccctttttatccagatctagtatccaatcaaagttcaagcattgcagttggctcttgtaaagagaccgtgctaatagtcctatggaaaaattccataatctagattgtcactttcttcatggtaagattaggtcaggtttcccagcaagactattatatagatcatgttgcgcattatatcaggagacccataacgtcaagctgcaagtggccaagttggacagcttggttaacatgatgaccaccagcaaccaggtctctccatttaaatttaaaatgtatatattttttaagagatagggtctcactctgttacccaggctgcagtgcaatagtacaatcatagctcactgtaatcacaagctcctgggcgcaagcaatactcctgcctcaatctcctgagtagctggaactatagatgtgtgccaccatgctagctaatttttaaattttttgtagagatggggtatcgctgtgttgccgaggctgatctcaaactcctgacctcaagggatcctcttacctcaaactcccaaagtgctgggattatagatgtgagccacttcacccagcccagatctctccattttacataaaggcacattttccttttgtattttaatctgtgaggtgatcatggaatgctgttttttttatttttattgtggtaaaacatacatatatatatacataacatgaaatttgacagtttaactgtttaaacatttttaagtgtagagctcagtggtactaattttcacaatgttgtgcaaccatcaccactatttctaaaacttgttcatcatcccaaacagaaactcggtaggcattaaataataattcccacttccatctctatcccttacccccagccattggtaacctctaatctactttctatctctgtgaatttgcccattttagatattttatataactggagttatacaatattcttccttttgcatcaggcttatttttcttaacataatattcttaagggtgatccattttgttgcaggtatcagaactttattcatttttatagctgaataatattccttgaatgtatatgttagtaatacattttgtttatccatctattgatgagcactgggttgtttccaccttggctactaggaataatgcgtaatgaacgttggcgttcaggtatctgtatgagtccttattttcaattcgtctggatatatacccaggagtagaattgctgggtcaaatggtaattctatgtttagctttgacagactattttccacagtagatataccatttacattcccaccagcaatatataagaattccaatttcttatgaaatgttattttttaaagaattgtttgttgttgttgttgttgttttcagatggaatttcactcttgttgcccaggctggagtatagtggcatgatcttggctcactgtaacctccgcctcctggcttcaagtgattctccagcctcagcctcccaagtagctgggattacaggtgcctgccaccaggcccagctaattttttgtatttttagtagagatagggttccatcatgttggccaggctggtctcgaactcctgacctcgagtgatctacctgtctcagcctcccaaagtgctggaattatgtatgagccaccgtgcctggcaagaattgttaatacaagcttgaactgtttaccttttctctttaaatgctatgaaaacagctattactctttttaaactttaggtatgctttgaataataacgtttttgtttttatgcacagatgtagatgtagagggaacttagaaggaataagtcaaccaatggaaatgtcatcagtgtaaattttttcttttctaggagtctgcccatgatgaaatgccttaggtcttccttacctttttattggcagtcacattataaagtgtcttatgacatgtctcttaatgtatatttaaacctttgaattactcttttactttttatatcaagccatatgtacccaaaatgggtcataagtttgagaacttaatactttcgttactggatctttggggtattgcttttctggttggaaacctctgtgcctggtggtgcctttgcccaagttcttgtcctgcatccaggaagaatgaggtatgcagacaagtggagggtgagcaagacaaagaggagctttattgagctcagaggagaccggcagtgggcatctcctctctgtaggcaggtcacccagtcaagtgttcagccctcagcacaaaggaaccctggagtgggtggcccctctctacaggcaggtcatcctgatgagtgttcagcttcagctttcagcagagaggagctaccctctggttgtcccatcatctctccatcctctgccttgctctgactgagcccagggcttttatggacctcagaggagaggaagtgtatgccgattggttcatgggcgccacgggcagcctggaaaaggcacaagtccccactccagtctatgggactggcagcctggcccccagccttcaggacctccctggcctgaaggtggggcctcaccagggaccccctcccttatacccaggagctagtctgcctcttgctgctttccatggcaccccggctgctcgtgctaaggggcacctgcaagccagtgctgagtcgccctcagtccccaaccttggttccctcttccatgcttgtcagtgcccagtccggtgggggcccaggcaacagggcccaagcatgtgcgtacccctccgggcagtgacagtgcgccgcctcagctccaaccccaatcccggataggagcagacgcaagaatggggagaggccaggcagcaggagcaggcatctccaagcctgcaagggtaaggggggcctaggaggtcgggggacgcagctgctgccagctcccagctcccgccgactcagtggagcatgcagccccagccgtgccccctgggagcctgtggcgggtggctcctaatcctcgctgggcctgggccagtgtctgggccaggggcgacattgccacaagcttccctgttgccctggggctaaggagtggcccggagctgattgcgggcctggggccaggctgtcaggagtgtcaggctgggaggtcaccccacgtgtggcggacactggggacttggccccaagtggcccgcgcagagcctcctcccgagcccaggaacccgggacccttagtggggtgggcgcagtggctgcacttctggccagatccccaaagctggagcagctcctgctttccgccccgcccccgaagcacagccccagctccgcataggggttcctctctgcctgactacattactcccccgctgtgctgctctgggcctgaccccattacggcagcccccagggcagcgggctctggggggtggcagcgggctgtggggggtggctgcagaaggggtggctgtccgcctccttcccgcaccttccggcctgctgctgctatcactttctagaattttctgatcctcctatagtttctaccagtgtttcttgtatatcagaagcattcaaaaagaggtttgacatactatttagaagtgaaaccttctccccataacaattagaggtgatttgaaaatcattaaaaatttttttgtagataatggacttactttaatgtgtaatttttacatttcagtccttgggaaatatatttaataaaacctaactttgaactggtggttttgtaatctagtcaagttgcttcattaatttgagatgatgttacttaaaataatggggtaaatacttaactttgcctttttggaaaaagttgtaaaaggttagaaagtaatttctaactgacaattaattgaggaaggtaaatgtatctcatactgcttaaaaaataaatatccggcctctacaaaacgtaggtgtactttggtattaaggccagagattatttggtgaagctagttatcatcagatttttctgattattcagacatctgaagaagctacattatgctgctgtcatttttattttcatgagcatcaacttttctcttgtttcagctgaatgtcggatatgtcctatgttatttctacaataactggcttatttctcttcgtacctcagcaaatattgagcagtttccccttgaagaggaggctgtgatggttttagtttcaacagggtgaattcattgtgtttagtgagtaagatgttgtgaaaccttgtgactaggcatatattcaaaaaacccggatgtcctggagtaattttttttttttttttgagacagagtcttgctgtgttgcccaggctggagtgcaggcgtgatctcagctcactgcaacctctgcctcctgggttcagatgattcccgtgcctcagcctcttgagcagctgggattgcaggtgtgtgccaccatgctggctaattttttgtattttaagtagagacagggttttaccatgttgaccaggctggtcttgaattcctggcctcaagtgatctgcccaccttggcctcccaaagtgctgggattataaacgggagccacatgctcagccgagtaattttactgatgttctatgtgatatatttaggaattctagcttaaagaagtatagacctttagagctgaaagtgaatatattgatttagtccaacccttttgttttagagaaaatcaaggcctgagagaggaactaacttgtgcaatataatgtattaatatagcaaatatttactgagttcctgccgtgccacatatactgtattaggtgatgtaccggtatacagtgagagcaaaacagaaacaactcctgctctgaggaatcagatagtatattagtagtgtggaatctggggtgatttgggccctagtgcctttgccttcattgccagggctggcccagcatatctagctgcctatgtgggtgagccttgcttcactcaacatgtctcacaaacctcaggatccatttaggaaatggctatcctaataaggctgatgaatagccacatccccttccaaagcctcgttattgtgagacctactctggacttgttcatggagtaagatgcctttttttttttttgagatggagtttcgctcttgttgcccagggtggagtgcaatggcacaatctcagctcactgcaacctctgcctcttgggttcaagcgattctagtgcctcagtctcctgagtagctgaggttacgggcatgtaccaccatgcccggctaatttttgtatttttagtagaaacagggttttaccatgttggtcaagctggtcttgaattccagacctcaagtgatccacctgcctcgccctcccaaagtgctgggattacaggcctgagctaccgtgcctggccgccttttttttttttttttttttaatcacagtgcgctgatttgtatgccatttgcctaccgttctttcttcacagttttgaagacattgtaaaaatcatatgatgttttggtatgtttattccaaagcagatttaataaaaactgaactgtagttttaggtcaacttttaagccatggcgtgtgcttgtagtcgcagatacttgggaggccaaggcgggaggatcttgagttcaagcccagcctgggcaaaataatgagaccctgtctccaagaaaacaaacagacaaaaaagaattgccttctttcaaattatacaatttaaggaagggcaggcaacgtatagttgaaattatttgatcaaagatcatagttttatgtaacttttagaagttttcttgggcagaacattgttatattttattttcttgcagatagaagaacagtagaaggcagtgcaatgtagtggcaaagagagagctttggaatcccgttgccttaggttggaatcacaactctgccttgactagctgtgtgcgtgtgtgtgtgtggtgtgggtgagagacaaattaatgaatttctctaagcctcaattcccacttatataaaattaagataaatactatctactcacaagattaggaggctcaagtgagaatgtgtgtaaagcactttagcctagcatctggtgccatggctacttatatctactagagtttaaacttactcttgaagatagggactttgttttattccattttctatttctagcacacacaaccatgcctggtatatataaggtaaataatagtctttttggaataaatgaatttttgccatccgaaacataaatacatagttatttgatctttggataatcttttttttttttttttttggagacaaagtctcactctgtcacccaggccggagtgaagtggcgcaatctcggctcactgcagcctctgcctcccaggttccagcgattctcctgcctcagcctcccagttagctggtgttacaagcatgcaccactacgcctggctaatttttgtatttttagtagagacggggtttcaccatgttgaccaggctggtctcgaactcctgacctcaggtgatctgctcgcctcggcctcccaaagtgctaggattacaggcatgagccactgcgcccggcctaaaatcttagatctttagttaatcttataacaatttataaaaatattcttcctagttttgctcctactctgagtaaataagcttgccttactggtagatcctagatcagtattatttgaacttttttttcttacttttaacctataatatgaaataccttttagttgtgtatgtacatttcatatatatgtgtgtacattaaaaaatttcatggaacaatacttttactatacattctggtattatttcttttagtttgttctatatcattctttaaaaaatatgtctgaacccactaatatatctcacaacccactaatgcatgatgaccttcagtttgaaaaaacactattcttgatcaccctgtggtagaattcatttattttcaaattctaagtaggaacaaaacaccttacaagttgtgtgtgataacttattatttgggtttttcctcccaacttgtttatatgtttcagttatttgcagtgaggactgggccacagatatttatctcagatgttctacttttagattgctttccctaaaatacgaatgagtgttgagttaggaaattggtcagaaatatagttgtcaggcctatgtattgctcatgtgagtctatggattctattattagttaggacagctgccataaagctttatatttgtcttcttaagccactataaacttgaggctgagccttttcaaactagtaattatgattgttttctcctctggaagaagaataaactgttctttggatttatcaaattttcttccctctccttttatacaatggacagagttatgaaatgtggccagaaagcatataatgtaaccaattcagttttttgtgtgaatatcaactccttttatcatgcagacaactattctttccccaaactggaggtcagactgagcagtagcagtgtgctttaaatattgaagtatgtttggctggaagtagattgttgatggaaaaggaagagcatggggaaaataattacccacctgttttcaacaatgctgttgaaagtttagatttggtccagaaatggaccagaaagcttatttttgaggagtattttctgtgtcattaaataggatattatgaattaacccagtaacaccagaaaattgtaatctaaaacaaaaaggaataagatgaacagtatgtaactataaaaatacaatatctgatattaagaaacagacaaatccataaatatagtaggaagtttaaaataggcctctttcagaactagtaggtcatagagatcataactgttagatcacaaaaatgtgagtaaggatacagtggatttgaataacataaataaaccaatctgacctaatgaacgcgtacagaatactgtccttatatctaattttcctgcagagtctgtttactaatttgaggtgtggatgactaagaaaccagctgtcacgcttagggaagatgcatctggttctgttagcgcttgtgttactttgtttttaagattatatattaaaaactaaacaacaaagatacacaggtaaaataggcccaggagcagtggagcacacttgtaatcccagcactttgggaggctgaagtaggaggattgcttgaggccaggagtttaagacctgggcaactggtgagacctcatctcttaaaaaatacaaaaattagtggggcatggtgatgcacccctgtagtcccagctacttgggaggctgaggggctgaggcagcaagatagtttgagctcaggaatgtgaggctgcagtgagctatgattgcaccactgcactccagccttttttttttttttttttttttttttttgacaggggaagacccgtgtcaaaaaaaaaagaaaaaaaaaagcttataatacagggttcataggatcaagtctaatacttcttagcatgggagcgaagatcccacagtctgactcaagcctataagtttagcctcagctcctacctctcctctgccaccggactacttgtccttcccaaatgtgaaccttcacatgttaggctatcctctgtctgaagtgcttttcaccagtttagctgtaacctcttctgaaacctctcctataataactgtcactatcctaccttcgagagctttttgtttatacagtaccatcagtataatacttatccacttatgttgttaatagtttttttgtttcctgttagtgtgtgaattctttgatgataaggacagtgtagtgctattcgttttggagttatctttgtgcaaaatgtattggcaggaaagagtcctagaggagggaaaactagagaggtgtttacagtcatctgggatgaggtctctttggagataagggctttacctagagggcatgtaggggaatgaaaagggagtataagatacatatataagaagttatgcaagaagaactgcagaattgaccatcgtttaaatagcagaacagaatgtcaaagagaggatgtcaaagatatgactttgaggattttgagcttggattagaaaaaatgggagtgggaaaaactaattggatggtggggattgggagacagcaagcgagtgagcatgtgtgtatgtgtgtgtgtgtgtgtgtgtgtgtgtgttcgttcaggtgaaagaggagtgaaaactggaaatattaatagtacttgatgtactagtcacaagtacccaatgggcagttagggaataggttctagagcttgggagagaggtcaagatgagaaagagatttagaagttttgagacatttggaaagcatatggcagtgtagatgattttgaaaattgaattaatagtgttttctggcataatttaattgcgtggagctagaagttcaaccagaacatatatataaatgaacagatgggtgctttttttttttttttttttttacctctaaagtgaatgcatttcgtactgggatgttttccttaaggaatgccaacaattcagatattaattctcagcctgatcatattttaaaggtacagttgataatcaaatgtgcattagtaaagtgcttttggtcttacctgatcttgcacattaaagacctggttgaggctttttcttccctttattttctcttttaaaatctgagtgctgcctaatttaaaaggaaagcaaaaaggtaaaacaatactccaaaacagaatatttgcttggagtcacgagttggctttagtaaattgaagcataacctagtataaagactgacctttaggagcagtgcagttgtgtactttgtaacgtgataataggcctaaatgaagagaacctaacactcctttaggatttggcccccagtctttagatctaatgtgtataaattggatgtacttttttcttttccttttttcctgtttaactcaggtggtagagaatgggagagtatatttaaaaaaaaaaaaaaggaaaatacagttcaaagagctatgtgggagacagtgttaaccaagttagacaaaaatgaaaacagatgtaggactgtgtaatttagtttaactctgtagaatcatatcattagcaaatatatattcagtgggagtggtgaaggaaatagattttcacaagataggttgctcagaatacaaagaccaggttcagttagttaagatttgatcaatgtgaacttgaatttaaaaattaggaatttggggaatttttttaagagcaacctctgatttttccattgatttggcccagattttccacctaaaatttttttacaaacgttatgctcattagcttttaaaaatatctcagaaagtacaaaattatcacttaataactcacttattgcctataaaaaattgttcaggaaattcaaagtcgtgagagaatttctcactatccttcaaagtagttttaataaagtaatatcattaagctccaagttgaaatatagggtagaaattgtctgtctatattcctagactttaaaatgcttttcctatttaaaaaaacacattgtagtttccttgtaaaagattaatagggttcttgtgtaatgcagtttgacactttatagttggcctgcagaggcaagtaaaaaaaaaaacaaaaaaaacttgctatgtttcttaacactgaagcattggctgtattttttcttttggctttctgtttgagacagaagagtgaatctttagtatctttgaatgaaggattgaatttattaatctcccctccccttaaaagctagatctttctgtggtgaaaagagtgataagagacttgtttcctaatcaagacggattgagtatcttaaaacatatgaagattagttgtgctacaaatcgattgaaagagtttaatgggtacgagtagatcacttgatcagaagatttagctatccgtaacaattagcattggtattgatcacaatttgcagtattactagacagattcctaatggttacactttgagtcttgttctttgatactggtaaatgaatggtaggtttctttctttcctttcctttcctttcatttcctcttcctttctttccttctttccttcctctctctctctctctcttaatttttagatctcagttttcatacgtattctttcctaaaattaatctgcctgagaaagatacttgctgtggaggttctatctcatattctcttctcccaattgactgaagacaggcatacttttctacccacctgaatcacattatggtgtattgccttggagttttacaaacttccagggcactaaaacaaaaggaacaatttggtgattactttaatggttaaacagtaccataagagcatcacccccaatttttctttgaaagatgtattttcagtaattatttcttatatttactattttattatttaccaaaatttgtaaaaaaaactatgcctttttgataaattgtgtgctagtgactattgtaataattcaatttagaggacacagaattaatacttagagcattacagtcattggaaattaagaaaaatttaaatacactaacatactatagattgaaaaattatagaatgattggtgaaagactttcaagcatgcaggtatatcacattcaaatagcattctgtggaggaagtagaatggaaaaaaagttcaaagagaaaaagagaagatgtggctgggtatggtggctcaggcctatgatcctggcactttgggaggccgatgcagaaggattagttgagctgaggacttcaagaccagcctgagcaacatagtgagatatgtctctacaaaaagtaaaaataaaaaaattagccaggcatggtggtgcacatctgcagtccagtctactcaggaggctaaggtgggaggatcacttgagcctggagggcaaggctgcagtgagctgtgactacgccactgcactgcagcttgggtgacagagcaagactcctgtctcaaaaaaaaaaaaaaaaaaaaaaaaagaagatataaaattccttaaagaggcatgttcaggcaacttttaaatagatatttctagaaatcaaatctctggcatttttatttggatatatttaaaataataatataaaagttttatttaaaaaaaactggtcatggtgcagtggttcacacagtataattccagcactttaagaggccaaggtgggaggattgcttgtgcccaggagttcgagaccagcctgggcaaaatagtgagacactgtctctacaaaaaaaaaaaaagagaaaaatttacattatgcaggatattcctttgtttacaactatttaaacttaagatgaaaacttgtgaataccaacttaaaaatttgtgaagcgtcgcatattttttcagttattttagtattaacaaacaaattgaagatcattggtttatataaccccctgagagactaatagtagaatagaacagaataatagaatagaatagaatagaataatagaatagaataataatagaataatagaaactcgcttatttatgattgttaataagtaggataaattgcagatcatttatactattaaagtgctttattgctttgaggtgtgcctgtaactgaatgttttacttccaaaattaaaattttctttggctgaataaagatattctgaaacctgacatttctcctttaatctttgttgagccaaatgacatatcaacttaaaaagataagcaaatatattaactgaatctggcagtagctgcagctgttattaatgtcaggcctatctacagatcagtggctgctccctgttagggtgaactctagctttgggtaagtaggttttgtgttgagaaaaaaaaaattaagacaacaaacctgaaccagctacttagttaggattacttattatacagtctttgacatttggtttcagaaaaataaatgttaagtttaacatagatggcaaataatgcctatctgtgacatctcacaaaaaattcttgaattattcataacttaatgtccccatttggttccatgttttaaaataattaaaaaaataaatttaaaaataattttaaaaataaaaaaaatttttttaaataattaaaaaaaaattcctaaaccaaaacttgaagttgatgaataaagacgttttgatattctaatgctaggatagtttatctttttgtcttatgaaataaaaattagtttgctactcttcagacatttatgagtttgaagaagataaaggtagacatcacaactcattaattgccttctgaaaacagttcattattatagactcagaggaaacgtgctttacttttatgagattgtatcaagacagagataaatattttataatatatttatgttattgatttcaatataataacatcgtggtcagagaacaccctttgtatgtaagtttgacctaggtcaaacttaaatcatacaaagtttgacctaggatatggtcagacttggtgcatgttccatttgtacttgaaaagcatgtgtattctgccattgttgggtggggtatagtataaatatcatttatagatctagttagttgatagtattattacatttttctctatcctttgctgattgtcttttctgctgattactgagagaagaatgttgaaatgtgcaaccaaaattgtggatttacccatttttccttttagttctataaatttttgttttatatatttcaaaattctgattgttgcatgcacatctagaattatgtcgttttggtgaatctacacttttatcgttatgtaatgtccctctttatctctggcatttttccttgctctgaagtctattttacctgatagtcatatagctactccatcttttgatttgtgtgtgtatggtgtatttttttcctttcttttaacttacctataccattatatttaaagtgagtttctgacctggtgcggtggctcatgcctgtaatcccagcacttttggaggctgaggcaggtggatcacttgaggtcaggagttcgagaccagcctggccaaaatggtgaaaccccatctctaataaaaatacaaaaattagctgggcatggtggcaggcacctgtaatcccagctactcgagaggctgaggcaagagaatgcttaggaaaccgggaggcagaggttacagtgagccgagattgtaccactgcactccaacctgggtaatacagcgagactctgtctcaaaaaataaataaataaataataagtaaataaattgtgtttcttgtagttgcatagagttgggccttgttttttaatgagttttacaattcctgtcttttagttggtgtgtttgcaccatttacactgaatataattattgttatgtttggatttaggtctactttctcatttttcagtttgcctctctcattttaatcccactgcttcctttttcctgccttctattggattgtgttttcaacgatatcttttagttgctctagtaaatacaagttactacttaacttttcacagttctacctaaaattaatattttacttcaagaggaatgtacgaacctacccaccataccctttatcctccccttttatgttgtacttaacttatatatatatgctgcactgaaaaccctactagacaatgttataatttttactttcaactgtcatacacagtctaagggacttaaggggagaaaaatagctgattgtatttaccatttctgttgcttttcattcattcctgaagttctaagtttctctgtggtataacttctcttctgcctgaagagccttctttagcatttcttttaaagcaagtatgcttataatggattatcttagttttccatctctgagaatgtgtattttgccatcattctttttttttttttttttttttttttttgagatggagtcttactctgttgcccaggctggagtgcatggcgcgatctcagctcaccgcaagctttgcctcctgggttcactccattctcctgcctcagcctcctgagtagctgggactacaggcgcctaccaccacgcccggttaatttttttttttttttttttgtattttgtatttttagtggagatggggtttcaccatgttagccaagatagtcttgatctcctgacctcgtgatccgcccgtctcggcctcccagagtgctgggattacaggcgtgagccactgcacccggccttgccatccttcttgaaggacatttttattggatataaaactcggggttgtggattgtagtttgttgtttttgctgtttgttttttagagtgctttaataattttgtgccattgccttctggcctccatggcttctgctgagaaattcagtcatttgaatttttcttcccctttatacgcacatcatttttctatggccactttcaagactattttattgctgctgctgctgctgcttctgcttctgcttcttctgcttctgctgctgcttcttctccttctccttctcctcctccttcttccttctcctcctctttctcctcttactcctcttcctcttcctcctcttcttcctcttcctcttcttcctcctcttcctcttcttcctcctcttcctcttcttcctcctcttcctcttcttcctcctcctcttcttcctcttcctcctcttcctcttcttcttcctcatcttcttcttcttcttcctcttcttcttcttcttcctcttcctgttattattattgtgagacagagtttggctgtgtttcccaggctggagtgcagtggtgcggtcgtggctcactgcaacctctgcctcccaggctcaagctattttcttgcctcagcctcctaagcagccgggactacaggcacgtgtcacaacacctggcttatttttttgtattttttgtagagacaggttttcaacatgttgccccagctggtctcaaactcctgggctcaagggatccgcctgcctcggtctcccaaaatgttgagattacaggcatgagccattgtgcccagctgactttttttctgtctttggttttcagcagtttgattataaaatacccatgcatggatttttttgcacttatagtgtttgagatttgctgagcttcttgaaatgtaagtttttgtcttttgccaaatttatggtgtttctagccattatttcactttttttttttttttaaatagcatggcgccatttttttttctctcctgagactccagtgataacaatagtaggccttttgctattgttcttaaaattttttcttcttttttttcagatctttttttcttctttctctgttattcataaggcaatttctacttacccatcttcaagataactcactttttcctatcatttccattcttccattaaacccattcagtttatttttttaatttagttactgtatttttctgaaattctgaaatttctacttttttctattttgcatgtttggtatctttcttttactttaagactgtttaatcttacttccttggaaggctgggcgtggtggttcacacctgtaatctcagcaattcgggaggccaaggtgggtggattacttgaggtccagagtttgagaccagcctggccaacatggtgaaaccctgtctctactaaaaatacaaaaattagctggacatggtggcacatgcctgtaatctcagctactcagaaggctgagggacgagaattgcttgaacctgagaggcagaggttgcagtgaactgagatcgtgccactgcactcaagcctgggtgacagagcgagactctgtctcaaaaaaaccaaaccaaaacaaaacgaaaaccttaattccttgtaacatggttataataactgctttaaggttagtctggtaattccagcatctgtgtcacattggagttggtgtctgttgactttttttctttataatatattgagcttttactggttatttgaatgtcaaataattttggattatatcctggacattttgaatcttatgctatgagatctgggtcttgtttaaatcctattaaaacataatacttgttggctgggtgtggtggctcacacctataatcccagcactttgagaggccgaggcgggcagatcacctgaggtcaagaattcaagaccagcctaaccaacatggagaaaccctgtctctactaaaaatacaaaattagctgggcatggtggcacatgcttgtaatcacagctactcaggaggctgaggcaggagaatcgctttaacctgggaggtggaggttgcggtgagcagagatagtgccattgcactccagactgggcaacaagaatgaaactccatctcaaaaaaataaaataaaataaaaataataatacttgtctgtttgtgccatcagggaatgacccagttaggttcagctgcaagttttgactcgccttatgtaagctgtaattccaatgtcagttcagttttcaaagcctttatagtgctattcagatctgtactgtatgtgcaccactcaggggccagtctgggtgctgggcagtaacctgttttgtagttcagttctcagtgcttttggtgtgctgtttaaggtcagacctgtacatgtgcagtttagagatgatcccaggtggtcacaggcaattttatgagatccctttctcacattccctcatatctgccatctcactaaagtctctgtcttccagggtctccagtatagaagataaataaagacatgaaagatctcctttcatgggaaagaaaggatgtgcaatatcatttgttatcagtgaaatacaaattaaaaccacaattagataccactcgtcttccactagaatgcttaaaatttaagagactttccagtggcatgagcaacttgttaggtgatgatgcagaataactaaaacatggatacattgctggtggtaatatgaatatggtacaaccactttagaaaacaatttcttacaaagttaaacttactataagatccctccatgccacctctagatatttacccaaaagataggaaaacatatgcccacattaagatctatgcacagctttaatcaccaaaaaacaagaaacaactgaaataaccatcacatgatgaacagataagcaaattgaactacttttattcaatagaatacttagtaatgtaatggaccatttatatatgaagaatatagatgagtctcaaaagcattatgctaagtgaaagaagcctaatacaaaaggctatatactatatgattttatttatatgacattctagagaaggcagaaatatagggaaagaaattagattaatggtaacccagggtctgggaaccttctgggatatagaaatgttctgtatttttattgtggtggtagttatgtgactgtatacattgcactgtacatgtaaatgggatgaattttatagcatataagttattatacctccataaacttgacttttaaaaaagctttaaagcaccgtgttaactagattgtcaaaattcttttgaatcatttacttaatacttaagtgaaaggaaattatttaagaacctctgtatgcttcaaagaagaataaaattcaaagtatcatgcaaaaatatttgccttgtatatgccgttttataaccttttttgatgcatggtaaatatcgtgacaataaatatatgcctgcagtaatttaaatggctgcatagtagcccattttatatcataatttactaaactggtctttcatttttgaacatttagattgcttccagttttatgctctttcaatttgaatactatagccctcatccttatagctattatcttggaataaatttctagaaaaggaatttctggttgaggtcatacctattttaaagattttatattcatattactaaattttcacccagaaatgttctataatcctttgtcatctcttttttttctttctttttaatgaaagacacttcatctttcattttctttaaaatttctgatggcagctttttggccaacagatattttactagctttttggtagttgaatctgttaggtagttaaatcttttaggtagttaaatctattcatctattattcctctcatggttttatactactttgttgtcatacttagaagggctttcctcattctgagagagtaaaaacatttatgttggcttctggtttcattaatggcttcatttttatgttaaattccatatggattaaagagtttacttggtatgatactgtaaaccaaaaagtatctgtctctaagatgggtctcaatcaatttagaagtttattttgccaaggttaaggacatgcccggaagacataaatacagtcacagaaaccgtctgtggtctttccctttctccaaagatgacttttgagggcttcaatatttaaaggggaaaagtgagctggaggggaaagagtaaaggtcatccacatagtgcaagagaaaaggagcagttgggggaatagtcaattatgtattcatctcatgctcagtaaatgggcacttttcatgagataaggtgaacatgaaagagctacctgtggagatatttacccctttatctgtagctatctgcttaggaacaaaaggaaaggcagcttcttgcatgactcagctttcagcttaatttttttcttttggcatagtgaattgagtgaatttggcatacctttcacaatatgatgtaaaactccaccagtattttttgccacctagttaacctagtcaaccacttttaaccatgtaagagttactaattttttcccccattggttttaaataccttgatcatattccaaatgcttttgtttcagttactgtgatttctatgttgttccgttggtctctttatttttatacctgaagtgaactgctttagtaagtgtagttttattatatgtattttagtaatatggcaatgcaggtcccctcttaaaccactcttattttttaattttttgggagatattctcagccatttctcagaaattctcacaaagttactggtacagtttaacttctaaatcattatgtccagttgcaacaaaaaaatctatgttttcataatatttataaattaatttggggaaatttgatatttttataagcctcttatctagaggcataatacactttactaaaatctcctacatccctcagtagcattttataatattgatttatattatgcattttattatacttcatcctatacattttgtgatttcgttgctggaaactttttaaaaattatatttgctgattattgctgaaatacagtaaaaaatattgatttttatattgtttttaagtagtcatctttttatttccagtgtcattttacatgactttttatttaacttaaatatggtcttatcaaagaaaaatttggggactgtatgtcaggattcaactaatattttctatttccattagattttacactgtgaagctaatattaaaatcagtctataagacctaaaataaaagaggcttgtctccatgaatctgacttttagtaattgtttgtagagatatatattaaaaagtcaatatttatattatatgctctgtcaaactaaggatgctaaatgtattttcttctcttggaattaagtcttattttaaaatgatttctgtccttcctccctacttgctacctgggggatatatttgtatgtgtcattagatggaattcacaagttatggtccaattaaagttacctttaaaaacctgattaggtaacactctaaaatgttactgtaaacttgatcttcttgctgggtcttagctagtatttcttaaattgctgctaaaataggacaattaagggatagacaaaagaatgctaggactcaagcctggggattatagtgttactctacgtcattgccttctagcataatgaaagtgtgagttggccatgtttgcaaattaacacagctattaaattttacatatgcaaaaaaacccttagattagtttacatttatatggccctgaaattgttattattattttttcttttttattatactttaagttctagggtacatgtgcataatgtgcaggtttgttacataggtatacatgtgtcatgttggtttgctgcacccatcagcttatcatttacattaggtatttctcctaatgctatccctcccccagtaccccacccgcctacaggtcctggtgtatgatgttccctgccctgtgtccatgtgttctcattgttcaattcccacctatgagtgagaacatacggtgtttggttttctgtccttgtgatagtttgctgagaatgtggtagtttccagcttcatctatgtccctgcaaaggacatgaactcattcttttttatggctgcattgtattccatggtgtatatgtgcacattttcttaatccagtctatcattgatggacacttgggttggttccaagtctttgctattgtgaatagtgccgcaataaacatacatgtgcatgtgtctttatagtagcatgatttataatcctttgggtatatacccagtaataggatcgctgggtcaaatgttatttctagttctagatccttgaggaatcgccacactgacttccacaatggttgaactaatttacactcccaccaacagtgtaaaagctttccagtttctctacatcgtctccagtatctattgtttcctgactttttaatgatcgccattctaactggcatgaaatggtatctcattgtggttttgatttgcgtttctctgatgaccagtgatgatgagcattttttcctgtgtctgttggctgcataaatgtcttcttttgagaagtgtctgttcctttcctttgcccactttttgatggggttgtttgtttttttcttgtaaatttgtttaagttctttatagattctggatattagccctttgtcagatgggcagattgcaaaaattttctcccattctgtaggttgcctgttcactctgatggtagtttcttttgctgtgcagaagctctttagtttagttagatcccatttgtctattttggcttttgttgccattgcttttggtgttttagtcatgaagtctttgtccatgcctatgtcctcaatggtattgcctagattttcttctagggtttttatgcttttaggtcgtacgtttaattctttaaaacatcttgagttaatttttgtatgaggtgtaaggaagggatccagtttcagcttcctacatatggctacccacttttcccagcaccatttattgaatagggaatcctttgcccatttcttgtttttgtcaggtttgtcaaatatcagatggttgtagatgtgtggtgttatttctaaggcctctgttctgttctgtatctgttttggtaccagtactatgctattttggtgactgtagccttgtagtatagtttgaagtcaggtagcatgatgcctccagctttgttctttttgcttaggattgtcttggctatgcaggctcttatttggttccatatgaagtttaaagtagttttttccaattctgtgaagaaagtaattggtagcttgatggggatggcattgaatctataaatgaccttgggcagtatggccattttcacgatattgattcttcctatccatgagcatggaatgttcttccatttgtttgtgtcttcttttatttcattgagcagtggtttgtagttctccttgaaaaggtctttcacatcccttgtaagttgtattcctaggtattttattctctttgtagcaattgtgaatgggagttcactcatgatttggctctctgtatgtctgttattggtgtataggaatgcttgtgatttttgcacattgattttgtatcctgagactttgctgaagttgcttatcagcttaaggagatttggggctgagaccatggagttttctaaatatacagtcatgccatctgcaaacagggacaatttgagttcctcttttcctagttgaataccctttatttctttctcttgcctgattgccctggccagaacttccaacactatgttgaacaggagtggtgagagagggcatccttgtgttgtgccagttttcaaagggaatgcttgcagtattcaaaaaaactggcacagtattcttgtgccagttttcaaagggaatgcttgcccattcagtatgatactgactgtgggtttgttataaatagctcttattattttgagatacattccatcaatacctagtttattgagagtttttagcatgaagggctgttgaattttgtctaaggccttttcagtatctattgagataatcatgtggtttttgtcattggttgtgtttatgtgatggattacatttattgatttgcatatgttgaaacagccttgcatcccagggatgaagctgacttgatcgtggtggataagctttttgatgtgcttctggattcggttttccattattttattaaggattttcgcatcgacattcatcagggatattggtctaaaattctctttttttgttgtgtctctgccaggctttggttatcaggatgatgctggcctcataaaatgagttagggaggattccctccttttctactgattggaatagtttcagaaggaatggtaccagctcctctttgtacctctggtagaattcagcggtgaatccctctgctcctggactttatttggttggtaggctattattgcctcaatttcaaaacctgttattggtctattaagagattcaacttcctcctggtttagtcttgggagggtgtatgtgtccggaaatttatccatttcttctagattttctagtttatttgtgtagagcggtttatagtattctctgatggtagtttgtatttctgtgggatcggtggtgatatcccctttatcattttttattgcatctatttgattcttctctcttctttattagtcttgctagtggtctatcaattttgctgatttttcaaaaaaccagctcctgtattcattgattttttgaagggttttttgtgtctctctttccttcagttctcctctgatctcaaatgtccaacaatgatagactggattaagaaaatgtggcacatatacaccatggaatactatgcagccataaaaaatgatgagatcatgtcctttgtagggacatgcatgaagctggaaaccatcattctcagcaaactatcacagggacaaaaaaccaaacaccgcatgttctcactcataggtgggaattgaacaatgagaacacatggacacagcaaggggaacatcacacaccaaggcctgttgtggggtgggggagggggggagggatagcattaggagatatagctaatgttaaatgacgagttaatgggtgcagcacaccaacatggcacatgtatnnnnnnnnnnnnnnnnnnnnggtagaattcagcggtgaatccctctgctcctggactttatttggttggtaggctattattgcctcaatttcaaaacctgttattggtctattaagagattcaacttcctcctggtttagtcttgggagggtgtatgtgtccggaaatttatccatttcttctagattttctagtttatttgtgtagagcggtttatagtattctctgatggtagtttgtatttctgtgggatcggtggtgatatcccctttatcattttttattgcatctatttgattcttctctcttttcttctttattagtcttgctagcagtctatcaattctgttgatcttttcaaaaaaccagctcctggattcattgattttttttgaatggttttttatgtctctatctccttcagttctgctctgattttagttatttcttgccttctgctagcttttgaatgtgtttgctcttgcttctctagttcttttaattgtgatgttagggtgtcaattttagctctttcctgctttctcttgtgggcatttagtgctataaatttccctctacacactgctttaaatgtgtcctagagattctggtatgttgtgtatttgatctcattggtttcaaagaacatctttatttctgccttcatttcgttatttatccagtagtcattcaggagtaggttgttcagttgccatgtagttgtgtagttttgagtgagtttcttaatcctgagttctaatttgattgtactgtggcccgagagacagtttgttgtgatttctgttcttttatatttgttgaggagtgttttacttccaattatgaggtcaattttcgcataagtgtgatatgatgctgagaagaatgtatattctgttgatttggagtggagagttctgtagatgtctattaggtccacttggtgcagagctgagttcaattcctggatatccttgttaaccttctgtctcattgatctgtctaatgttgatagtggggtgttaaagtctcccattatcattgtgtgggagcctaagtctctttgtaggtctctaaggacttgctttatgaatctgggtgctcctgtattgcatgcatatgtatttaggatagttagctcttcttgttgaattgatccctttaccattatgtaatggccttctttgtctcttttgatctttgttggtttaaagtctgttttattagagactaggattgcaacccatgcatttttttgctctccatttgcttggtagatcttcctccatccctttattttgagcctatgtgtgtctctgcacatgagatgggtttcctgaatacagcacactgatgggtcttgactctttatccagtttgtcagtctgtgtcttttaattggagcatttagcccatttacatttaaggttaatgttgttatgtgtgaatttgatcctgtcattatgatgttagctggttattttgcccgttaattgatgtagtttcttcacagcatgaatggtctttgcaatttggcatgtttttgcggtggctggtactggttgctcttttcaatgtttagtgcttcctttaggagctcttgtaaggcaggtctggtggtgacaaaatctctcagcatttgcttgtctgtaaaggatttgatttgcccttcacttacgaagcttagtttggctggatatgaaattctggattgaaaattctttcttttaagaatgttgaatattggcccccactctcttctggcttgtagggtttctgacgagagatctgctgttagtccgatgggcttccctttgtgggtaacctgacctttctctctggctgcctttaacattttttccttcatttcaaccttggttaatctgacaattatgtgtcttggagttgctcttcttgaggaatatctttgtggtggtctccatatttcctgaatttgaatattggcctgccttgctaggttggagaagttctcctggataatatcctgaagagtgttttctaacttggttccattctccccgtcactttcaggtacaccaatcaaatgtagatttggtttttttacatagtcccatatttcttggaggcttttttcgtttctttttactcttttttctctaatcttgtcttctcgttttatttcattaatttgatcttcaaccacgatagcctttcttccacttaatcgaattggctattgaagcttgtgcatgcgtcatgaagttctcgtactgtggttttcagctccatcaggtcatttaaggtcttctctacactgtttattctagttagccattcgtctaaccttttttcaaggtttttagcttccttgcgatgggttagaacatgtttctttagctcggagaagtttgttattaccaaccttcggaagcctacttctgtcagcttgtgaaagtcattctccatccagttttgttccgttgctggcaaggagctgcgatccttttcaggagaagaggcgctctggtttttggaattttcagcttttcagccctggtttctccctatctttgtggttttatctacctttggtctttgatgttggtgacctacagatggggttttggtgtggatgtcctttttgctgatgttgatgctattccttcctgtttgttaattttccttctaacaggcccctcagctgcaggtctgttggagtttgctggaggtccactccggaccctgtttgcctaggtctcaccagtggaggctgcagaacagcaaatattgcagaacagcaaatattgctgcctgatccttcctctggaagcatcatcccagaggggcacctgcctgtatgaggtgtctgtcggcccctactgggaggtgtctcccagtcagtctacatgggatcagggacccacttgaagaggcagtctgttcattctcagagcttgaatgccatgctgggagaaccactgctctcttcagagctgtcagtcagggacgtttaagtttgcagaagttgtctgctgcctttttttcagctatgccctgcccacagaggtggaatctatagaggcagtaggccttgctgagctacggtgggctctgcctagttcgagcttcccagctgctttgttaacctactcaagcctcagcaatggcagacgcccctcccgccatgaggctgcagcctcgcaggttgatctcagactgctgcagtagcagtgaataaggcttcgtgggtgtgggacccaccgagccaggcacaggagggaatcttctggtctgctggttgctaagaccatgggaaaagcacagtatttgggcaaaagagtactgtttttccaggtacagtctgtcatggcttcccttggctaggaaagggaaatctccccaccccttgcacttcccagttgaggtgatgccctgccctgcttcgacttgccctccgtgggctgcacccactgtccaaccagtcccaatgagatgaaccaggtatctcagttggaaatgcagaaatctacccctcttctgtgtcaatcttgtcgatcttgctgggagctgcagaccggagctgttcctattcggccatcttggaagtgactgaaattgttatttttatgtgttctctgttttgcttcctcaccaagactctaaactctggatggaagtatatctgttgtttataattcccaatagtcttagtataatcccttacacacaacgaccattgtattgtgaccaatgtagtagtaaaaattggaaaagattttcaataaatattatgacaatgaatgcacgtgtgtttacgtgtatatgtacaagttaaagttaccaaagatgattataggtcagcaatgactaaaggtgactaatatcataatgactaaatatggcttggtagggataggaaaatcagcatcttacccatttcctgccagactcaaggtgaataagagaaagctaaaagattgccttgccctaggagacaaggttaagaccgagttactaggcttatggtggtcataaacctgcaaatattctgagaagtcaaagtctgtttgacatccccatatggatattcaatgggcatttcaaacttaatgctttaagaacaaacatcttaatttcccattgctccaacctccttttattcatttaacatatatttattgaagggctactatgtggcaggtactgttttagtcttggaatgtccatcaatgggcataacaaagatctctgcccttgtgttgtttataatctggcagggagaaacaggcagtagatagtaaacacagtaggtgaattgttaagtgttgtagaaaaagcaacaaggtagaaaaagggtaagaggaactgggagtgctggtgggatgggcttggggatagtgatggagagatgtaagtagcaacttcaattggggaggtcaggatgacctgactccattgtcaggttgaaattggagcagagagctggagttgagggagttagtcaagtagtaaggttatccgggggaagagcattccagcaaagggaacaagtagagcaaagtcaggaggtacttagagtatcccgtgaacagcaaggaggccatgtgtctgctgcagagccagtgatggagagagtataaaaggaggtttaggaaggaaagctgggtgatggggatcaaatcatacagggccttaggccactgaaaagactttggcttttagtctgagtgaaatacggggagtctctgaactgttttgaacagagaaataacatctgacttgcattttaacagaattactctggcatctctgttgagtaaagaatataaaacggcaagggcaggaacaggggaacctgttaagagcaattgcagaggctgggcgcagtggctcatgcctgtaatcccagcactttgggaggccaaggtgggtggatcacggggtcaggagatcgagaccatcctggccaacatggtgaaaccccgtctctactaaaaatacaaaaatacaaaaaattagctgggcacggtggcgggcgcctgtagtcccagctactcgggaagctgaggcaggagaatggcatgaatccgggaggcagagcttgcagtgagctgagatcacaccactgcactccagcctgggtaacagagcgagactgtctcggaaaaaaaaaaaaaagagtgattgcagaaatacatgcagagaaatggcagtggcttgtacagggccacagcaatggacatgaggatgaacatattttggattctgaacatattttgaagttagagtcggcatggttttctgacactttggatataaaatgtgaatccaaggctttttgcctgagcaactatttaatagaagaatgaaagtgccattaactgcagtgggaaagactgtgggtggagcaggtttggagaagataagtagttcagttttggatatgttaagtttgtgatatccaagtaaagattttgaataggcagttggatgtacaagtctggagtctgggaagaaatctaggctggggacagaaatttgagggttgtcaccctgtagatcatgtttaaaaccacgggactgtatgagtttcattataccaaggaaataagtagtaagagaagaggaccaaaggcagaaccttagggatgccacctctgttgcctttgttctctttcatcttttcagtaaatggcactactatctccctgatttctcaagcctaaaatctagaagtcgtccttgatttcttccttctacatccagacccgtcctctttgtctccactaccaccaacctagtccaagtcaccattatcttctaatacatctccatgcttccccatttgtccccctacagtcattttccatccagcagtcagaatgatcttgacagaatgaaggtaattctaattgtatcacacctctgtgcaaagcctgccagtgttctgcacagcaaacattgtgaatgaatgttctgactcacaaatcactgtgaaatattgtccaacgtgaaacagagtgaaaaggcagcctacagaaaggaaaaaaatatttttttcttagaataaaatattctaataaaatattaaccccctaaaaaggggttaatatccagaatatacaaagaactcctacaacataacaataaaaaacaaataatctaatttaaaaatgggcaaaggacttaaatggacatttctctaaagaagatatacacatggccaacaaacattgaaaagatgctctacatcatgaatcatcacatacccatgttcattgcagcattattcacaattaccaagaggtggaagcaattaaatgtcaattgacagatgagtggataaagaaaagtttgtatatacaaaaaatggaatcttattcagccttaaaaaagaagggaatcctatcatatgctataacatggctgaaccttagggatattatgctaagtgaaataagccaaaaagacaaaatactgcatgatttcacttatatgaagtatctgaagtagtcaaactcttagaaacagaaagtagaaaggtggttgccaagagccggggagagtggcaaaaggggagttgtttataatggatatggagcttcattttttgcgagatgaaaatgttctagggctgggtgcggtgggtcacgcctgtaatcccagcactttgggaggccaaggcgggcggatcacctgaggtcaggagttcgagaccaacctcaacatggggaaaccctgtctctactaaaaaaaatacaaaattagccgggcgtagtgctgcatgcctgtaatctcagctactcaggaggctgaggcaggagaattgcttgaacctgggaggcggaggttgcggtgagccgagattgagccattgcactccagcctgggcaacaagagcgaaagtccgtctcaaaaaaaagaaaatgttctagagctctattgcacagcaatgtggatatagttaacactattgtactgtacatgtaaaaatggttaatatggtgaaatttgtattatgtgttctttagcacaataaaacaaaaaccaaatccctcctgtggttcctactgcacttagaataaaatccccaacttcttgccctagctgccaaagctgtttatgatgttgttttgccagaatccctcgacctcaacttgtgccattcttcctttgtctgttattgtccagccacagtagctttctttctattccttacacttaccaaacttttccccctgcctttgaaatgttcttcccgctgacttttaccaggctagctgcatcttgtttttcagatcttgacttaatgttacctcctcatgaaggctttttataactacctagtctctagttgccaccaatcactagctgtatcacatcactctacttaaattttctaggccgggcgcggtggctcacgcctgtaatcccagcactttgggaggctgaggcgggtggatcacgaggtcaagagatggagaccagcctggccaacatggtgaaaccccgtctctactaaaaatacagaaaattagctgggtgtggtggcatgagcctgtagtcctaggtactcgggaggttgaggcaggagaattgcttgaacctgggaggtggaggttgcagtgagccgagatcgcgccactgcactccagcctggtgacagagtgagactcagtctccaaaaaaaaaaaaaaattctgcatagcacttctcactatctgatatttttcttatttatatttgtttactgtctgcttcccctatgtaagaattctataagttttttatattttagaatttaaagtttttaaattttaaaagaatgttatgagaaagcagggaccttgtctgttttgttcatcaccatatccccaagcacctagaatagtgcctggcatatactaggtgctcaataaatatttgccaaaagaaaactgaacttcctagtcttaaatgatcatttcttgaaaaggactactcttctccccaagctccagacctgtctttttgaattccttcttgggtatttctgtctaaatattctacaaatacctcaaattcaacatgcccctttctgctcaattactcttacagaccttattttttctgttaatggcatcatcattagcccaattgatcaggccagaggtcctctttgattcctttctttctctcaactcccactatctatcagatcctgtcagtatcttgtctcacatctttcccttctcttccacagagttgctaccacatcattttaggcctaattactttttacttgtatcattgtaagaaactgcctaaccgggctttttgcttccaatcccccacggctttccagaccatactgtcttctattcatcatactacttttctgttcaaaactaacaaatgaaatgccatttttttttatgctttggaaagccacggaaaactttatcctcagcctcctttagaccctacttacctttccagcctcaccattcatgacatccctgcagctctgtgctgctgccctcattctgtggccttatcagcctcatagctggtggtcacatacaccagcagcctccacctttacaaagccattttccctgactgcagtgctcctgaacccccgctccttttggctgacttacagttttatctttaagatataactaaaaaactgcctccccaagaagcctttatagatcttccctcaactccaaaattgaaattagtggcatagacccataatatctctattattaatatcattttttttctttttttttccaagataggtcttactttgttacccagactggagtgcagtggcgcaatcttggctcactgcagccttgaactcctgagcttaagcaatcctcccacctcaacctcctgagtagctatgatgacaggcatgtgccaccatgcccagctaatttttttgtattttttgtagagatggggttttgctatgttgcctaggctggtctcaaactcctgagctcaagcagtctgcccaggcttccaaaatatttattgagcacctactatatgccaggcactattctaggtactgccctcagcctcccaaagtgttaggattacaggcatgagccacctctcccagcctatttcattttttaaattgtggtaaagtatacataatataaaatttaccattgtaactgtttttaagggtacaattcccttgcattaagtacatttacattgctgtacaacattcaccactgtcctctgctatcatatttaattatttatggatgtagttgtcccctcctctgattggaaacaaaacgcttggcgttatttgtaagtgctgaattaacatggatgaacatgaatataatcagatcatctcctgagatgagatgtcatgtcacaagtatccttgtgatcctgcttgggtaacttcaggattgtgttcagttttcttccttgtacttattcaaaatggcattggttagagttcacggagtcctggatttttaaaggttctttgcctaatttcttctttacaagtttttggtgcgtacacttaacctaacttttttgtcttaccaatatctatcctataaatatgccagtgaaatggagcatattgcgttaggtaaggtgtgcatatttcaagaactagatgtgtttcaaagcacataatgaaacttcagcaaaaatgagattaagagtttaggctccaataatattgctgcgattttatttctgtcaaagttttgttatttttgctgtattgtttgcttttcttcaatgttttgtaagccccggttctttgatgaactcctaataagctgtgcttaaaactatgacattgacctttctccagaaacaggtttcagaattgtctgtttttcatgttctctccctgccttttctcttgtaatcaaatcagcatgtttttgtttttgttttggagacagagtcgcactctgttgcccaggctggagtgcagtggcactatctctgctaactgcaacctctgcctcctgggttcaagcgattcttctgcctcagcctcccgagtagctgggactacaggcacgtgccaccacacccagctaattttttgtatttttagtagagacagggtttcaccatgttgcccagactagtctcaaactcctgagctcaggcaatctgcccgcctccacctcacaaagtgctaggattacaggcatgggccattgcacccagcctaaatcagcatgtatttttaaacatcatagaatgcgagggtttgaagtgtcttttgtgatcatctaacattcactttgcatataaataaataaataaagacccatgttaatgccaaagggagtgagtggcagaagaatctatgacggaagcatatcttttggtgctgtcaatgaaagggaaacaaatgcttggcattatttgtaagtgctgaattaacatggatgaacatgaaaataatcagatcatcagttattctccctcctgatctgaaggatcctgtgtgacatcatctgagatgcactgggggttgaggaaagatgacccttaaaatccacatttgtactttccaagagcaaggtgagatcatagagaagttacacccgctcctttctccactttttagtctttatccactaaaaacaagatgtgagaaaatcaagtgacaagaatgatagggtaataggctgtcaacaaaatgagtgtgtgggcttatataggtataaacatggtgaaggtgatagaccatggatgcttagtcccttttaagttccatcttccgtttaacacattttgaaagaatttattgtgtcttattttcccctgatttgtgtagctgtgccaccctagataacagtttttctttttgctcttgccaccttcttgataaaggcaagtacagttagaatcgtaggtacttaataatgcttcggcatgaatatgcttcacaactttgagatgtgtaccctttattttctttctgttataaatcttaatttctttgtgccctacttttcatatctgtaaaatggatgaaatagtagtatctgcctcatataattgctgtaaagattaaatgctaatacacataaagctcttagaacaggtctggtgtatagtaaacacacaaagctgctattattattgttactggtattaactgatatattcatactttttataactgctcatcctattaattaaatgtattttttcactatatattctttttcaatgtatattccttttaatcttccttcttagcctccactatagttcagatgccttctccaatttcaaacaatttaatgaaaagaaaagaaaatttatacatccagagatggctgatttaatttcttcagtcttttggagggtagaattattttccttctgagagtaaacttattttttctatgttacaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggtaaaagtagatgactggaatgttggggtatagaaacaggattaaataagggagaaatttggatgcatgtgaatgataatctatacagtattagatgtcatttatctctttttattacttaagattataaattatctttaaagattattagattataatctattaaaacatattctagctctgcttcccctgccccttacccccagctctctgctccatagggcttccttttcctatcttggaacacttacttatacaaactgaaataattagccaaatttgtactctcaggttcttacaatgtcatgtgatcatatttgctagtgagcctttaccactatatgaaccatggacatcagtttaatttaaacatcacccagactaatacagcaattgaatacaccagcagttacaccttgttgagaaaattagaaatctggctttgaggagagggaattttaaaagcaccttactagtgtcgagttcagacatatgacttaagtttaaggatttaatacttctgtctgtattttatttaaacttcaagggattgaaaatgttttgggggagagagaagagtcactttattttttagaaattctagtatcggtgcagagagaaattatgcgctcttgccttccaaattcaccgtctctgagcttggattcttgtcttcttaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtaagaatttaaactatgtagactcttagttaaaatgtcaagtctctgttttatatctgagacagaaatatagtctagtacatgttgtttattttttgtggcttttatttttccttattttctgatttttctcgttttataataagaaaatactattgtggagttttttgtcacatagtctaatagtacaatgggatgtgaagcatagttgtagcattagaggaaggacaatttttaaaacttgaaaagatattcagctgtgtaaagcattgccttaaagctaaccgaataccagagtagaagaaacccattgctctgtaaatgacattttgaagaactgtcttatcagctttctaatatattaaatgaatggtttcccacctcccctggaaagctttctggaagctcactttgataaggatttaattgataacctttaatcttgagctttcctacttgaaaaagaagttggaatgtcagtttgataagacactgcaaagaattgtgtaatttatcccttctttgagtactgtagcagtggttacaatggagtaacaaccacatctttcaacatgttctttcctttgagtgtaatttttttggtatacattctagtgtgtggtacttgagaagatttggtgagagaaatagttgttcaatctggggttctttgtgagataatgtcctaaaactcttaaatttacacatctctctttatttagtttgagttttgatagatcgctaagtgtaagaggatgaaaaggctactgtgcttttataatattaaagcattgtatgtcttaactataaaccatttactttttcaaatttttttttcaggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtaattggtatggtcttacacataatttcagtagtgcccctcaaagccatgttcaatattgctatgtttcattcagaaaggtcgcctacagtttgtataactggcattaagaaaacctaactaaaattaaaagaaagcaaaaaagaaaatgtaaccaatcttttcccagaagagaaggaaatccttttgctaacccatattaggcatggtatttaataagtgcatagattagatttattctgctaatagtgttttatttatttatattatatagcatatatatgctttgagcctgctcagacatatgtattagtaaggaagctgctttataagatgtttctgaaggttttttctgcctcctttgccaaaatacatgtttaaaaaattttttagtataggatttatatatgttgcggaaaaaaactgagtccatgatgattaagaaggaaaaaaagccttccatgtaattattttgttttcaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggtaaagaatagcatttaattcttaatcatttgatcatcatatagaatgattattttgatggagaagagaatttgaactggttcttttggaatttcttccaattttttttccttttaatttatgattgattttagctcttgtattcttatatgatgatctggtctgttcaacaattaggtgatcaaatttatatatttagtggtgtcttccacttggtaatggttctaatttactagaaatagagtataagacttttataaattgttttattttagcaatagttctgttgacaaagagtcaaactctgtaaaatatttgaagagatttattctgagccaaatatgagtgaccatggcccatgacacagccctcagacccagaggacatgtgttcagggtagtcagggtgcagcttggttttaaacattttaagaagacatgagacatcagtcagacacatttaagatatacattggcttggtccagaaatcgggcgagggttgaaagatttattatcaatcgaaaggaatgtctgggttaggataagaggttgtagttaccaaagtttgatcatgcagatgaagcctccaggtagcaggcttcacagagaatagattgtaaatgtttcttatcagacttaaggtctgtgttggtattaatgctgattgacttttcctgatttccaaaagagaggaggcataatgaggcatgtctgacccccatttcccatcatggcctgaaccagtctttcaggttaactttggagtgccgtggtcaagaggagggaatctgttgagataggccctgcctattgagcggggccttagaattttgttttgggtttacagttcttattaaatcattattttgggaaccttatttcataagtgaaaaaccaaaccagatatctgtctgagtcagtgactctgttttgactctcagttctactccctctgcatattccagacttgctaatttattgacttctcatttctttgccttccctgggcaagcccatctctcctggggcgttatagtgtgggatgggacagcagacccttatgcacaacactaggggagtaagaattcatcttttcccagcccatgatttcttccaggcaatgatatctatcaggcaccatagtataatatggagcctcatgacttattactagcactgacctgaccattgggaggatcagttggtcattagttggtcattagtacccagaagttggtcattagtaccccagaagctcacttgaacaaataggcacaagatcttacttatatatgtatatatttcagatttttccccctaaggttctcattctttgtcagtgccacaagtcccttctacatactccccagacctttctgaaaggtggaactaattacactagtgagccctccagttttctttagtctcgcaatttttctcattataatgacaatagtaaggctcccactccctattaaaatggaatatgcacagttaagcttaaattgaactttctcctccatcaggttaaacttccagctgtgctcttggctaactttacctttttgtgatcactttaatgtgagcatatcacaattttcttttcatttgctctatttcttacaatgtcttagtgagctttatacaagtacagagaggagtatagagttcctggccaggcgtggtggctcatgcttataatcccagcactttgggaggtcgaggtagatggatcatttgagaccaggagttcaagagcagcctggccaacatggtgaaaccctgtttctactaaaaatacaaaaaattagctggacgtggtggtgcacacctgtaattccagctactcgggagactgaggcacaagaattgctttaacctgggaggtggaggtagcagtgagccgagatggcgccactgcactacagtctaggccacagagtgagactctgtctcaaaaaaaaaaaaaaaacaaatagagttcccctctgatcagtaatttccactcaacattgtgataatgtcattatatgtggattattgacacttaaacagtgctttaatataatttgtctaattggaatatttttcctcccagattatgagcagagggcaaaaataaaaagataatggttttacctctctgttcaaaatatctggaagagatacagtttttaaacacgcaatgtgaaaaagatgtgttttaactgtaatgcctggccaggtgctgtggctcacgcctgtcatcccagcactttgggaggccaaggtgggtggatcacgaggtcaggagttcgagaccagcctggccaacatggtgaaacctcatctctactaaagatacaaaaaattagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaagaggtaatgcctgacaggttcttcctgcctgctgcacaggcaaaacagttcattgagaccatggtatcgcagtaaagagtttaattaatgcaaggccagccacgcaggagaattggagttatcactcaaatcagtctccctgaaggctcagaggttagggtttttcaaagatagtttgatggacaagggactagagaatgggttgattggttggggatgaaatcatagggatgtggaaaacagtccttatgtgctgagtcagcttctagttgggaaccacaggaccagctgagttacaactcactcactggtccaggtgacgtcagctggttgtcagaaatgcaaaagtcagaataacatctcagaaggccaatcttaggttctacagtagtgatgttatctacaggagtagttgaggaagttacaaatcttaacaacttccaaaacaatgactggttatcctttaattacacatacatgttagccaaattcaggcccctcttataatcccaaccttgtgacctttcattagttttacaaaggtggtttagttttgggaaaggttgttatcatccttgctttaagattaaactgtaagctaaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccgggagatggtggttgcagtgagctgagattgcgccactgcactccagcctgggtgactgagtgagactccatctcaaaaaaaaaaaaaaaggcggagtcaaccatgtcagatttcttttactgttataattttgcaaagacagtttcataatcataggtgattgataatagcgaagcctgatgtgttcacatttgccttgagttaaggtatctaaagtagtacgtgttggaataaaatataagtgaacatggcttatattcaaatcctttatcatatcatacaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggtatggcaactttatattctactaatcagttcttgttgagagcatttggaaatcctggtggaattttatctgtttgtagtgttatgctttcttaaaatgagtatcctgttactgctcttatggcagacaacagtaaaggtcttttctcattactttttcagccagtgtcctggctgtttctttcctccttctttctctctttttttcctcctcttctcttctccttttacccccatctcttctctccacccctttctcctctcttttctcacctactacttctctttcccttctcttacctcctctcccctttcttctctgtcttgtcttttttctcctctcctctccttctcccccgcctgtccccctactctgttcttcctcctcctctcctcttcctctcatagttcttcaggtattttgtatttatctctcacattgggaacttggtaacatattctttgtcattcataaaaattgatccaaatgtttagttctgttttctccctgaagtttaataaactcttttatgtaaatttagattttgatattctcttttttacttggtatatccttaactgcagcagagtgaccacattctcatgtagtacctgagctcatatacctccatataatttagcaggatggatcggttgaataggatgagtgtcaagattaaaaatcgccacaatgtccaactaaggttgcgaataagagtgaagatatcagtacccaagagaaccaaactgtgtccacacataaactcacttgaacaaaatgttcactcatttaatgtacagtgctcatgtatatgaatgttcaatgtacatgaacgttcattcaggattattcacaataacaaaaaagttgaaacaacccaaacaaccatcatctgataaatagataaataaaatgtggtctgtccttacaatgaatattatttggctcgaaaaggaatcaagtgctgatacatgctacaacatagatccttgaaaccttacactaagtgacaaaagccagtcataatagaccacatagtgcatgattattatttttttctttatcaagttgattatatttttatgaaatttttagaataggcatatccatagagacaggaagtagattaaagattgtattgggctggagtgaatagtggtaagaggtgataggggagtgactgctaatggattttggggtttctttttggagttatgaaaatgttctataactggatagtggtagtggttgtacaaccctgtgaatataaacaactttaaatgggtgaattgcatggtatttgaattacatcagtaaaactactaaaaaaaaaaaaaagtgacaagtattagcaccaggggcaatggggaagaaatttagtttcaacatttactggaatatccagaagtaccatagtggagacttcatgtcatatagagtagcctgccattttagaatgacagtacatactgatggatatttagatttaggaggttaattgagattctccaaaaattgctttgaaagattgccaatagtagaaaaaagtacttctacagttggtaatcatatattgttctcaaagagtcaaataagaactatgaagttataccctggttggcaaaataaattttttgttttcttttattatattttatgtgtttaatgctatgtttgataaaattcacttatttagagctttaaaaatagtctcataataaatcacacatcatgttggctaaatctggaaagttaataatagttacattccagtgaaaataagtcacagatttacagatgtggtgtccagaccttggcatggtgagaggtaggaatcttcagtcatgcagacatttttctttccatgacatattttgttttctcatcttaaaatccttatttaaatggagtttgaaatcttggcaaagcagtttgaaggagaatttctttgttgctgtacaggagtaaaaaatcctcatagagtccgcagctggagcttgtgaattaagctgataaaagacagattaaaagaaaaaagcatacaaattttatttgatgtttgtatgtggcacaggcaacaggcagtgggggagttcataggaaagacgtgaaaccctcaaaaaagcagtgttaaggacttagtgctcttataacaaagggtaataccttgtggaaaagtgactacacaaaggaaggggtttagacttctaggggtaaaaaattgtgggaaagtgactaggaaatatgcgggggaaactaatgaaagatgagggttattttactaaggtttgtttgtgtcaactcatcttggtgttgactatcccatctctgatggtaccaggaaggtgcctttctcacgggaaatttatgccctaattttaggcagaaagagggagggtagatagcctttcctgcatctgctgtttctcagttgccttcagctctaaataattaacatgctaaagagttatattctggggcagaatgttctgattcctttccctgccatctttataatttagaaggatcttgaaagaagataggggaaagcaatattctttttcataaaatttcaaaaattttgatactaatttttttattgaggtgaagtttacataattccagtggcgtttagtgcattcatagtgttttgcaaccaccccctctatcttgttccaaaacatttttatctccgcaaaaggataccccacacccatttaacagtgactcccctttcccttctcccctcaacctctggtaaccaccaatctttgttctgtctctagggatttacctattctggatatttcatagaaatggaatcctataacatgtgacctttcgtgtctggcttctttcatttagcatagtgttttcaaggttcactcatgttgtggcatatatcagtacttcattcctttctatggttgaataatagtacattgtatatacatatgtatatatcaatatcacatttgctttatccatttacgtactgatggacatttgggttgttttgactttttgactacaatgaaaaatgcttctatgcccattggcattcaaatatctatttgagttcctgttttcttttccccgtgccccccttgttttgaaacagagtctcactctgttacccaggctggagtgtaagtggtgtgatcatggctcactgcagcctcaaactcctgagctcaggcagtcctcccacctcagcctcccaagtagctggaactgcaggcatgcaccaccacacctggcttatttttaattttttgtagagacagggtctcccagtgttgcccaggctgatcttgaactcttgggctcaagcaatccacctgcctgccttggcctcccaaagtgctgagattataggtgtgaactactgtacgcagcccctgtattcagttcttttgggtgtacacttaggagtgaaattgtcatatgataattccatgttaagctttttgaggaattgccaaactgttttccacagaggctggactattttacattcccgccagcaatgtatgaggttccagtttcttcatatcctcaccaccacttattattttctatttttattattatagctgtcctagtgggtgagaagtaggacctcattttggttttggtgtgcatttccacaataactaatgatgccgaggatcttttcatgagcttgttggccatttatctatcttctttggagaaatatctgttcaagtcctttgtccaatttttaattgagtttttgtctttgttgttaagttgtaagagtttttaaatactggacactggacccttatcaggcttgcaaaacattttcccccattctataggttgtcttttctctttcttatgttcttgatgcataaaagtttttgattttgatggaatcccgtatatctgtttttttcttttgttgctagtcctttccgtattgatgctaattatttttttgaggtagactgtttggtagaagtactataaatctttttttgtggctttagaaaattagccatttgaaagatatcttctcacttattcactttgaattgaagaaattagtgtaattttcatttctgttgaggaaattctgcttggcaaattttattgttttctcttctctggcagtattctgaaaagctttatgttaataatccatcttgaaacagacaacatgatacattttcctcttttcccttataggttctttggtggttaactacccttttgatgatgatgaacaaggacttgccacatatagtaaatcaccagatgatgctgtgttccaacaaatagcactttcttattccaaggtaggcttgtctttgaatataaaatgttacaaaattaattcttttatttaaaaatatgctttaaagtcctgcaagactcaggtcaagtgcttccatagttaataaagcatgactttttcagctgtttccgaaaaatagctttttctcctgtttcccacctcacttttgaatacactacatgtctttctccattggccttttatctatggttttagcacagtacctggaacatatacatgtcaatttatttcatttgacaaataagttataagcccagtaaagtaggccaagataagggcttaatgaattatagctctggagccaaatcttgcccaccacctgtttttgtaaataaaattgtattgacacacagccacagctatatttttatatattgtgtgtggctgctttctccttcaacatttcaaagtaagtcagtataatttactatattaacaaactaaagaaggaaaatccagtgatcaaagggcaaagttgggtagtttcaacaaagacttttgcatctaaaaagtctgaaatatttgctttctggttttttacaggaaaaaattgccaaactttagtctaaggtatttaagatcctgtagttacatatagcaaggaaaagcaggcagaaatttctgtattttccaaacttcctatgataaacatggattactcttacaatcgggaatgttaaaatgtgtgtgtgtgtgaaaatttaatttaaaaatcgttcttaggaccaggcttggtggctcatgcctgaaatcgtagcactttggtagggcaaggcaggagaattgcttgagctctcaggagtttgagaccagactgggcaacatagcaagagcttgcctctactaaaaataaaaaataaaaaaaaaattagccggttgtggtgacatgcatttgttgttccagctacttaggaggctgaggtgggaggattgctctatcccaggagattgaggttgaagtgagcttgatcacaatactatactctagcctgggtgacaaagctgagaccctgtctcaaaaaaataaaaattgtcttagaaaacatgttaaaagttgaggcttgtaaactaagcttgttagtttcaatgtttggtgttactactgacttagtattgttattggttatattggtactattattggttataggtaatgaatattattactgtaactctgcactctccagtcacagtcctccatccttccacttttcccattccctcatcctctgcaaatgaatcttgtgagattgttcagagtttctactagaggagtacagctgttcatttcaccttagagaattattgctttctgtttggacatatatgtttttttgaagtacatacgtggagtaataagagaatgtatagtgtcccaaccatcaaaataaaaattaaatggctggattttgcatattttctcatcacattctatgctcattctcatgatttctgcttttcgccttcattttggcttctagttccttatcttctctttgttttcttagaccattaacccttttgatttgatttacctttctctgtagggtagacccatggacataccttttcaatgattctcctaagggtcttgtacacccctttgacataactgctttgccctccagtcctcagtaattaccattatctcttttctccataccaatattacaagtacagcctagagtggtcacactgtcacggcaatttgctatagtccatatgtgtgctctccaacttcagctgaaccctcagtcctacatggcaacatttcctgtttagctacttgactccctggctcagttcccactatggtgattcagagcctttatcctctatctgagcctcctgttccagctctatccctcttattcatagtagatcactttgcattgaactcaagtagaactttgagtaatctgatgtgagttcactaagattctgtcttctcaattgtttctcatgtgtgtcttaacaatattctcctccatttcttgatcccactgcattctgcctcctcgaatcttgtgtcttcatatcttattttataaatgaggaaggtgataattaaactccccagtcttcactcacagccttttttctcttggtcaataagcagctcctctaaaaatattgtcttctgctaaccttagtaagcccccatgaagctaccattcaaagtttctttatttttactcttcaaaacttctcaaaagtagatagtcttgggagacatctgagcagccaaagacaatgatggctatgtgataacctatctcccagggtttttctttaaacaatataaaacgacttaaaaactaccaaattttacacaaaaccacactgttggcatcacaaaagatcctgaaactgcaaaataactgtaaattttttaaaaatcaagaagtctcagcatgatctatcatgcacctaccccaccttcgccccaccacaaggctttgtggtgaggtaaaacagaccaagaaaacttacggagaagacagaagtgggtgccagtgaagggcagctgtgaaggtaatttggaatgaccaccatacatcacatatgcactaaatccaaaaatactaaaagagtaactgggcagattagagctctggaatacagggaagagatttcaaaatgcacacaacttaaaggatctggtgtgatttaatgggataagtacaatttaaaaggagaggatggttacagggagatcttccaaactcatagcttctggagaaggaaaaaaagaggcaaagatagaaatgaagaagtgctccttggcaattagatggtgaatgggaaaaggaaacagtggggagaaatgtaaggttttacaagacagaaaagaactttaaaatcagaagattctcagctccacccttaccaccaagacaaataaataaccacactgaggtacctggattttgctagaccgacagaaaagtgtaccattaagctaggaataatattaaatgcccaatatcataaaaataaagaggaaaataaagtccatggaaaatgattgcagaaaattaggaaatgaaacttcacatatagacactaaggagaccctaccattagcaaaaaataatcgagaagcagaagaaaactgttcagttggcattctaaacagattaagtatacccaaatatacgttgagaatatgagaaactacctcaactcagatagtcaaaaaataaaaacagaggccaggaaacaaaaaacagggataaataaaataaagtttataggactcaggaaaaaaatggaagaaaaagacaaaattatctctgaaatgaagaataaatgacaaaagttagggaactcatacatccaatttcaaacttactacaaagctacagtaattaagacagtgtggtactggcataaagacagacatatagatcaatgaaatagaactgagaacccaggaataaattcttatgttgatggtcagttgatttttttttttagaaaaggatgccaagacaattcaataggcaaagaatagattttttaaataaatggtgctgggacaattggatatttatatgcaaaagaataaactagataccttcctcacaccacaccccaaaattagcttaaaataggtcataaacctaaatataggaactaaaactataaaactaagaaaaaataggaatacatttttgtgatttggtcctcctctagatatgacatcggaagcacaagtgacaaaaaaagattgatacattggacataatccagatttaaaacttctttactgcaaaaaaaaactgtatttgtttcctagttctgctgtaacaaaattccacaaactgggtggtctaagacaacaggaatttattgtctcatagttttggaggccagaagtccaaaatcacagtgttggcagggccattctccctctgaaactgtggaagaatccttccttgtttctccctagtttctggtgctttgctggcaaccattggcattccttcacttctaggtgcatcactccaacccttcatcatcacacggcattctccctctgtcttcgtatcccagtttcccctttgtacaaggacaccgtcatattggattagggcccatgctaatcaccttattttaacttgattacctctgtaaggaacttatttttaaataagatcacattttgaggtactgagggttaggacttcaatatatttttggaggacacaactcaatccataacatataacatccaggaagtaaaaagacaacccacagaagctgggcttggtgacacgtgcctgtagtcccagctacttgggaggctgaggccgaaggattgcttgagcccaagaagtagaggctatcgtgagctatgatcatgccactgcactccagctttggtgacagaaggagaccccagcccccaaaaaataaataaatagatgacccacagaataagagaaaatttttgtaaatcatatattttgataaaggtgttatatctaaaatatataaagaactcttatggctaaataataaaaagacaaatcatccaagtgaaaaataggcaaaggatctgaatggacatttctctgaagaagagaaaatggccaataagcacatgaaaagatgctcaatattattagccattagagaaatgcaagtcaataccacaatgagatacctcttgttacccactagaatggctgtaattttaaaaaatggaaaatatgcataggcaaaggtggaaaaattgaaaccttacatacattgctggtggggtgtaaaatggtataactgctttgaaaaacagtctggcagtgctttaaaacattaaatatagaattgtaatatgacccagcattccactgctaggtatatacccaagagaaatggaaacatgtattcacacaaaaacttgtacatgaatatttgtagcagcattattcataatagccccaaatggaagcaaccaaaatgtccatcaactgatgaatgggttaacaaactgataagtagacatacaaaatcatacagtggaatattattcagccataaaaagtaatgaagtaatgatacacagtacaacttgaatgaaccttaaaaacctactaagtgaaagaagtcacaagagactacatattgtatgattcagtttatatgtaatgttcagagtaggcaaacccatagagacagaaagtagattggtggttgcctagggtttggagtgggggtggggagtaggggttggggaaaaatggagaatgctaataggtatagagtttctttttggggtgatgaaaatgtcctaaaatttattatggtgggtggttatacaactctatgaatactaaaaaccattgaattgtacactttaaatggagtcaatgtgtggaatgtgaattatatctcaataaagtggattttgaaaacctaaagaagactgaggggtggaggatccattctgtattcgtatataagttaaaaaaatgagatctaaaagttatataccaagcccggtgtgatggctcacacctgtaatctcaacactttgggaggccgaggtgggcagattcgttgagcccaggagttcgagaccagcctgggcaacatagtcaaaccccatccctacaaaaaatacaaaaattagccaggtgtgtgggtgcatgcctatagtcccagctcctcaggagggtgaggtggaaggatcacttgagcgtggggagattgaggctgcagtgagcctgtgtttccactactgcactctgagctgggtgacaaacaagacccagtttcaaaaccaaaacaaaaccaaaacaaaaccaaagcaaaagagcatgcatataattattacagtaatctaaaattatggtttttatttgataagagtgatgggatgataagcctataattggcatattaagtttctagatggggatcgtttattttattttgtttttgttaggacagagtcttgctttgtcacccaggctgtagtgcagtggtgcaatcatggtttactgcagcctcaacctcctggggtcaagctattttcccatctcagcctcccaaggagctggttctacagacatgtagcaccatgtgtggcttttttttttttttttttttttttgtagagatgaggtctcactgtattgcccaggctggtcttgaacttctgagctcaagcagttctccaaccttggcctcccaaagtgttgggattacaggtgtgatcttacctgtccctgtttatatattttaaatggttaattctctgtggtagaaaaatgggaaattattctttttctcttcacactttcagtactttttttctgtttcaaaaagagataaatgaagttttgaccatctttcaaagctcaatttcttctaggaaactccccctgccactctcatcagatgtaatctttctctcctcttgctttcaatggcatgcatttgtgtctccatggcagtttttcttacccttcattgagttatcagttggacacctactgtatgctagatgctgaggacacagagacacaaactgtttcaaggaatagtgtattgtctttagggaagagaaaggtgcaactagttgtaatagggtaagataattgtacagagggcagtcagagcacagaggggccatcttattcctgctagcagtcagggaaagctgcttgcttttattgtgtgtgtattatcttttttggacttcaagctccttgaaagcatgaaacgaaagtataaatatgagcagaaattttttttagagaggggttcagctaggttttatattacttgtaattgcgagtaataaatgaagtcaatattttcttacggagcacattgtattttgatttttaaaaatagataagttcagatagtgaaaaatcaaaatggcataaaaagctatacactgaaaagtctcactgctcatagccccaccccactcccacctccacccctcacataccctgttggaagccacttttattattttcctgtatctttccagtatttttttttgatggagatacaaacaaatagaagtaaagattctttttgtttttccaggaaaattcccagatgtttcaaggtagaccttgcaagaatatgtatcctaatgaatattttcctcatggaataacaaatggagctagttggtataatgtgccaggtaaagattcttttatatcaaggccttacaacttgatggcctttctgctttcctagatggtgcttcttgttattatcttttagttttgaggaataataattatttttaaaacatggtttaaatagtttaaaatatttaaataatcttttcaactacttttatgtttgatgtacgttgagggttgagtaagaataatgcactaaaacttgattaaatggttacattttacttctggctattagaaagaatcttacatgtgctaatagaagagtgtaagctatatttgaattctttttttttttttctttacaacgttactttcttttttttttttttcttttctttttttattatactttaggttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccctttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctcctgcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtataaggaagggatccagtttcagctttctacatatggctagccagttttcccagcaccatttattaaatagggaatcctttccccatttcttgtttttctcaggtttgtcaaagatcagacagttgtaggtatgtggtgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtaaatccatctggtcctggactctttttggttggtaagctattgattattgccacaatttcagctcctgttattggtctattaagagattcaacttcttccacatgaaggtataggtgttttgcttgtatcgcaagcatcaaagtgccctcacatgaacacgttagcttatcaatgctgataagagataaatttggctttttactaggaatgttgcttaccttttgggatctgagctgtttagaacttcttcagagtgactaattttaatttttatcttttaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggtgactattcaggagtgaagtatgaaatttctcccgagggtgaaaagatttttgtgcgtacacgtggtttttgtgcagtgattttggaatacactctttaaaatttcaattcattttagtatatttaaccagtttgtatattccaaggtgtttaatatatttatctagaaaattcgtgaatggaaatgagtttatttgtatatgtgaggaaaagttgaagaaaatgattgaacaaggtagtgatattttgctcttaagggttagtggtcactttttacccgtgtttaaaaaagaccagcataaattggatacacacctaatcattggccaagtgatagaaagatgggctgtggagtgaatgtttttattctttttcttgttgccagtgatttactgtgaaatgattaatttccttttgtttggatatgtgtggtggccagtaggtaaagattataagaaatatactaatgttaattaggataatcagactaatactttctgccagtacatttctgcatttttctttttcctgagtggtgtgacataaagtctgtgagtttttttttactatatttaaagacattttattctgaaaaattttaaatatacagaaaagttatgactagccaataattattcctatacctagatttaacatttttaacattttgttatatttgctttattttaatgtaaattttatttacacactcacatacacatacatatttttgactgaactattgtaatataaattgcaggtatggtattttacccctaaatatttcagcatctatctcctaaaaataaggagctactacatactatctctaagtgctactgtcctacccaagaaaattaacagtaattccctaatattacctaatacttagtttatatttaaatgtccatatttgtccccaaaatgtaattttacagctgtattttatgaccaggatctagtcaagtttcatgcattgcattggattattatatctctttactattctttgaactataagagtccttctgtttttaaaaaatgccatttccttttgaaaaggccaggtctgttttcttgtagaatgtcatatattctgaaatcatcagaatgtgctaaagtttaaacagtgttatttatattcttcatgataaagagaaacaaagcctatgaaaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacgaaaaaaaaaaaaaggaaagattcctggggtaaatattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcctttaaaggagtaacagaagtgttagttgatgaagcacaaagaacatagaaaatgcatagaaagaacatttctcgttcttttaatttgctaaatacaggcaagcccaaagcaatgcagtctatttaacatgctagtaacttttttttttttttttttttttttttgagacagagcttctctctatcgcccaggctggagtgcatggcactatctcagctgcctgcaacttctgcctcctgggttcaagggatgcttgtgcctcagcctcccaagtagttgatattactggtgtgtgccaccacacccaactaatttttgtatttttagtagagacagggtttctcttgtagttttcttttttatcttttgataagtatagatgttaccacaggatattttcccttcctcctgctagctaacttatttctgaagagttagtttgaatacccattgaagtaagggtaaaatatgaaagcattttagtcgttgcctttgttttttaatggttttcagatatctagtggtccgtaaatgaatgggttagaacctcacactaatgagtaatgaggtcttttctgtgattcttccatttttggcagagtgttaactaaagcagcaggggatccgagaaacagggtgagaaggatgtgtttggcagagaatgtcataacctagcacctctgcaactttcccacccgtataccctgatagaagacaagtgaatttaagttccaggagacatgggagtatccactacaagcactaaatttcttttgaagccatatatttaatcttaaaaacctaggccaggtgcggtggctcaggtctgtaatcccagcactttgggaggcagaggcaggtggatcacttgaggtcagaagtttgagaccagcctggccaacatggtgaaatcctgtctctactaaaaatacaaaaattatccaggcatggtggtgggcacctgcaatcccagctactcaggaggctgaggcaggagaatcacttgaacccaggaggcggaggttgcagtgaactgagatggtgccactgcactccagcctgggtgacagagcaagactccatcttaaaaaaaatcatgaaaaaaaatccattcatattttgtaatatacccatgtctattctttattaatgtattaaaaataataaattactcaacgttaaaattttgtctctttaggaaactgcaccacatttatcccaaggattcttacgttctctgcacacctgccttcccagggtttgggtactccagctgcaggagtgtggttctgatctgtctcctttatcataggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaagtaagtgtcactttctattgtctttttttttttttcaagacagtaaaatcagcattagccatgttgaatagttgtaatttatatagaaatatttgggaacagaatgtacagagagttggagtttacttattttgcaacatgtatttgcttggagatcttttttttttaattatgctttaagttttagggtacatgtgcacaacgtgcaggtttgttacatatgtatacatgtgccatgttggtgtgctgcacccattaactcgtcatttacattaggtatatctcctaatgctatccctcccccctacccctaccccacaacagaccccagggtgtgatgttccccttcctgtgtccaagtgttctcattgttcagttcccacctatgagtgagaacatgcagtgtttggttttttgtccttgcgatagtttgctgagaatgatggtttccagcttcatccatgtccctacaaaggacatgaactcataattttttatggttgcatagtattccatggtgtatatgtgccacattttcttaatccagtctatcattgatggacatttgggttggttccaagtctttgctattgtgaatagtgccacaataaacatacgtgtgcatgtgtctttatagcaccatgatttatagtccctttgggtatatacccagtaatgggatggctgggtcaaatggtatttccagttctagatcccctgaggaattgcaacactgacttccacaatggttgaactaatttacactcccaccaacagtgtaaaagctttccagtttctctacatcgtctccagtatctattgtttcctgactttttaatgattgctattctaactgatgtgagatggtatctcactgtggttttgatttgcattctctgatggccagtgatgatgagcatttttttgtgtgtcttttggctgcataaatgtcttcttttgagaagtgtctgttcatatccttcacccactttttgatggggttgtttgtatttttcttgtaaatttgtttaagttctttgtagattctggatattagccctttgtcagatgagtagattgcaaaaattttcttccattctgtaggttgcctgttcactctgatggtagtttcttttgctgtgcagaagctctttagtttaatgagatcccatttgtcaattttggcttttgttgccattgctattggtgttttagacataaagttcttgcccatgcctatgtcctgaatggtattgcctaggttttcttctagggtttttatggttttaggtctaacatgtaagtctttaatccatcgtgaattaatttttgtataaggtgtaaggaaggggtgcttggagatctttttaatagtgaatcttgggaactttaaggagaattacttgttagattagaagtagatagcctgtgattccaggaaatgtaaaattgctcttcctgataattattttgactgattgtaaaaccctttccatcactcagctacagatctattaatatgttctgactaaatattgtttagtttgttttattttgcttggggcaagggaggaatttagaactgtaagctcacctgttagggattatgtgtaactttttttttttaattagaaaatgaagcctagttgctgtcctaattctagtctctattcacagtctcttacttgaagctttagggacatgtgtgatcgtgggtcccagggaaaacatacagtcctggcttatgtaaaactgatagctgagatagcctttaccttcactttgtggtggttgctctgcctcacttgcactgcttcattttagattttgttacagttactccaaaattatttctatgatttgttgattcctatggtttgcctgttgtagttaaggtctttacattttgccttgagcatatagttctctgctgcaaacctcatgaacattatttagccttttacctttttactttgtctttcttcatgggtccttttaatttcatcagaaaacttagttcctcaaattctgatttataatattcatagatgcagagtgatacttaactttctttggcaataccaattacttttcttccttaactgattcttggatatttctggctatttcaggttttaatatcatacaatcttagtgccatagagttcatatacttttttattttaaaataaaaccaggctgggcacagtggctcacacctgtaatcccagcactttgggaggcccaggtgggaggatcgcttgaggccaggagctccagtttacgttgaactatgatcacaccactgtactccagcctaggtgacagtaagatcctgtctctaaaacaaacaaaaattgggcattattttgctgtctgtttacttagttgatttaatttttttaacctcctaattcaagacacactttttagttaaatattttctcaaaatatgccacacatgccagtggtggggcacaagagagttttaggtggtacaccaacaggcactaagtaccattgaatagcgtcatgagaaagcaataaggtttctgttaatttttctcaatttaatatgattatttttttctgtccaattcttgtaaatctccctttatgctaaagaaagcagaccttaagctcaaagctcttgggcaagcagagtatttgaccattgtttaattttcattgaattagtatttttttccccactcaaattacttttactgtgaaactggtgttgcatttatagtaaaatataacgtgacttatttacaaatattaattttgattaaaaagggagggccagggtggtggcgcatgctgtaatcccagcactttgggaggctgaggtgggaggattgcttgaggccagaagcgcttgaaaccagcctcagcaatatagcaagaccctgtctctacaaaattttttttaaaaaattagctaggcatggtggtgcaaacctgtagtactactcccttaggagactgaggccagaggatcacttgagtcctggaattcaaggctgcagtgagctatgatcaagccattgcattccagcttgggtgacatagtgagaccctgtctcttaaaaatataatgacaataatataaataaataaataaataaataagggaggttatctatgttcatacatacttaaatatttctgtaataaaaatttaatttgtgagttagtacaaaatatattaactaaatagtagtgtagattaaagaagatagggcaaatattgtgatgattgtatgagaattactgaatttggaaggatggtaaactaaatcataatctttcctaaatctttcctaaatctgataatatcatctatttgataaatgttctttggtcaaggaaaactaattttcttaaggttttctgatgcagtgattcactctttaaagactttttaaaactttttgtgttttgttttcatttctatttttaaagtccataagtcaacattaacatagtgcttgattacttgctgatttttttgtttctggtttttgaaagtttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaagtaagagaatagccgaggttgacatgctttaaaaggaaaaagctcaacattaatatcagggcaccatttttaaaatttttaatttcttgctagattttacagagtcacttgtagtacattatgaactttactctttaaaaatgaaccatctttgtagtatataccctttgttaatagtgtctttctattatatttccttgtatgtcttaagaggcatgcaggaaagaatactaaaaatttacattcaatttcctactccgtcatttaatagccacactacccttccagtctttattcatagttctttactttttttttttttttttgagacagagtcctgctctatcacccaggcttgagtgcaatggcatgatctcggctcactgcaacctccacctcctggattcaagcaattatcccgcctcagcttcctgagtagctgggactacagatgcccaccaccatgcccggctaatttttttatatttttggtagagacggggttttgccatgttggccacgctggtctcgaactcctgacctcaggtaatccacctgctttggcctcccaaaaatgctgtgattacaggcgtgagccatggcgcctggccagttttttacattctgacttgagggacttccattctgaattacttataactaggacactatattgaaaaatctagtgaaagcctagtttttcagtatagttttctttttcatgtaatacataaaaaattattggacatcttggctgctaagagattttagaaaaagcaatatggtgttatctactttagcaatctgtgactacagaaaagaactttgactggggtgtgatggctcatgcctgtaatcacaacacttcagggggctgaagagagaggaccacttgaggccaggcgtttgagaccagccagagcagcagagtgataccttgtctctacaaaaatttaaaaaattagctgggccttgtggtgcacacctgtaatcctagctacttgggacgctaaagtgggaggatcacttgagcctagtaggtcaagactgcagtgagctgtgattgcaccactgcattccagcctgggtaacaggctggaatctcaaaaacaaacaaaacaaaacaaaactttgacccagaggcttgggcacgtatgattaagcatcctagttgtacgttgcctcagagaagggaaggaaagagtgaaacactcactaattggcactgtccatagtggacttaggaaagggaaaaagaactgatatttattgaatacatattttgtgctgggtaatataccaggtattttatatacgtcattatatcctcaaccctgtgataatgattatctccattttataaatgtagaaactgaggcagtcccacagctagaaactggtaaaactagaatttaaacccacgtatgtctactttgaagcccagtgcagttctgcctccccaaaacaaattgggaaagaattgatgtcatgattaggatcagaagggacctgtgtaattaggtgacatgaacttaaatcagactgaccaaaaattatgttatcttcctttgtgggacaggtgctctgtgttgcgaacttactcaactctgccattagagcacaaaacagtcatatgtaaatgaatagtcatgcttatgtgtcagtaaaactttatatacaatagcaggcaccaactggatttggcctgctgttagtggtttctcacccctgttctaagtcactggaaggtctctgggaacattagctgtacagtagttttttgcttatttttaatatatttgaagcaaaaggaaatttaattttttattttttcattcatcttagttctgtcttttaaattaactatgtgtagaataaacagactttctgtttgaggcatgagagggtacccattgattctacatgcagctagtaactcgttaatttctgtttctgcttcagttggttgacaggactaggattgtgattgtcccttctctaaatccagatgggcgagagagagctcaagagaaagactgtacttcaaaaataggacaaacaaatgctcgtggcaaagatttggatacagacttcacaagtaagactaatttttaggctactaaagtacttaggagataattttctttctgctagaagattgattgatcctattttgtcagtgaataatggagtactttcttgtctgggttatgaatgtgaggtataaatgaattcagacatctggaaaagtttttgaatttttctccattattatttgcaaaaataatttaagtttttcatagaaattcaatccattatattgggatgtttgtttcttcactagttgtgtagagatgtgtattctctctcccctcctatgtatgtgtgtatgtgtatacacgcacaacacacacgtatgtatattgatttggagagccctatttcttatttacttaaatgggacctttttcattgaatatgtatcattgacatggttcaatttcagtacttatagatctctaacattctttttcttttttttttttttgagacagagtctcactctgttgcccaggctggagtgcaatggtacaatcttggctcgcctccgcctcttgggttaagcaattatcctgcctcagcctcctgaatagctgggattacagggacccgccaccatgcctggccaatttttgtatttttagtagagatggggttttatcatgttgaccaggctggtcttgaactcccgacctcgggtgatccgcctgcccagcctcccaaagtgctgggattataggcattagccactgtgccaggcccaacattattttctaatggcatctagtatgccatgaatctatgacagtactcttaatttattcaaccattttctactgatagatatttactttatttctgattttttgcttttgtaaacagtgctgcagagaacacccggctttctgaaactctaattttcttccaaagataatgtatttgtccattttcacactgctgataaaggcatacccaagactggaaagaaaaggagttttaatttgacttacagctctacatggctggggaggtttcacaatcatgctgcaggatgaaagccacttcttacatggtggcagcaagagagtgtgagaaggaagcaaaagcagatctgataaacccatcagatctcataagacttattcactatcacaagaataatacgggaaagacccgcccccatgattcagttacctcccaccggctccctcccacaacaagtgggaattctgggagataaaattcgagttgagatttgagtggggacacagccaaaccatatcattctgccactggcccctcccaaatctcatgtcctcacatttcaaaaccaatcatgccttcccaacagtcccccaaagtcttatttcagcattaactcaaaagtccacagtccaacatctcatctaagacaggtcccttctgcctctgaggctgtaaaatcaaaagcaagttagttacttcctagataaaataggggtacaggcattgagtaaatacagccattccaaatgggagaaattggccaaaatggaggggctacaggccccatgcaagttcagaatccagcagggcagtcaaatcttaaaagttcaaaaattttctcctttgactccatgtcttgcatctaggtcatgctgatgcaagaagtgggttcccatggtcttgggcagctccacccctgtggctttacagggtacaggctgtctcccagctgctttcaccagctggcattgagtgtctgtggcttttccaggggcatggtgcaagctgtcgtggatctaccattctggagtctggaggatggtggccctcttctcacagctccactaggcagtacctcagtagggactctgtgtgggggctctgatcccacatttcccttctgcactgccctagcagaggttctccatgaggggcctgcccctgcagcaaacttttgcctggacatccaagcttttccatacatcttctgaaatctaggtggaggttcccaaacatcaattcttgacttttttgcacccgcgggctcaatgccacatggaagctgccaggtctcggggcttccacccattgaagcaacagcccgagctgtaccttggccccttttagtcacagccggcacagctgggacacagggcaccaagtccctagattgcccccagcacggggaccctgggcccagcccacaaaaccagtttttcctcctgggcctccaggcctttgatgggaggggctgccgagaaggtctctgacatggcctggagacattttccccatggtcttggggattaacattaggctcctggctacttatgcaaatttctgcagctgggttgaatttctccccagaaaatgggtttttcttttctattgcatagtcaggctgcaaattttccaaacttttatgctttgcttcccttataaaactgaatgcctttaacagcacccatgtcacctcttgaatgctttgctgcttagaaatttcttccgccagataccctaaatcatctctctcagattcaaagttccaaaaatctctagggcaggggcaaaatgctgccagtctctttgctaaaacataacaagaatcatctttgctccagttcccaacaagttcattatctccgtctgagaccacctcagcctggaccttattggtcatatcactatcagcatttttgtcaaagccattcaacaagtctctaggaagttctatgctttcccacattttcccatcttcttctgagccctacaaactattccaacctctgcctgttacccagctccaaagctgcttccacatttttgggtatcttttcagcaacacctggctctattggtaccaatttactgtattagtctgttttcaaactgctaataaagacatactcgagactgggaagaaaaggagatttaattggacttacagtcccacatggctggggaggtttcacaatcatagcggaggatgaaaggcacttcttacatggcagtggcaagagagaatgagaaggaagtgaaagtggaatcccctggtaaacccatcagatcttgtgagacttattcactatcacaagaatagcatggcaaagacccgcccccatgattcagtcacctcccactgggtacctcccacaacacgtgggaattctgggagatacaattcaagttgagatttgggtgggggtacagccaaaccatatcagataggttatttatatattccctaaattattttgtaaagctggatatgcttattctttttgtttttttaataagatttttctttaacttgcttagagtcattagtatatacacatcctgaagtacataataaaactcagactaacctaccttctgtaatgtatctttcttgcttgagatagtggcttatggagaaataaaatatttatctacaaatttttaagttagcattttgattgtattcaagtagagaatattttcttagatactcatactaagatttaaaatttgatattttatatttgacttttctcttttttagataatgcctcccaacctgagaccaaagccatcattgaaaatttgattcaaaaacaggactttagtctttctgttgccttagatggtggttccatgctggtcacatatccttatgacaagccagtacagacaggtatgtagaatgtcattttatatatatactgtttaagcttaggtagcaaatcccaattaagtaatgtcccttccacatttttataaatagtgagcatttgagcacactctatgagcaaattaccaaccaaagaagattgtacatacatcagcagttcagttacttggagagctcagatctaatggtagcccagctttattgagtctagctatcttgttccatctgttccatttagtccacaagcatttactgagcaattattatgtctgtaaatattgagaatataaaagtgagtatgacacggtttctgcctcatgaaactcctatgtaaccaaatactaacagtacagatttgtccttccctgttttaaactttgactaagtggttgcaccttatggtgagttaaatagttggttgtttaatctctgtggggtcgcagtatatggagatagtttgggtggttttcagtgcatcttacaaagaatattgttattaggctacagttgtcccaaaatgcagtaagacataccaaaacaagtttgtattttagtgtgatagtctgttgtgaaaactcaccattagaaccttttcatgtaaagaggatgtttgtcttctattatcttgggctaaataaaaccttttagggttaattatagtaacagtatacttaagtggagtgcaaaatttattaggagaaaaagatgacttgtatccatgaaggttaacttgggggaaaaaaatcatttggatttctccactgacttctaaatttttctttctatagtggaaaataaagagactctgaagcatttggcatctctttatgcaaataatcatccatccatgcacatgggtcagcccagttgcccaaataaatcaggtagatgttttccataccttttgttattgctgttgttgttgttgcttttgtggggaaaggagtttcaccttaaggtcttcctgattccacatctcttaatgcttttatagatgagaatattccaggaggagtaatgcgtggagcagaatggcatagtcacctgggcagcatgaaggtatgctttctagaacatggttagaatggagttatggccaggcacaatgccgtatgtgtaaacccagtgctttgggaggccaaggcaggtggattttctgagtttgggagttcaagaccagcctggccaacatggtgaaaccccatttctactaaaaatataaaaattagctgggtgtggtggcagacgcccgtaatcccagctacttgggaggctgagtcaggagaatcgcttgaacctgggaggcggaggttgcagtgagtcgagccgagatcgcactactgcactccagcctgggcaacagagcaagattccatctcaaaaaaaaaaaaaaaaaaaaaagaatggagtttatgaatatcagccattgagtacaagaataggtgacttttctggtattgtaaagtgaatggcatctgcctcatggctttcttgacatgtttagcccttacattaacccgacagtacttttttggccattttaaccatttttaattgtacagtttagtgacattaattaaatgttgtgccccaaaaaccatatctatttccaaaacttcatttgccccagacagaaactctgtacccactaagcaataactccctattcccctctcccacggctcctggaacccctgtctactttctgcctctatgaatttgcctattctaggtatttcatgtaagtagaatcatacaatatttaccctttcacttagcaaaatgtttttaggattcatccattttagagcatgtatcattacttcattcatttttatggctgaataatattctatttatgtttataccacattttatttgttaattcatgtgtcgatgggcacttggatttctactttttggctgttgcaaatgatgttgccatgaagattggtattgcaggtatctgtttgaaccctgtgctgccatgaacattggtattacaagtatctgtcacttctttggggtagatacctaggagtggaattgcctggttatattgtaagtctatgtttcaccttttgaggaaccaccaaactgttttccacagcagctgcaccattttacattccttaccagcaatgtttgaggtttccaattttcccatatcctctcctcaccaacacttatttgctggtttttttttttttaaacagagtctcactttgttgctcaggctggagtgcagtggctatggctccttcgcagcttattgcagcctgaacctcccaggcccaagcaatccccccacctcagcctcctgagtagccaagaccacccgcatgcaccaccatgctgaaccaattatttttaattctttgtagagacagggtctccctttgttgcctaggctggagttctttatatattaatataaaaggctgagcgtggtggtggctcatgcctataatcccagcactttgggaggccgaggcgggaggatcacctgaggtcaggagtttgagaccagcctggccaacatggtgaaacccatctctactaaaaatacaaaaaaattagctgggcgtggtggcaggtgcctgtaatcccagctacttgggaggctgaggcaggagaatcgcttgaacttgggaagcagaggtttcagtgagccgagattacaccattgcactccagcctgggcaacaaacacgaaactctgtctcaaaaaaacgaataaacaaacaaaacccattctggatgctgtgtattctagataggaaattcttatcagatacatgatttgcaagtattttctcctattctttaggttaccttttaaatttcttgattatgtcctttgatacatgagtttttaattgtaacgaaatccagtgtacctgtttttgttgttgttgcttttgcagttgttatcctatctaaggatctgttgctaaatccaaggtcatgaagatgccccgccccaccccatgttttcttttcttttttttggagggcaaatgtgggatgagtgggaggggcggggtacatggcccccctgcccacctccctgctccctgccgcctatccttgtgttttctttgaagagttttatgggcttggcacggtggctcaggcctgtaatctgagcactttgggaggccaaggtgggtggatcatttgatgtcaggagttcaagaccagcctggccaacatgttgaaaccccatatactaaaaatacaaacattagccaggctgtagtgctgcgcacctgtaatcccagctacccgggaggctgtggcaggagaattgcttgagcctgggatgggaagattgcgaagagccgagatcttgccacttcacttgagtctgggcaacagagtgagaccctgtctcaaaaaaaaaaaaagaaaaaaaagagttttatggatcaagctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttatttttatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaacatgcggtgtttggttttttgtccttgcgatagtttgctgagaatgatggtttccagcttcatcagtatcactgttttgattaatgtaggtttgttgtagtaagttgtaaaattggaacgtgtgagtctttcagctttattgttcttaaagattgttttggctattcagggccccttgtcattccatttgaatttgagcattggcttttctttttctgagaaaaggggtgttggaattttgttagatgttgtgttaaaaccgtatatcactttgtgtagtattgacatctctacaatattgtcctcctatccattatttaggtcttctttaatttctgacagcattttaattcattgtccatccacttcaaattaggcaggagttgttagcagatgggtggttggctgatcattttattcacatgtgcaaccagaaaattgactttattcccatttctgcctgtcttccctcctttatttactaagaacttactactgggaggcattttgctatattagtgataaataaaatatactgcctggcctattgtacgaattaactgtgttacataattaattgatttgatctggaagagagcaactctcagcaggccgtgagaaattaaagacacaaaaaattatatctagtcagagatacagccttttctctttagaggagatggcatttgggctgcagagatagtgaagcagaacattccagaaagaggaagcagtacatagcagaagtctaatttagttagaatatggggtgtaatgcagagccacagaagtttaagaatggaaagagtgcttgttgctttgaatgctttgttttaataagaatgggaaactgaggttttgagcaggggtaacaatattgacatgatctgagctatgctatgggaaaactaatctctaaataatcagttaagatagtttggaggaaggagagactggtacagggagaccggtttggaattatctagacaaaaagtaatgagggcctaggttatgctagtggcaacgagagtagagtcaaaggatgacattttagatattctatagaggtagaattgacaagattcagcaaattatggatgatagtgagatagagaagtcaaagacaagaggtttcattgctatgtaagaaaatgagttaataccattaactgagttaggaaaaagaagagattttgggaaaaggtggtaagttgggtttttgaacctgtctgcacaggcagttcctgtaccttgataatatcaatgccgtattgcagggagtggatattgtcaccagcaggggtccaggttgagggtatgagagagctgatgatcattatctccatagcttcaagtacaactgtgacatttctgggttttgagggaagctgaccctcttctgcatgtactcattcattcatttcttcagcaaacccgaataaaccccatctacctggcactaccaggcactgtgggaagcactgaagataggaaaatgaattcgacatagcccctgtcctcaagggctctcatagagtttgtgattgattataatacagagaggtttatttatatttgtcataaaatgctttacagcttctttgtttacgtcagctacgttttcttttcatttactccatttgttgtattacaaagccttattctttcttttacttattaattttcccacatttgattttgaactttatattctaggattatagtgtcacctatggccattgtccggaaatcacagtatacacaagctgctgttactttcctagtgctgcacgactcccttccttgtgggcagacaataagagatctcttcttagtatgttagtggaggtgagtcttttccttttaactagaggcaaactcccaggaatatgttcagtgaaaacctttatcaaaacattgtcttttaccaaaaatgtatattatttattttaaatttatatagaaagaagagttttggtcattttatgtttcctaaatagatgccatttattcacatctctggaatctgctataatttaggtaatttgaccttgcaagatgctgcaagttctttaatttgaatatcacagagttactggagtcaatataccatggtgggaaggaaatcactcaaggcattagaagattgggttctaatgcttcaggctatgacaatatcagagttctcttttatttccagctctgtgagcctgaatattgaatgaatagcaaacaaggtcagagtcagtggggagggaagagaagaagcaggccatacagagtttgatacttgtttgtgtgtggtttttgttttgtttgtttgtttggttggttttggtcatgcctcaagctagtgcctctaccatgtctggcattatgacaacataaatttatattttaaacattttttcaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtaagaaactcaaattgagtagcatcatgtaaatttttattcttaataatacttctgttttattttgaaactcttgttagaaatcttgaagggaataaagaaattaaaagtgtgactgcctcttgattatgatatcttgttatccttgtaccccttgctaacaaaagggaaaattttctagcattttgtatactttagatggcaatgcatcatctccttagtttgctatatggggcctaataatatagcagggatacagtacaccttaagcagaatttgtcatgattcttacactttctccttctaggtctttgtgcatcatgatgcagctagttctgtggtgatagtctttgacacagataaccggatatttggtttgccaagggagcttgtggtaactgtatcaggtaaagacattttgatttttagtagtaaaagttaaaaacaatcttgacatttcaatatgagagtgggtcacctctctcatattgatcctgaaactaatcacttgtcttctaatgtctccttatctaaatgtgattttcctggacctctgttctcgcatatgttctcctggcttgcctttctctgccgagaccagctccatcaaggagaccctaacccagcggtgctagagaaattaaagacacacacagaaatatagaggtgtcaagtgggaaatcaggggtctcatagccttcagcgctgagaacctccaacagagatttacccaggtgtttattaacagcaagccagtcattagcattgtttctatagatattatattagctgaaagtatcctttatgggaaacgaagggatgggccaaaataaagggatgggttgggctagttatctgcagcaggagcatgtccttaaggcacagatcactcatgctattgtttgtggtttaagaacgcctttaagcagttttccgccctgggcgggccaggtgttccttgccttcattccggtaaacccacaaccttctagtgtggatgtcatggccatcatgaacatgtcacagtgctgcagagattttgtttatggccagttttggggccagtttatggccatattttggggggcctgttcccaacacttctctttcttcaggtctatactcaaacgtcacctccacggagaggctttccctgatcaccctagctacccctgtcactatctctatcctgctttttttcattatagcactttcataacattatatatttgttcatgtatttgtctatattcaatctctcccactaaaacataagttctgagagagggaggaatctacctgtatcctccaagcctagaacgatggttagcacgcagtgggtcttaatgaagagttgttgaatgaatgaatgatttgctttatattaaagtcataagttcctaggactttgacttatattagttccgctttttcaagatccaggaaagaggaaatgtttgtttacgctggaactaattcatgtcattgcttggattactgaaaggttaggaaggaaaaaaatgtggtaaaatgaatactctgctatactttatctatttgatacaaacagccttagtttatttctaagtgcagcttggatgaggcagaataaccaagttttatcacagggttcctgtgggagagacccttagttgagagaaagtagtatattggaaacatggcccaatcatagatcctgtgtggtgtgtttaaagggttcttagcttgtctcagataaagtgtaaataacttagtggttaaaaacacaggaggtagaattcagccatggtttaaatctggctctgtcacccattagctattgtgaacttagtttttattacttttagtttctaacacttttattttgataaccttgtacaaatttaaaataaacaaggagatttggatgaaatgaaagtttactggaaaggaaaagtataatagaagtcataaaaagcaggttgcagaacagtagacacagtataatttcattatggtaaaagaaaaaaaatacatgtacgtgcatatgcataaagaaagatctggagccaggcatggtggctcacgcctgtaataccagcactttgggaggccgaggcaggtggatcacttgaagtcaggagttctagactagcctgggcaacatggcaaaaccctatctctagcaaaaataaaaaaaaattagccaggtgtggtggcatgcacctgtggtactacttgggaggctgaggtgggaggattacacacacacacaaaagatcttataactaaaaatgatctctgggtaatggaaatgtaaatataggaggttttttggttttggcttttgttagtttgcttatctgtatttttaaactttgtatattgtacatatactgcttctataataataaaggttgttcttaagtgcatgaaatagaaataaaataaatgaggggtatattattaaaagttccattgtaagcggctgcttattaatatccttaaagtataatatcacccacatgatggtttttgtttgtcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttcca

SEQ ID NO: 11930 - DNA, 86947 bp, Human
catgaatcacccatgactatctgttttttggttttatattgctttccttgaagaggactgaggatactgtaccacttgaaatcatggtcactgttcataattttttcaacaaatatttatgacacatgttttatgttctagacattgtgctagatgttgggacaagatatgcaaagtctgagccctccaaggtgtgtatgacacaaaatagaataatcacgggaaatgttgagaaatgtcctggcttggatctagttatttctaatacaagaaactaagagaatgagacaggatctgattcttctgctcattgtaacaagctttagcataggcataggttgataatggatgtaggcatggggttagaatgccttgcccattcacatttatcttgtttggtttttacaaatgactctgttagtcgggaatgcagggcaggaattctctcgtagaagctggaactgaggttcaggaaaggtcagttgacttgcctaaattcgatgagactcctgccctattctccttactcgaagaggcctgagttaaatgcttaaaatcctcttcactgatggctcttcaggataggagtcagtttcaaatcttcagtgtaacggttttttaaatgcttctcaaagggagatatcagagactttcctgaatcagaatcacctaagatgtattataaaaatgcatgctcttgatcaagacctcctctgacctacccaattagactccctgtgagttctgggaacttgcatcttaaactcccagggtgatttttctgcatgtaagtttaactgggagagttttaatgtaaagcttcggtttgtttttgtttttgtttttgtttttgagacggagtctccctctgacgccaggctggagtgcagtggcgcgattttagctcactgcaacctccgcctcctggattcatgcaattctcctgcctcagcctcccgagaagctgggactacagggtcgtgccaccacgcccagctaatttttgtattttttttagtagagacgaggtttcaccatgttggccaggatggtctctatcgcttgacctcgtgatccacccgcctcggcctcccaaagtgctgggataacaggtgtgagccactgagcccagcccctggaaagcctcagctttgatgcagggttaacatttgcctttgggacatatttcgtcagcatctcaaagagtaacccatatgtccttgagcagatgggaatgcaacagccttctggccggaacctgtctctttctttctttctttcttttgagacggagtttcgctcttgttgcccaggctggagtgtaatggcacgatctcggctcaccgcaactccgcctcccgggttcaagcgattctcctgcctcagcctcccgaatagctaagactccaggtgcgcgccactacgcccggttaattttgcatttttagtagagacggggtttctccatgttggtcaggctggtctcgaactcccgacctcaggtgatccgcccgcctcggcctcccaaagtgctgggattacaggcgtgagccaccacgcccggccacttgtctcttttttatgcaagtgttttttggaatttgggggttcaggtgagcaggtgctctgctgctggtaactactcgcagttaaagatcttttgactctttccccgacacgctatttgtcagtgtcgttttccaccacagagccaggtatttgccccgccggccacggtgaggcgcgcgaggcgtgtgctgccagcttctctcttccttccccggtccgccttcgcgcccttaaggagacagtccctgggagtttctgcctttggtctccagttattgttctcttctcgcgagaactgctcctcccatcctcttctctcacgaagccccgcccgcggagaggttccatattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtggtgagtgtcgctgggcctggggccgctgtgggcagggtggcccctcgcgcccgagggccaggcctgctccactgctcagcgttgcgtcaagtggcaggaattttcctcgggggagggcattgctgccccttcgagctctgcccgttctgcacctccagcacccctcgccctgcactcacgcaggtatgcggtccaccgtgtgcagcactcaggtccgctgcgagaggtaggtggtggtgctggagctcggttctggctagcaccctgcgccttcccctctcggagggttgctgctcggcaacaggcaccgggggaagggccgcttccttgggggtctccctgcctacctggagcagaaggaccctctcccgtgatgcgcccacgctggggctccggaccctgggtcctctgagcagacaagctcggggaactgccgggagaagcagaagggcacagcccaacccgaagactgcggtcatctgaacaaaactgaccaggaagggagctctctccgggcctttttttttttttttttttttcaaaactctgtcgaaatcccatcttgaaaagcgttctttttgaattcgcacttgaattaacagcgatccatagagcttaaaataccgactttatctcggtgagcactgtgccagcttgagtggtgtgtttccgattcggttgaaagcgtatttcctttccgtggaggggcggcggtggtagtgcctgcaagaacactgcagcttgagaaactggcaggctcactgattagtcacataccactgctcatttaagtattgttcgacaaaacaattttctcatttggagcaagaaagattcagatctgtaaggcgccctcaagatcaaaaagttattaacagtgctgggaggtattgtaaatattttttgagataattcctgcgaatactgtgttttaaaagtcccttagagagcttgcagggagttatctagttatctgcatttatggcctgaggtacacgatggttttcgtaaggatatggaaccacatagaaaaggaagggaagagatactttttagctttaatttacaccgtgagtgtgttttaaattaagtcgatagcatataatttccagacctgaaatatttcactaactgctctcttaacttccaaggttttataccctgtattttagattttctataatttgaaagctacggatcttaaactaagtatcagatttaactgttagctttttctgtgttttagtaattcgtattgtatgcgtcatttgaaaacgggcctgtaaaatcgtttttttgttttggaacaaattccaggcttttggatgtgttaatctttaaatatgatttctgtgtttcccaaagtcacatcatgaatttcctgtttggtagaatcttctgggtaattgagattgtgcaattgtgtccagcaacagatcatattgcattttctagttcaagttgcttaagttatgttgcagatagcaccgtgcttgacatctttctcccatttttacagcatggcagtttacattttaaaggaatttgcagcattttacattcagagagtgtgtgtgtgtagttggtttgcagcattttacattcagtatatacatattatataggtatatacattcagtatatacatattatataggtatatacattcagtatatacatattatatatatctagttgatttgctaattttcaaagacgtatttggatcattgctcttttaatattttatagctcattaatatacttccattttttcattcttgaattgacatacatttctgtagtatcacgttttcgttttcaatgctatttaaattttaatggagtgatacagcagaataactcaactatagagggtttgggtgaactccaattgaattgcttgcaagggttcgctactattggtgactagctctgcactggaacaggagattcagatttacagtgaagtaccattaaaattaactccacagttctttagtggtatacttttctgtggtatagaagccagcagtatctgacacttaaaagtacttttattttattgaacagattttttaaaatacattgacattgtataaaatttgaaagttttacaaaggtactcagtgggccgggtgcagtggctcacgcctgtaatcccagcactttgggaggccgaggcgggtggatcacagcgtcaggagatcgagaccatcctggctaacacggtgaaaccccgtctctactaaaaatacaaaaaattagccgcccgtggtggcgggcgcctgtactcccagctactcaggaggctgaggcaggaggatgatttgaacccgggaggcggaggttgcaatgagctgagatcgctccactgcactccagcctgggcgaaagtgcgagacgccgtctcaaaaaaaaaaaaaaaaaaagatattcagtgaaaagtctcctttcctttttgttctccagccactctactctctcaaagacaggcactgttaagtgtcttgtgtctttccagagaggcagttttttttatttgcttgtttgtttagtagtctttctactaaagggatttaagatgtaacctacagcatattggtgaaagaaaatacaactgaaactgaaattgtatgacaattgacaataaacaaattataactaatgttggaatgaaaataccagaatttagatttacaattaagtgttatcttattcagagattcagcgtagttatttgaagtttttcttttctttgagacgaagtctcactctgtcgcccaggcttgagtgcagtggtgccatcttggctcactgcaacttccacctcctgggttcaagcgattctcctgcctcagcctccctagtagctgggactacaggtgcccgccaccatacccagctaatttttgtatttttagtagagacggggttctccatgttggccaggctggtctcagactcctgacctcaagtgatctgctctccttggcctcccaaagtgctgggattataggcctcagccacggtgcccagcctgaagttgttctttcaatgagtacctttttaggtgtggcagaaaacattttttggaacttcttttagaatccactttggagcctgtgatattcttcttcttttttattttgagacagagtctcattctgttgtccaagttggagtgcaatggcaccatctctgctcactataacctccacctcatgggttcaagcgattctcctgccttaggctcccaagtagctgggatacaagtgcgcaacaccatgcccggatgatttttgtatttttaatacagacagggtttcaccatgttggccaggctgatctctaactcctgacctcaggtgatccacttgccttggcctcccaaagtgctgagattacaggggtgagccaccgtctctggccatccatcttcatttttttgagagcagatttgattttagggaataacagttcatttgaatccaaataatttagggaatttggactcaagtctgataagaaagataaggcaatcaggttggtgatactactgttttaggtcagataggagttataactataaagtaacaacacataattttttgtgtgacttcttgaactggacctgaagtctacttccaaaaaaatctccgaattttattttatttatttatttattttgtagagatagggtcttactgtgttgcccaggttggtctcaaactcctggcctcaagcagttcccccaccttggcctcccgaagtgctgggattatagggatgagccaccacacccagcccctgaattttattttcaagaatgaaaataaatgaatagaatatttcaatgaataaaattcattcattgaaatatttgtcagtttccgaattttattgctctaaagtgtggtatactttgtaacatttacaaattattttaagcctatattattttaatttatactaagtatagtaaaaaaacaagtagaagcctgtgtgataaccaactatgaatcaaaatagagttttacaaatatgcctttccgttaaagggtaaagggaactagactaggtcttgcagttttaaggaactttatgcattgtctgtgaggggaaatgaagcaaaattgtttaagaatacattgttgcaaagcattgattttggggttttgggacagaaggggagaatctttgtggtgagtttaaggaaatacaaacaggaacttaagtgcctttcctctggggtagggttcttccaggcccttgctgttgattagaggaggtgggacactggtaaccatgaaataggaggtgacagttgagaattactcttagatcttattcaactgtttattcaacagtgtttattgaatacctaccatgggccagatagctaggttctggaaatagagtgctaaacaagacagaaacaagacaatccattctctcctggaacttacagcctagtgggtttaataactacattttgtggattgcttgctatgttctagcattgtgctgtgcactttatcatcagcataaaaagtatataacaaaacctttggtaaaaggatagcaaaacttgctaagaaatcaaatacaacttcctaagtgctttgtggaacaagattattctagtataaaagaaataagtgaagctaactttttttaactattaatggccattcaccattttaaatctattttttttttttttagaatgagccagggcacaaagaaataaaagtgcatgattattaagtatacaagggtgactttcttgactcctgaccagtgagaagggtgtgccctttacttttctagtagtgatagtaggtccatgctgagctttccattcttttctttgtaaccaaaagtaaggtagttgcctgtatgttaccagtgccagtcaataagaagtctttaaacataattaacggcaagcatttgtattattgatgtataaagattgttttaagaaagagttcattcgaagctggctataaagtcattttattatcaaatcccatttttccactttttttttttttttgagacggagtcttgctgtgttgcccaggctggggcgcagtggtgcaatctcggctcacggcagcctctgcctcccgagttcaagcaattctcctgcctcagcctcctgaatagctgagattacaagtgcgtgccaccatgcctggctgatttttgtatttttagtagagacggggttttaccatgttggtcaggccagtctcgaactcctgaccttgtgatctgcccaccttggcctcccaaagtgctgggattacaggaatgagccaccacacccagcctccactggttcttctttaaaataagcttatcctggatctccaggttttcagttctgccagtttgatttcttgatactgaggagtactctgcttttgatttctttctagcccagtctcagagatgatgtgttgactttgcctttcatgggcaagagtgcagatattgctgagcccctggggcctagaattcaaagatggaagaattcactggggtagatcaccctcactttagaattaactgacatttttagggatttttgcagtttataaagtgttttcattcaaagcattatcaatcagttctcactagctccatggaggctcatatttattaactccattttatagatggggagctggactcattcattaaaggaatggcatacttgtcaatgctacttttagtagtctcctttctgatagatgtgggctgctgaggttgcgcggtggcaccttctcttatgcagttaacctcctcttgtgaaaaaggggttgctgagtcactcggaatagagcttgagtgtaggaaagcagttccaccagtgtcattgcccagtttatgtgaggggtaatgacttaacccatttaacccattagagtcatgtctcttcctcagaactgataaatcaaaaatgcactcattgcccagattaaaattttttctgaaggaattattaggcagtgcaaatagttaattcctgaatttatgaatcctattggattgaaattcttcagtgtacatttatgtaaagttgggactgtctgtacatgtttgtgttacataagtataggatataaatagaaataactgcctctccagccctttgaaaatacattagatttttgctttttgcagtaaaatttggggtaaaactgatttgttcttatctaagaggtataattactgcagtgctcagaaaagcctcattataaagtgggctcccctgacttggaacttagggatgtcttctcatggctgctatggaagtcatgcagctgtttcgtcaggaaaataaccaaaaacttctttaaacttggaaatgtttttgtaaaagaaactttcagtattcagagtagtttgtctttcacagtgcttccataaattaagcacaggcacaactcgttttattatgcttcacagataattgctttttttttgcaaattgaaggttagtgacaaccctgtggtaagcgagtcttttggcaccatttttccaaaagcatgtgctcacttcatgtctctgtgtcacattttggtaattctcgcaatatttctttctttctttttttttttttttttttgagacggagttctgctctgtcgcccagactggagtgccatggtgcgatctcggctcactgcaacctccgccttccggtttcaagtgattctcctgcctcagcctcccaagtagctgggactacaggcatgtgccaccacacctggctaatttttgtatttttagtagagatggggtttcaccatgttggtcaggctggtctcgaactcctgaccttgtgatctgcctgccttggcctcccaaagtgctgggattacaggtgtgagccaccatgcccggcagttctgctgggattacaggtgtgagccactgtgcccggcagttctcgcaatatttcaaactttctcattattattaaatattatggggatctgagatcactgatctttgatgttgctgttgtaattgttttgaggtgtctggaaccatgcccataggcagacttaattgataaacattgtgtgtgttctgactgctctgccaaccagctgttccctctctccatctcctaaggcgtccttattccctgagacacaataatactgaaattaggccaattaataacactacagtggtttctgaatgttcaagtgaaaggaatgtttgcatgtctcttactttaaatcaaaagctagaaatgattaagcatagtgaggaaggcatgtcgaaaactgagataagctgaaagctaggcttcttgtaccaaacagccaatttgtgaatgcaaatgaaaagtttttgaaggaaattaaaaattatattccagtaaacaaatgaatgattagaaagcaacacagccttgttgctgagctggagaaagttttagtggtctggataaaagatcagaccaaccacaacatgcccttaagtcaaagcctaatctagagcaaagccctaactctctttaattgtatgaagtttgagacaggtgagaaagctgcaaaagataagtttgaagctagcagagggtggttcataggtttaaggaaagaacctgtctccatagcataacttatagtgcaaggtggctgggggcggtggctaacacctgtaatttcagcactttgggaggctgaggcaggcagatcatctgaggtcaggagtttgagaccagcctggccaacatggcgaaactctgcctctagaaaaaatacaaaaatttgttttttatattttttggtgttgtggtgtacacctatagtcccagctgcttgggaggctgaggcaggagaattgcttgaacctgggaagtggaggttgcagtgagccactgcaaccaagtggcaaccgagatcgtgccactgcactccagcctgggcgatagagcaagagtacatctcaaaaaaaaaaaaaaaaaaatcaatagatgagaaattgcttctcaggaatgaataaataaagtagtttcttgaggtggaatctgctgttggggaagatgcttatgaacattgttgaaatgacaacaaagggtttagaatattacataaacttagttgataaagcagcagcaaggtttgagaggattgactcccattttgaaagtagttctactgtgggtaaaatgctatcaaacaccattgcaggctacagagaaatctatcacgaaaggaagaataaatcaatgcaacaattcaccgttgtcttatttttagaaattgccatagtcattccagtcttcagcagttatcaccctgagtagtcagcagccatcaccctgagtaggcagcagccatcaacactgagacaagaccctccaccagcaagaagataataacttgctgaaggctcaggtgacccttagcattttttagcaaaaaaatatttatttatttatttattttttctagatggagtctcgctctgttgcccagcctggagtgcagtggcacgatcttggctcactgcaccctccacctcccaggttcaagcaattctcccaccttagcctcccgagtagctgggattacaggtgtgcaccaccatgcccagccaatttttgtatttttaatagagatggggtttcaccatgttggctaggctggtctcaaactcttgacctcaagcgatcctcctgcctcggcctcccaaagtgctgagagtaataggtatgagccactgtgcccggctaataaaatatttttaaattaaggtatgtgcatatatatatttttttgacatactgctagtgcatacttaatagactacagtatcatgtaaatataacttttatatgcactgggaaaccaaaaaatttatgtcactcatttttttgtgatattcactgtgttgtggttgtctggaactgaactcatgatatctttgaggtacacctgtatgtatgtgttaaggatttacaaaattaaccagctttcccgtgcagtgttcaagtcttttaataatttattatagggaagaagaagtggtggtttgtaaattctgtacttgacaaatggatactgggttttgggcatgcttggctccaaggctgaatgttgggggaaagaagtataggagagtgaggagtctaggatttctaagttttggccttgggcaaatggatatattttagtgccattttctgaactttgtgttacaaagttacaaaagagtgttacagggtacaagattgtagagagaaaggggaaggagcataggttcatggtaatctccttgaggacaggactcattataccttgagtgcctaccatgtatggtttgccgtaagtgctggagatgaaatgtgaacaaaagagacaaaaatttctgccttaagaagctatattctggccaggtgcagtgagtggctcacacctgtaattcctgcactttgggaggccaaggtaggtttccttgagcccagtagttagaaaccagcatcctgggaaaaatggggaggctcctctactaaaaaataaaaataaaaaattagggatgcttggtggcacactcctgtagttccaactacttgggaggctgaggtggagggattgcttgagcctaagaggattgcttgagcctgggaagttgaggctgtagtgagctgtgatcctgccactgtactccagcttgggtgacagagtgataccctgtctccaaaaagaaaaaaaaaaggaagctatattctaatggggatggcagtggaagtagataataaacaaaatatatagtgtgtcagataagtgctgtggagaaaatgcaagaagggaaggagagtgagtgctaggatggctgttgcacttttaagaaaggtgaatacggtaagcatcattgataaagtaacaattgagcaaaaacctgaagaaggtgatataggacactggttggacatgggtgaggatgtgataacattctaggctgaggattagcaagtgtgcaaaagccctgaggtaagggccctgtgctccaggaaatagctaagagaccagtacagctagagctaaatgaaccaggggccaaatatagggagaaaagtggggtgaggagagggttgcagatatgcagggatcatgtagggtcttatttgcctttatacagactgtgacttttcctttaagtgagaggggaagccttggagggttatgaccagaggaaggacatgacctaaatcttgttttaacagattactgtgctctagggtcccaagtttttcgtttcggttccttacccattctaccctaaaccactactgtgaataggatagaacggtggagttagatgaattggtgcaagccctgacccatgctcacaactctcattccagcagtcccagagtgccagagccagtatttttgttgggccctagaaatttagggtattccagtccagctctttaaataacatgggctgactttactttttcaggtttttgttgccaaaaggaaggagcagagattagctcttgagtttagctgaaaaaggaagattagtctgctggcagattgagtgttttttaacttctttggcttttagggtttttcttacttttggatcatgttttaaaagtcatttttaccttctttcaacagttaaacatttaagttttatttgattttatttgaccctttttctgctttacattcctctgccttttccccattataatacttttagtagaggttagaccattgttatctgtcattaatgtcttagctttgaggccccaaggacttctctgttaaacttaaatatatcatatagattgaaagattatctacagacatgtgatcctataaaaacccatattatttattgtcctccctgcctttacagatgtaaacccctctcctcttttcatcagagctccccctcttttactgctctatcatcaggttgcagaaaataagttttcctgcaaacatagattcccatggcaacataacaaaaaggtaatagaacaaatgtttattttgtctagacctgctgtctgagtaccattagaccctgaacatgttggctcctgttatttgaatatgtggttacaaattccttattttcctcaaaacttacttctcttaggccttggtgatattgtcactgtgcctgtgatatgaaggaaggtgtgtgtgtgtgtgagtatgtgtgtcttactgtcattctactcaaaagtgtgtattgattgcattttcaaacttatggcttaaaatgtagacaccacacaatctgagcatgtgaagaaaaaaagcataccagttttgttctttgttttcgtaagttcattaatttaatatttccagtgcactatactagatattttgtttacagagattttaaaaaaaagaagggtccctcctttcgaaagtatcagtccaggctgggtgcagtggctcacgcctgtaatcccagcactttgggaggccaaggtgggcggatcacttgaggtcaggagtttgagatcagcctggccaacatggtgaaaccccatctctacaaaaattagttgggcatggtggtgtgtgcctgtaatcccagctattcaggaggctgaggcacaagaatcacttgaacccgggaggcggaggttgcagtgagccgagatcactcccctgcactcctgtctgggcgatagagcaagactcagtctcaaaaaaaaaaaaaaaaagaaagtatcagtccagaggagacatatttatgtttcctcatagatggctttggaagtcctctgtagttttggatcttgaagcattttaggttttggattttcagattagggatactcaacctgtataacccagggtaattcaacctattgacactttaggtgggataatgttttgttgtgggggactgacctgtgcagtgtagtatgtttagcagcatccctgtctccaactcactgtatactaatagcaattcccagttgtgacaaccaaaaatgtctagacattgccacatatctcttgacgggtagggagggcaaaatcacctttagttgagaaccacttatataaccctatatatttggattgataaccctgtatatttgattgagtaaaaactagatgggataacatgaaccttccacctgcaaaaaggcagaaatgctatactttctgcattataaattgggcctctctaaacatgatttttgttatttctaggagagtaacagcatttctaatggtcaaggtcctagctataacccaataagcttaatggatgggagaacttgcacaagcatgtttgcaagaggccaggtgtatcactggcacatttgagaaacaactaattagtgagggagacccaattttcatgaataattgtgttttgtcattgtcatggccccaacttagggtgttttgaattttttctggaaaggaaattagcatgaagtccaagttggtaggtaggtagcattttccctagtgtctcttctggtattctgtgtcctttctctcctgtcttctttcagtatttagcgttttcaaactcctagaaataaaatgctgtttagaagaccacaaagagagctgcacataaactaaggagcaagaagtagtacattgtgaattaattttctgtatgtttttgaaggttcttgcatctgggaaggcttgcttagttttaaaaatattaggtaataacagactgaaattttgaagatcttgtggatctcaggtagcagtaactcaggaagatcagccttctttgatttagaatgtcatttaggcacattatgtattctggtaccttagaagatacaatgccttttcctgaattatcattgctactgctttaattactttaagggtgtgaggcagtaactaactttagtgtcacaatgtatacatcttaacatttattgtgctcttttttttttttttaaacaccaccttaaagtactctgctattcagatttttccttgtgtttctctaattctcctatttcatccattggtcagttttttcttcctcttttctttctgctccatgatccattcttaaattttcttttctctttctgtgcatattctttttgaattcattatctgatagtctcaacaatggtcttgttcatatactatccttccaaatttgtactttcaaacctaatctcaagaatgactgatcctttggattctaaatctattgagatgtaatgtttcatgcttttccttgattactttcctacacacttcttgaagataccagagatgtagcactaacttccgttggaatgggattcatgttacaaacttgaatggttcagtttagatatgtgaagcggatgtcatcattagcactgatgactgacagtagttataaaaattacaatcaggaatgaaccaatttacctgaagttttcaataactctaggtattaatgcaacataattttgaaagtttgaaatatataggtataaatattgatgcttatattttagatttactgtagtgaaggaaatttgccagtcgtccatcagtgttaaatgcccaccaatgtgtaaaagaaatagacctaaaatattaataaattgtgtatatatgtatgaaggtattgatgtgtacagagaagtggagacattgtgagttatagtggtcagtatggttttatggagcagaaaggatttgaagattatttagaaagatgggtatttggagagaagaaaaggaaacattttcagacaagagaaaacataaaccatagaatagatatgaaaaggactgttctgacaggaggaacatctcaggtagggtgaacccagttgtggttctcattcttgttgtgcttcagactcacttgtggaacttttaaacatacctctggaaattaagaatgagatctggagtgggacttaggcagttgcatttctaaaaagtctacaaatggttctttaggtagtagagagctgttggagtttcttgagttgtgaactgtggaggaaaattgttttaaaattggtcttggtggagtgtaaagaatggattagaggaaacaaatgtattgctttgtcaaagtctcgtaaatttatgtgtgcctctgttcattttgactcctcggctagatttcttagttccttgaggtcataaacaatcagcttttaaagcttcagtgaaggaatatctttttttttttttttttttttggctgggttgggggacagggttttgctctgtcacctgggtggaagtgtagttacgcagtcaatggctcactgcagccttgaactcctgagttcaagtgatcttcctacctcagccacccaaagtagctgagactacaggtgtgtgccgccatgcccacctaattttttttttttttcgtagacacgaggtctcactatgtcatgaagttgcccaggctggtcttgaactcctgagctcaagcttcctcctgcctcagacttccgaagtgctaggattacaggtgtgagccaccgcacctagcaggaaacatcttataaaatcattctactttcatttggaacttgcaggctcgtgcctgcaatcccagcactttggcaggctgaggcaggtgaattacttgagctcaggagctcaggatttctaaaccagcctgggcaacatggtgaaactttgtctctaccaaaaatataaaaaaattagccaggcgtcgtggtgtgcctcagtagtagcagctactcgggaagctgaggtgggaggtttgttggggcctgggaagtcaaagctgcattgagccgtgatcatgccaccacactctagcctgggcaacagagcaagaccccgtctcaaaaaaaaaaattaaaaatgaaagtaagtttcattaaaaaatactatatatgtaattacagtggtgaaattgttttgtgattaaataaatactgttgtgttgacattaaaacaagatatttgagagttagcgaagatattaaagctaatgttttaaattttgagtttttaaagtcaatcttaaatctcctgctactctgaagaagataaatgtatataattttaatttttctatttcactaggtttgaagaatattttttgaggttcctaaatcaaaacttaagttccaatttttgcataaagttgcctttattttcaagacgttatttccaaaatggcaggacagagcatccgcttcagagcaacagtgatatttgcacatttacttgaatatggaaggaagaaaagctaggcttctgtaatagaatgtaacatgtgcagaaaaatatttccagtatgtcatttattgaaatttgttccaggtgctacaggtaaagagaaagttccaagttagtggtcttaattatttagttatttagaaggcaagttttgaagactattattaattatcctgattcagttggaaaaaaagcctgaaattgtatgatccggagaagaggtgtcatgtttttgcaaattatttcttctcactttatagatattcttttttctttttctttctttttttttttttttttttttttgagatggagtttcgctcttgttgcccaggctggagtgcaatggcacaatctcagctcaccacaacctctacctcccgggttcaagcgattctcctgtgtcagcctcccaagtagctgagattataggcatgcaccaccacacctggctaattttgtatttttagtagagacgggatttctccatgttggtcaggctggtcgcgaatacccaacctcaggtgatctgcccacctcggcctcccaaagttctgggattacagtcgtgagccaccgcacccggccctcactttatagatattctaatgaatttaatgtattaatgagactttgctaattcagtgtaactacagatttcaatatatttaaatatttccattaacttccaaaagtaaaccaaattgtgtttatcttcttagaagtcatctatgaccattgaaagaaattgtaaaatcacttacgatccccacaaattactcaaagacttgctgagtgattactcattcttcatattctgttgatgaaaacacagattgttttttgaggaaaatcatggtgcagtcgtttgtactttaatactctgtggacatgggcacttgtccagcaccttacctttcttaagaggttgtctccctttctctactcagctgatgttaaatttattgatctgccattaccttataacagaaaatctacaagtcaggtgcccatcatggaatataaacacaagttccctatatctctatacctatcaaaagctcagttgacagccgaacatggtggctcatgcctgtaacccaaacactttgagaggctgaggtgggaggatcgcctgaggccaggagttcgagaccagcctgggcaacaagcaaggccccatctctacaaaagaaaattttaaaaataataaacaaaaagctcattgatagctccagtcatctttggaggattgtctgaagaatatggagcttatctgtttttctaaatgtatttaagatttcctcttggattaagtctgtcagagaggccaggtatggtggctcatgcctgtaacccctgtacttattgggagtccaaggcaggaggatcacttagcctaggagttcaagaccagcctagggaacatagtgggaccctgtgtctacaaaaatcaaaataattagcgaagcttggtggcacatgcctgtagtcctggctacccaggaggctaaggttggaggattgcttgaggccaggaggttgaggctgcagtgagccatgattacatgactccactccagcctggatgacagagtgagaccttaaagaaaaaaaaaaaaagcaacaccgtaatattttgtactcctaccctctttgctaataatgaactgtattttggccttacgacagcaatctgtactgatggatgctctaaaaagaaaaccatctgaaacccactattatattcttttaaagatgttgattaggacatttttaccacattatatgtctccttcttgaacagacacagaatgaacttttccctggtttattacaggaataattatgcctctcttcagctctcctgagtacctggttggtttttattgtatggcttctgtgattcatgtcctaactgattctgttctctttgttaatggctttagtgagctttgagccaaatttgaggcctacctctaatgggtatttaaaaaggacctctggccgggtgtggtggctcacgcctgtaatcccagccctttgggaggctgaggtgggcggatcacgagatcaggagatcgagaccatcctggctaacacggtgaaaccccatctctactaaaaatacaaaaaaactagctgggtgtggtggcatgcacctgtagtcccagctgctggggaggctgaggcaggagaatggcgtgaacccgggaggcggtgcttgcagtgagccgagatcgcgccactgcactccagcctgggtgacacagcaagactctgtctcaaaaaaaaaaaaaaaaaaaaaaaaagaaagaaaggacctcatgatatatgctaacctcagctgtacagactttcttattttcccttaatcacttaccattttgtcaggttttatatatataattccagtctgctttaaatccattgtgaataaaggaaggtatacatcaataaatttagaagttaaacagaattatattaggatatatgaagaatctagtaacccacattttctatgtgtgtgtgacacaaggggaggcaagtatgaatgtgtaacaaaacattgaagtttatttaatgattatccttgtgtgttatgtactggattcacggtcagcagtagatgagtgagaatgacatcctaatattgtaataactgcttctaatttttatatttctttcagttattttttactataccaatgattttataaaatgtgaattaatttgataattttggaaaagttcatgtaaattcacaattgggggaaaaacttgttaaacagtatgtcctgaattttagtttggagaacctgtttatcataaagataatttcattttatgatgttgttcatgaaaacaaggttttacttgtagctctacttttacagatgtgattgagaggcgtatttgagctttgccatggaccaagctccttgccaaacctactataaaagttattacatttaatcctaacatatccaacagatgaaatataaacataattctcatttcatgaaagaatttaattaacatcctcaagattatatagctattaagtggcagaactggaattaaaatccagatagtctaattccaaagtcccagctcttatttaatcactctgttggagtattataaacatgtaataataaattgtgattgttggggtctatagggtactgattaattctagcctgccttttgctgaatagattcaggagtcaaatagagataaaaatatttacttttattagtaaagctggcatgcagagtgccttgggcgggcaactcaagtgggcttcttatttcttccccagttaattgaacttgcacacttaatcagtcagatcagctagaaaactgctgctgttccttgctccccagcaggcttaccaatggaggagagaagaaagtgttcagcttgcaggtggaaggcaaactctgaggtgggaagttgaagaagctgggtcccacaggggcaatggccatttttccagtctcaccagagctagtttagagaactgggtttagagatgagtatacatttacttgctacttttgagagggaagaagttactaatttatgggtttgtaggagcaatgggagtggaaaagaagagaaccaccaccctcttttatgtgagataaggaaggagtcagtgagggtgttgtgacagagtaatggcttcttagaggtccctaacaggttcctgagcaggtgactatttaaaccaatacttgaaggataaggatttagctatggggtgggatgggggcggaggagaagaaaatcctaggaaccaggagcagcctgtctgaatagttaaaagaactgaaaggagctagcagaacatagcagctgagagagagggaaagagtagcacaggaacaggtggaataatcagtggtgaccagatcacctgggccttgtaggccatcatgagaaatttgcattttactctgtatgccaaggagattccttgaatggtttgaaggaggggagtgttgtgatctaatttgtacttttattgctattttttatttttcatttttgagacagtctcactgtatcttccaggctagagtgcagtggtgccatcatggcgcaccacaacaaggttgagcagcttcagccttcctgggctcaagcaatcttcctgcctcagcctcccaagtagctgggcatggtggcccatgcctgactaattttttttttttttttgagatgaagttttgctcttgttgcccaggctggagtgcaatggcatgatctcagctcactgcaacctccacctccctggttcaagcaattctcctgcctcagcctcccgagtagctgggattacaggtgcctgccaccacacccagctaatttttttaaatatatatttttagtagagatggggtttcaccatgttggccaggctggtctcaaactcctaaccttagcctcccaaagtgctgggattataggcgtgagccactgcgcctggctgcctaatttttaatttatttattattatttttttgagacagagtctcactctgttgctaaggcttgagtgcagtgatgcaatctcggctcagtgcaacctccacctcctggattcaagtgatcctcccacctcagactctcaagtagctggggttacaagtgtgtgccaccacaccccactaatttttatatttttttagtagagacgggtttcaccatgttggccagactggtattgaactcctgacctcaagtgatccacccgccttggcctcacaaagtgctgggattacaggcgtgagccactgcacccaacccgttttttattttttgcagagacagggtcttgctatgttgctcaggctgatctcaaacttctgggctcaagcaatcctcctgccctggcctcccaaagtgctaggattacaggcttgagccattgtgcctggcataatttatatttttaaaagactgtattggatgcatttggaaagcatattagaaggaggtaggccagtgacatggactaatatgatattggtgaaatgaagagcagttgactttgagacgtcttttggaggtgaaaaccatgagacttgccaatagatttgaatgaggactgaggaaagggagaaatcaaggatgacaatcaaatgtctagctcgagcaactggatgaacagtccatttattgagataacagagccatggagaagaatagttctgggtgttttgaacttggtacgcttcaggtgcttatgtgtctttcttatggagacatcagggctcagagaagagatttcagtgagagacataaatttgggagttttcaatatatagatggcatttaatttaaagtcatgggcatagatgagattatctagaaagagaatgtgggagagagaagagggcccagtaccaagtcctgaagaactccaacatacagagtttgagtagaagcagcacatgcagtggagacagagatggagctgccagaggggtcatagaaaaccaatggaagtgttgatatagactccaggatggacagtatttagagaaagtggtgactatgtcaattactaatcttagaaaagtggatttggtagcagaggtcattaatgaccttgagaagagcagtttcagtggaattggattgaggaaagaatgggattgaaatgagtcagttgtgtagatgtgtgcttctcacaccttaagcggtatattaatcacctggaaatcttgtcaaaaagtaaattctattttagggcccaagatctcctttcctttccttttcctttcttttcttttttcctttcctgttgtctgcagagatcctgcattttctaatgagctcccagataatgtcaatgctgccggtccatggagcacactttgaatagcaaaggtataaattagtggttctcaaactgtaatatgtattagaataacatggagagcttgataaaatacagattattagacccacttcaaagtttcttattccattaactctggggtggtacctgagaattttcatttcttataaattcccaggtgaaactgatgctgctgatctgggaacctctggtgtaggtgacttttttggagaattttaactgtgatggagaactgttaagggaagtcttttgtttgttggctgaaggcggtaaacaagtagagcaaatttatgctgatgagaatggtccagtagatagggagacactgatgatgcaagagagaagaggaatgaagaagtgaaatccttgagaagatgagggaggtggctccaaagcatgtattgtggtcttgaattttgataagcaggggcatattcttagttatagcaagagggaaggtggagacgatgggtttatagatttggggctaagcaaatggagctcccctcctgatggtttctgttttctcagtgaaggcaagggcaactcttgagggaagagggtgaattggagatttgagagagaacatgtcaaacgatcattttcgagtaggaaaatgaacttactagaagaaaatggctttattgagagcctctttgagattaaggtcagaaactaagaatgaaaatctgattctacagtctttcttgttcaacctcagttccttggattcagtcatggagaattaagtggttgagattacccaaggttagactttatccaggtgagtacatcagagagacagacagacagagagagagaagtgcaagggagtgattataatcatggaacaggaagggagatgaagacagaagagggctgaaggatagaaacaagcaatgacaatgaggttaacaaattgttgtagtcagggtacaagtaaactagaggtaactaggtttttgatgaaaagcaaatgctgctggcattcaaaattttgtaggtggggcagtttttggtaggaataaaggtctagaatgtgaccatgaagatggctgggtgtggtggagtttcctagagaggtcaggaaacaggatgttgggtgtgccgttcacctggatgttgaagttgccaagaatgatgacagaagttgagagtgtagagagatcttctggatagaaactaacttttcaatgaatgatggaaaatttcaggtcagtggatacctgcagcagagagggatagtttatcagggttgtgagcaggaggtattttatagaacaaacggaaagtaatggtcctgaagtggtaacggctgccaaggaagactcctacgcacctgctagccaggaggtatctgggctattagagaatgctttctaatggcagggctataagagaagcagtgtcttctagaaatggcctagtttcagagatggaggggaggttcagaaaagaggttgaagatttataggagtttatcacaaattgggatttgaagattgagggtatgccataaaagtttgggagtgaaaggaagggcactggagtaggtacagagttgtaaaagcaagtttggcaggcagagagtttggtgataacagatgaccagaaagtcttggatacatgttagagactgagacaaactggaggatgaggcataatggaactggcccagacaatttctgttattactatttttttttttttttgagaccgagtttcactcttattgccaggctggagtgcgatggtgcaatctcagctcactgcaacctccgcctcctgggatcaagtgattctcctgcctcagcctcctgagtagctgggattacaggcacctgccactgcgcctaattttgtatttttagtagagatggggtttcaccatcttggtcagactggtctcgagctcctgacctcgtgatcctcccgcctcggcctcccaaggtgctggattacaggcatgagccactgtgcctggcgacgatttctaaaaataattaaaatacacatcgcatttttgctgtagatgtcctccatgatctagctgctgcctgcatctcttacgtcatcccttcccactctccccttgctccctgtgctctacccacacagcctttctgtctttctgtcactcactccagcatgccatacgtttcctacctctgtttcttttttcgtttgtttgcacttgctcttctgagagatagcagagtcaagtggtcagtagcataagctctggatccagactccctgctctgccgcttttaagctttgtgaccgtggtcaagttacctaacttctctctgcttcagtttcttacttgtaagtgggagaatgataatagtacttatttcataggggattcggggaaatacaaaagctgaattgagacaaataaatgtaaagggcttagaacaatttcttgtatgtgtgggtaaagactctataaacattaatattattattatttcttctgcttgaagctctttttcttatatatttatatagggaatttaatcattatattgtttccttctcagctcagatgtcattcctcagccatcctagctaaagtggtataactccactggctttctgtcactctttatcccattacccttttatttagtcatagtattttcatcactacttgaaattattttattattctgttctgctcttcccccattccctgaaggtgccaagtactttgtaggtgctcaagaaatatttgtggcaatttattgtcctgaaaacatggtttcctgggcctcgactctgagcaggcagcagatgtggcaaggtgacgacagtgaggcctaggcagggaagacagaattcaactctgtttattaatctgttggctcatctagatcaggcagctgccagtttttgtaaattttattagaacacagccacacccattttaaaacttattttctggctgctttcctcatacaaccacagagttgagtagttgtgacagaggtcttacttacaaagttgaaaatattactatctggcccttcattgaaaaaaatttgctgacttctgatttagatacatagaaaagacaaggagaaaacaccaaaaataataacagaagctttatttggataatgggataataggtcattttgctttttatctttatgcttttttttggtattttgttatagaccctttaatttggaaatagccttataaataccccaaaataatatttagaacagctttttaatggtgggttttttcccttttttctccttagtgctgcttttgacacaaaaacggggttacgtgtggcagtgaagaagctctccagaccatttcagtccatcattcatgcgaaaagaacctacagagaactgcggttacttaaacatatgaaacatgaaaatgtaagttattcattcaaggaagaatacattttgatcttgaatagactggggaaaaatgttttaattactgcagatggaaatacgctggagtgcatcaaacgttggtccctgctccttgtcctggggtgttagtggccacttggttatgtcaggtcaaagacttggaatgaaagtgatgcatcttcctggagttttagttttactcaaagatttttagaggagaaagaactctttaaaattttaaaattaaaggatatgttatgaaatacaacacaaaattcacaataatttttaagagaaaatattaaaaagaagttatgtattctttgcctggttttcctaaggctatattatgagaatatgggagtctgtggctattaaaagacaaaatagccacagactcccatattctcataatatagccttaatatttttaagtggaaaaatctgagaaagagtgccttaggctcactgaaagtcctatcagagatggctattattttatatatttgttaataatttttctttttttccagattcacgtattttaataaatatgtcagaggcattgtttaagttaaatataactttttcttttttaccaatttgttgattcagttgccattctgcaaagatgcttacaaattctaatacgataaataagtggatataattggaatactaactgaaagtaaaaagacagttgactgaagacacttattttactgaatttcaaaatcaagttatgaatttctgtgactgctatatgaagggtactgtgaagtttgtagcattgtggaaacaatggccatagagatttcaaagtcctctggctgtactgcttgttaccttgtggaagaaaattcaaaatctgtgaatttattatttgactatttagactgttttagtaatttaacttcttcatagcgagaaaaaagtcacagataagtgactcttcattagcgtacatttgtttcattagtgcaaatttcttctaaattgagaacattaagacttaaatttgtaattggattatggatgccattataatcacagctgctgctttttattttcacattttattttgattgtatgctattgaggaaatcctatttctacagacaacttctattcctgagtataattttacttaagtagctatgtgcaaaccagagttttaagaatgttcagtgtgaagctgcagccttcctaatcagtgacatgtttacaagaagttgagatatgcggaaaaagctggcagcagaaactttattcctaggtctgcataaaatcaaagtggcctggcagctttaagggatgtgtttgcgtttgatttttaacacatttaagtgtgtatgctgtttttcattacacattattatatgtgacagagacagtgtcacagctttgcaagtataaaggatattttgaaagtgaaatgcaagccaaacatttatggaaccccagagcacctttgggagccactaggatcctattgatgtggctatgctaatttaagaacatctggtttaggagattatcagtgctacactgattgttttgcttttcttcataaatatgttaagccaatgtttagggatcatggtattagaaaaataggattttaatttctatacattgttttataagtggcttgcttactagcagtcttttttttatataaagatgtttaagttctaacagttggtggtcacctagatatcagtgatttgttatttaaacaaaataaggcacatggctgaatgtctcatagttctctattccattggcaaatgtttgaagccaaaagacttgactcaatgtagaaaaattcctgcattttagcctattttgaaaacatttgttaggtgcttataatgtcaaagtagttttacccaataaagaaccaaaacttccggtaagtttaattgagggttttcagagaaattcatctcgtttaccctcctcttcttttttaaaaaattactgttttgggtcaccatccaatttttatagcggccaaacctcccacaggcagcagcaacaggcgcttaaaacttgtgaacattttaggtgttggtaacaaatacaattttcaggtgccagagggcacatgtgatcttttacacaaaaatgcctctgacccacaatcggtagttcatcttgaattgtctcttctgttagtgatcatgaataatagataaacatttattaggtgagtgactgaagctaggggatgtcctctgtgactgtgagagtttctctctgaacaaagttagttggaccattcctgattgaacttctgaccttgatctcgttaacacctgctctaaggaaagattaaagggaggcagcctgccagctgcatcctttgctgtctgggcagacactacagagatggcccatatatgggcctagagatctgtacattttagaatttaaaaatgatcaaggaaattgttttgtaaattttatttgggagccttagatttaaccttaccattgtagaccaagagattgttttggtgtgcttttgttaaatatgctaaatattgtctctggatactgagttaaagtatttttttttggatgtgtgctaatttaataaaaatacgacttaatatttgccaggctttggaccatgatgggataatcattagagatatttgctgcttatttgtattatgaatgtcttttctaaaaatttgattcctgggttactttgaggtgactgaagtcatgtaacagcagaaggagttaaggaaatagactaaaatatgacttgatttagaagggaatttccatttaagaaatgagaaatggctgggcgcagtggctcatgcctgtaatcctagcactttgggaggccaaggtgggtggattgcttgaacccagaagtttgagaccagcctgggcaacatggcaaaaaccagtctctattattatattaaaaaaaaaaaaaagaaatgagaaatgaatagattcctaaaatattttccagatctattttaatgctgataagcttttgttttacagtattttccttatgattaatattcataagtatgattaatggagtgagggatattttgtaaaaacccatcaaaaatttaagtactttgatttagcatgggtagttttaatctcaaaattgttattttcggtgtgcttatgttaaacacattaaatattgtaaatattgccctttttaggaaattaaaatttggtagggtatttactagttggcttttctctattttttttcaggttactttatttttcttcttgcagtcatggtttttaatcatttgaatagttgagctttatgtctcatattctgttaatggaagtagctgcttcagatagtttgcttaggtatattgtattttgtaattgtctattcaactgtgtgggctgtggtcaccacttattttgatgatccacagtgggtcagccttttgtactaggcaccttcagatacattgtctgctcagtcttgctgtcagtactgtgaaaataagcaatgatgtcctcatgtttttcatatgaggaaaatgggactcagagaagataccaaatgtatttgccaattattatttacataacagccattcattgaactcctgctgaatgccaggctccattccaagtgccagcgttattggaatgaagaaattataagctcttggacccaagaaatcacaaactgatactggggttcaaacttacagctgcttggttccaaaatgtctgttgtgttttcagtttgaaattggagtttttatttgaaaatagttttgacttttgtcttttgaggtaactcttgcatgtgtaaatcagatctctaatgatttagttttatttccataggaggattttcacaatcacaatggaaacactgtaaaacaatgtaaatagttttaaacttttctattgttttgaggagatgggcatctcagataacaagaatcattgattagaaaatattggaacggtgaataaagttagcttctagacctcagttaccttaagtagaagtgggtataagggagagtgattaaaagaccagaggtcttaagccaggagtataccaaactcaagggaaacgattatggtttagatggagaaggtaaaaggaaatggatttgacttaaatttaaagcactattgtgaatgaggtcacaggtactctattgggaggcatgtaagttggccttacctctatggaggaccatttgacaatattaagatccttaaatatattggtgtcctttgattctgtaattctgtttcttgaaatttatttcctggaagaaaatatgagatgtgcaaaatacatatatttttcttgcagtattccttaaatgtctagagataggaaattggttaagttatggtatacacaaatgatagatatgctgtatacaaatatttaaatattaagtaaaaaggcaggatataaaactatgcatggtgtaaccccaatttaatttatgtacatcagaaaatcaaaggaaatatatctcaaaatgttaatgatagttataatgggtggtataattatgggtaattttggttttcttatgtactgttgtctgggtaagatctgaaagtgattctatttcctttggaacaattttcaaggacttgaaacctattcttgaattccaagtatgtgtcccaccacctccttttcaggttcagactgtaaaattaaagttgcttttaaaaagtgacatttggagtcgggcgtggtggtgcatgcctgttatcccagctactcgggaggctgaggcaggagaatcacttatacccaggaggcagaggttgcagtgagctgagattgtgccatgcactccagcctgggcaacaggagcgaaactctgtctcaaagaaaaaaaaaaaagtctgatatttggatgagtggagtaacatcctaattagaagatctttttcatgataatgttttgagtgttaacatatcttacttctagagctttgtgtttaagttggcagtttagaacagtgtgctagtgaggccacagtcttgcttcataaccagatactctcaaatatggctgggcgtattacaaatgaattatatatttcttatttgccttgtcaatgcctaactttgtagaaatgaatggcctgggttttaaggaaaatagatgggaggtaggggttggagggtgctgtatgtggataaatcagtataaattcctgatcagaaaaactgctcaaagaccatgggttattgagtattaagtagctctttgctttatccctgtgtaaaaatagactttttttttcatttttaaattgtctgatttaaataccctatacattaagactttgtgagaataataccaagaatatactgagaatattttgagactttaaaaatgtcagttttgaagcatatacagttaatatggaaatttttcgtggaatacatttttaaaaaacacaatattacggtaacaaccatggacgtgtgacctttttcacctgttggattaattcattagaccattagtacatacgtaaggcaaggaccctaaatctttttgccttctgataaactactgactacatatgaataaattctaaagagatgaagatttttaatggtaaagtgggttaatatgagaattgatgttaacaagtagaaaacaaaagcataatttgggtagaaaattagttggagttattaagtatatgatgtgatgttatggaactgaggtagctggttttgaattagttcctattaaaatgattgagacgtggctggccgtggtggctcactgctgtaatgccagcactttgggatgctgaagtgggaggatcgcttgaggccagaaggtcaagaccagcctgggcaatctagtgagacacatctgtacaaaaaaagaaaaattagctaggcatggtggtggcacgtgcttatagtcccagctacttgggaggctgagacaggattgcttgagctgcagtgaactgtgatggtgtcactgtactctagcttgtgtgtcaagagtgagatcctgactctttttttttttttttgagacagagtctcactctgcacctgcactctcccaggctggagtgcagtggcgcaatctcgggtcactgcaacctccgcttcccaggttcaatcagttctcctgcctcagcctcccgagtagctgggattacaggcgcccgccaccacacctggctaatgtttgtatttttagtagagacagggttttaccatgttggccaggctggtctcgaactcctgacttcaggtgatccgcccgcctcggcctcccaaagtgttgggattacaggcgtgagccactgctcccggcctagaccctgactctttaaaaaaaaagaagattaagacctgatgggtactatactgagtttaatatttatttactttttaatttttatattttcttacaggtgattggtctgttggacgtttttacacctgcaaggtctctggaggaattcaatgatgtgtgagtaaattttttgcatttgccttcctggtctacagaatgaagactaatagcccatttctattcctgaaccatttagcaacatatagacttcaaaaaattctttattcctatcatgcacctctttttgggtgtagggatggataccagaagatgtatgttatgggtggtgcgtgttagtatttacatcatttcaggcacattgtaccccattgaagagtcagtcttgaattcttacaaaagttccatggagaaaggagtggagagagttttgactatggattttcttttcaaagtgtttatcccaggtttggttttgttgttgttgttgttgttgttgtttttgttttaaaagacacggggtcttgtgatattgcccaggctggactcaagctcctgggctgtagtgatcctcccacctcagcctcctgaggagctggaactacaggcacatgctaccatgcctggccgatcccaacttttaaaggtgctcttcaagaaatgtaacggatccccagccatatagactccctcctcttttatcgcccatgcatgtgggagatgatactagaactacatgctgatccttgaagtattagatttctatactgggataaggggcagactctacctgttgagaaaggcttcttctctcagctttgtaaccacctctgttgttttagcctgggatacccctagaaagcagagcctgggattctcaggaaccagtagtggggggctagggaaaatgaaacaggaaaggagagaaagcttctatgagtatatgttgagttggtcaccactatggacaattgggctgaaaactgccaagatctaagaagctgtacgtaatgcacctcagatggggatcattaatacactggctcctgaccccattggcaagggttgccacgtatgtcattagtgccttcacatgcccaggttgcacattggtgggccataagacagattccagcaagtgttcccatgtatgtgtgaactctctactatagtagcttttctagtatctgagttgacacagctctccctgcccccagttcacatatacactataccatgaaagagaaaaaaaccttaaacacagttatacttttggtcacattgaaattttggcattcctaaatggagagtgttactattatgaaagccaaaacagaactgaagatcgtgacttctcttccttaacctccattcccccattgaccccagggctgaacctaaccagtttctcctcacccttatcctggtttcagtttctcccattcttatcctgggctgattgcaaacaccgtttactccttccccacagaacacaaaggggatatgtttgaacttctatgttctgtctaaggaaagggagaaagaaataaagaagatgaaatggaaagggaaggaggaaaggtggcaaaaacatttctccaccatttgaatttagttggaacagtgtatggctgagagtagaagagtagaagttaagagaggagaatttggtccacctacaagatctccttggctacattaaccttgatcctgctaatgaaagtttaagaaacaaaggaaaaaaatagccaataactaagaaaaattgttcttctcgcagccctgcttgatacaacaatatggaggcttccagagattactggatgttactcaggggcatgtatattacagtttgttgagccctactgtatgctatagttggaaaagggaatgttacagaatgatggtttttaaaaatagttttcctaaatgtagaagaaatgctgaagtaatgtgtttgtgaattactttggaaaacatttgagttagatctgagctgtatcccaaaattttaggtatactaaggatggatttatataacaaaggaaatgatttgctgacttgtgcaaagtgcaaaatgctgtattttggcctaattgggcattctggaaccggattaagaacctatttttcctatgtgaaaagaccttaattaaggccagtgtctatttagaaggttaagtgttactgatagtggtgcctttgtttggctccttcatccatgtaaggacccagcaactacaaatctacctttgaactaaggtttcattcattcattcaaccattcattcattcatttattcaataaatactatggctgttgagcaggaatctgttctttctatttaactctagctggatactgttttttataaacaataactgagtttacctcttggaagcaaatctcattactacttgttgactacttactgaatgcagaacactgagcagagtgttagcacaggctcagaataatcagaaacagtcgcccttccttttgatgaaagtgtctggttgggggaaacgaattcaaagcacttttgtatccaagctaccaattggccatatgaccttggacaagtcactttaccactgtaggcccagtcatttcactgtaaaatgatgagaattgaggtcgttgacttctgaagtgttttaaattacagaaagtctctgaaaatagaatgaacttgtttgccctaagaaaaatattccattgtttactttttattgtgatgttcatatcactgaaaaaatcactgtagttcgactatagttatttcagtgttttctttttttttgagacagcgtcttgccctgttgtcacccaggttggagtgcagtggcaagatcttggctcactgccacctctgcctcccagctcatgcaatcctcccacctcagtcccccaagtagctgggactgcaggaatgggccaccatgtccagctaatttttgtatttttggtagagacagggttttgccatgttgcctaggctggtctcgaactcctgagctcaggtggtcgccctcctaggccactcaaagtgctgggattacagacatgagccgccacacccagccatttcagtattttctaaagttattttgggatatgcataagaaactaaacatcttcacctacacttgcagggtttgcaaatttaaataccttcagggtcacacaaagaacataaatgaggttcagtgttacacaattgggagtggtggggtctgtggcaaaatacatctgcacctcctaaaagtattcaaattcacattgaaacaaaacaagtaaacaaacgaaaacctacacttctggccaaaccagacataatttaggctagagtggttctacaagctgcctgtttagagcaggctataatttgaacacaaatttttaaatgctaattagcaaaatctctataattactttcagatttatagttttttttttttctttttcttttcttttttttttttttgaggtggagtctcgctctgtcacccaggctggagtgcagtggcacgatcttagctcactgcaacctccgcctcccaggttcaagcgattctcctacctcagcctcacaagtagctgggattacaggcgcacatcaccatgcctggttaatttttgtatttttagtagaggtgggatttcactgttttggccagactggtcatgaacgcttgacctcaagtgatccacccacctcagcctcccaaagtgctaggattgtaggtgtgagccaccgcgcctggcctacagttggcttttaatcatgtgatacgtgtatttgtccctttatgtttcggttagcacttttaatttatatacagtcatgcatcagttaatgactgggatgtgttctgagaaatatgtcattaggtgattttgtcattgtgcagacatcatagagtatacttccacaaacctagatggtataatctacacacctaatctatatggtgtatcttgttgctcccatactacaaacctgcatggcatgttactgtactggatgctgtaggtaactgtaacgtgatgctatgtgtttgtgtatctaaacataactaaacatagaaaacaacagtaaaaatatggtactgtaggccaggcttagtggcttactcctataatcccagcactttgggaggccgaggtgggcagatcacttgagcccaagagctggagaccagcctgagcaacatagggaaaccccttctctacaaaaaaatttaaaaaattagccgagcatggtggtgcatgcctgtagtcccagctactggggagtctaaggtgagaggatcatttgagcccaggggcagcggttatattgaaccatgattgcgccactgcattccagcccaggtgacagagtgatatatgtggtccactgttgactgaaacattgttatgtggtacatgactacttcagatttttgctatgttttaaattttaattcttacaaatgaagactatacctttgagaaaggaacaataggtagtgcattttgaacattaggaacaatatacagttactgaatctggatggagatgatttttggaaaatgtagtgttaaaagatggatatactaagttgctcttgaccaccataggatgtggttgtacagatggcaaaattttgtaaagatacagtacatctagatctcttaaatgactggaaatcctttgggcctttctgttggcttcttgatagtaatgtttggcaagatactgcatgcatatatattcctgtgtattcagcagatattaccagtagaaatgcaaaaatcttaaatagccaatatttgaacctaacaccagagcaagctgtaattcagtattactataatattgccttttctttgtgtgtgtgtgtgtgtgtgtgtgtgtttgttttctttttgtagttggggctacaggctcacaccactagactcagctgtttttatttttttgtaaagacaaggccttgctatgttgccttggttggtcttgaactcctggactcaagcaatcccccaaccttggcctcccaaaatgctgggattacagatatgagccaccatgcccccccccccacccctttttcttaactgtagtggttctttgcgcaagcatagtagacaagaattttttgattcctcctgggaactatttcctcaaatttcatggaaactgaattgtcatgagttaagtggaaattagtcttctgatactttttcctttattttacaagttcccatcccaggtttcttatactgaattccttatctctgcctcattcttgaagagggaaatggaagtggggttttggattctaccatgatagaagggaagacctacaacaaggctattcagcagcctttgttttagtgaaagccaatgagaagagatcacttcttccacttactaacaatgattgctcaactaataagtttagcttttttatttcaatgtaaaagttgctgaaaacactgaattggtaaaggaaatttctggatttacattttaacctgatgttgttcaataaatatttgaatatctaccttatgctaggcacagtaatagtctctgaggaatataacagtaaataagagctgaggctgttaatgggagagaagaacaatgtaaatgatcaaacaaaataccatgtggtaagacctgaaaggtcctacatgagttggtctccggtgtactctctaatctaacctcacctagtcctctttccactctgtctccaccccagtcactctggcctcttgttctttgagtacagacaaccacatttgcaataagacctttgcaccagtttctgttattgccctggaactttttccccacatacctacatgactgtctcctttccttcaggactctacccaagggtcttctcatcagaagctcttcttttgttaccattctaactgaaatagtacccctactgtcactgtttactccttaccctgctttgttcttagcaaattttgttattgtctgtcttctccctttctttgtaagctgtgttcaagcacggagtttgttttcttcgttgctgaatcattattggagtatatgcactccattgtttgttaaacaggtgaacacaagaattgccattatagggcaggtatagagtgctaaaggactgcatagtatggccacctaacccagacatggggtgtcttcaggaaagcctctgcaaaaaaaatgtatacacagagggcttaacggatgaaggagagttggaaaggtggggaaagtacaagttcatccaggggccgagagagggagctgagggcagaaaaggtgtgtgtgtgtgtgtgtgtgtgtgtgtgtgtgtgtgtgtttggtgggaatagaggtgtatatggcaaaagatgaagctggaatggggagggactagatctttggggctttataagctaagcctcattaaggtggttgctttagagaagagatcaaagggtactgggaactggaaatgggattggaaaaaggatgaaaggttttacttttatgtgggatgacatagttacaactctctcccccttcctccccacacaaacacattccatagtgtgtgataaaaagatatcattttaccagaggcagttttctcctggatccttaacacattaggaaatattttggatgagcatactagttgaaaatctgaaatggatataagacttttctgggaacttaaatttatgtaatgatgcttctcattgttaatatctgactttaatttcttttggtttgacttcttgccaacattacaactatgtcctttcttcaaaaaacagggtcttatgcttatgagtgaaactgacaaaacatgtgggtgagcagttctataaaaactctttttttttcagtaacatcttggagggtacaaagggctttcacataatcttatttgacacaacaatcctgtgaaacagatggtattatctctaattttcagatgagggaactgaggttgagagagatgaacctaattgtataatatcacatacaaaattgcatctctccctggtcttttggctctaaacctatttctcatcacatttttctgatctaaggctatgattattatttgaaagtctgctaccccttcttattgagtaaatattgtgttaagttctatgtaagatgccaaaactaagggcctgtctcgttttccaattgctatggtcttattaaagaaatgaggcatttcttattaagaaatgcttacctaaaataactgaagggctgagtcaaatctgtaatgtctagacaacttacagggtgctgcatgaaactcagaatattagagaagcttagtggagaaaagcctctaaagaaggtaataactgtgtccgaagaaacaaatagggataggatgtggaagttgaaatttattccagacagagaatgaaggaaatatgtaaagtgtacagaaaagagatttgtatggaatggagagtgttaaatgagaataactattgatacttcttttgtacttggataaaaattgtgcattgatgaattctgggtgtgtgtgtgtgtgtgtatgtgtgtatgtgtgtatgtgtagggttattcctgatttagctaataaatgtgatctttttggaaataatggtgaaagaaatacctagccgagttgcttggacttacaggttatttcctaatttagctaataaacatggtagttttggaaataatgctgaaagaaatactagcctagttgcttgaaactaggctaagtgctcaagatagtgaacacaggaagagaagtggtctaggaaaaagattaatgagttaactattaacatttatgtttacaattttttttttatcagagaggtctgctgaaatggagatggtgggtggcgaaactccttgtagatgtttttacaaactcacatttgaaatctaaataagttacatatctcttaagaaaatatcattcagtttttgcctgacatgatcaataagatgccacctttttctcagattagctagttttaaaaggtaaagaagcttcaaggcctagcttagagtttgagtccttcagcaatctctctctaattcacttcttcctaagtctgtgctgggaccctctcctgtgtgttctccatcaccgtatgtccctttattatgattatatattcatatatgccttcctttcatctaaaggctgtatctgtctttcccactgctgcatccccagggcccagaaatacgtatttgttgatggagtgatagaatgagtgaataactttgtgctgtcactgtttataactggttgatgatttggttgtctgaaagcatgctcagtgctctctcctttgactagcttttttgttttcatcctgtaatgtagactgtgtggtaaaatattgagtctagtttcactgatgcaggtaatgtagagggcatcttttagtaatctttgcttcaagtgagaataatttgttgtgaaataagcctactaagctgcctacttggctgctgaatgattcttttacccctaaattagaacagtctggtctgcttaccagtaagatctttggcacatgtatttcaataaaatgagcccttgtcttatcttactagtagtgctgtgtgagttgtcctgagtcattcagtggtaattgagtgcctactatctatcagacactgttctcggtactttagatactacagggaacaaaaaataaccctgtcctccacgaacattgtacaagcagataacaataaacaacagtgagcatataaaaaaggaaattacatagtctgttagcagacaataatgctataactaaaaagaaaaggtagaaaggtagaacaggaaaggggaattaggagtacaagggtggggggaagatgaaattttaaatggataggccttattgagatgaattttgagcaaaagtgtgaagaagtagaggaattagacctggggatatctagaggaagagcattccaggcagaagaggaagtcagtgcaaaggtcctgaggcagactgcatgatatattggaactggagcaaggaggccagtgtggagctgagtaagagcaagggacagagacatagactatgaaatcagagacataattaggggcagtgtactggattaggtagggctttatctgccattgaaaggaattttgtgttttactcttagtaaaatagggagccttttgaggaaaggagtgccctgatctgagttttatttctaaagaaacactcttcccctgtgttgagaatagactgtagtaagtcccaaggatcaataggtgagttgcagaagcttgtgcttacaaattgtcaatccctgtgattgttttaagcaccctgtttaaatatggaataaatgggtttttttgttttgttttgttttttgccttttgataattgctttgaataggactgatagtagtaagagacgccagtctatagatatcgaagagttttttctacataggttctttctgattgttctgtgctttaaaaagtgggaggtggggaggaagagggcgggggcagtggtgctggtcttaacaattgggtattatccaagaagtataaatgaagctgtaaaatggggtgctgtctagagtactgaaaagcatttatgacagagttcttccttcttgctgtcacagtacattttactcacaggagtcacattgagaaatgtgatttgtgctctctatactttgattaaatttaaagaagaccaacttcacaagaaaagtgaaaaacaagatttgtatcagtccatgaaattgttttcagcttttagcctaataaagtccaacttaacttaattcctttgtaaagatgtgagaactagatagctttccaaccatactcaagtctaaccttccttaatttactttaatttactttacttaatttactttaggtgttatatacattgacaatattaggcatgtctttactaaaatgtaattgactatgctttccagaaacaaatactatagaaattatgtgactctccattaatgcctcttttggaatgtgcttcttaaaatgtgctcatttatattccttgccccccatcctgttcattatttttagaagttggtgcatcttccataaacaatcagcaactttgcatgatgcttgcttttgtcccctgttgtaagacttattttgaaaatctttctatatgggagttagaatgtaacaattggtggtcatggattggtctttgggcctcctggaaacaagtatagtgattaagttagttcctgcaagatgcttctgccataaataatgcctttcagtttatttcattgtagcttagtagtaatgcttgatagttattactatatagactgattaatcttataaacttacataatgttttggcagtctcaccctcgttctaaattttggtgataaaatggatgtggtctctgagggggaaaggatttgagagaaattacatagtggtaaactgttctaattaaaagctctttccctctctctctctctctctctgttgccatgcagtcagtggtcctctggctgcctaagatttcttaactcactggtaaccatttacacataatagctgtacttgaagttgctatggtttcattagtagttttgcctaacctttgtgaactggctcaggcctattagttaggactagtattatttttatttaaaaataagttatgtttgtctcttctccataaaattatttagaaaagttcaaagaataaccctcttattatccaatgtcaaaaaatataattatgtgcaaagtagtcttatatgaccgaaattagattctgtcttcctcagcttatgcatcaatttagggttaaaaaatacagtaactgtgattaggacagaatactgctatgttcttgccagcctgagaactttgttaagattaactttgatagtaaatacagtattgagaattattaaggaaattattcagacatattgcttccctagttattgtgacatttaaagagttttaaaaaggtcattcccttgatgtaaattttgtatcagctgaaagaattgttggaagaatatgtgctgtgattaagatcatggtctgtggggtcagttagttttagatccaactcctgacattactactctttttgaccttgagtagatggcttatccttattctgtctctatttccttgtcaatgaaatgggaacgctaatggacattatctcacagagttattgggaagagtacatgagacataatgagtacatggacataataaactgcttgctgcagtgctggacacagaataagtgctagttagtgcctttggttatgttgtgttgagattggaacatttcttaaaacgtttcagtctcatttacttattaattacatttagagtctactctttcctcaaggccgtataaacatgcaagttttaaaaatatgaaatgctaacatcttaaggttgcaactaggttaagtcctgttgatcttcatgaaattgagaactgaccatggcagccctaccaggaaattatgacagagaaaaaaattccattcctcttggaggacagaaagtaataaatatagtgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaatacagtaatgagtgggttaaggcattgtgtctagaatatgtgtggtgaacctgttggacttgaatgtaatcattccctaatcttaccacataaagatgggattaataaccagcaccacacctgtgaggagaaattctggaatgcctcatcttgcctccagataaaacatgttcctccttcctttaaggtaaatgcaggaatattgtcaatgaacaaaatcctttcactagtcattcctgaaaaagaattacagttggaaaataaaaaaaatactcctattttagaacctgtaatgtggaagacttataatgaggtgaaaatgtagcggtggatttaaaactacaagatacttaattatagccatgcagtaagttatactatatatttgtcatgcaagaataacatttgtaagaaaactgatactgacacatgtatctttctaatccctacctttgctgtttttgttttcttttctcttttattttttgtagagatggggtttccctgtgttacccaggctgatctcacactcctgcctcagcctcccaaagtgctaagattataggtgtgagccacaaagcttggcctggtttcttttttcttgagataacctggaaaaagatatgtcaagtaggaataagtatgtaaatgtttagaacagatggcaggtagttaaagttagaatagtaatgttgggaggctaaattgggaggatcacctgagaccaagagttagagcccagcctgagcaacatagtgagaccccatctctacaggaaaatttaaaaaaattagctgtgcgtggtggtgcacacctttagtcctagctactcggaaggctgaggtaggaggatcacttgagcccaggagtttgaggttgcagtgaattactatgattgctccactgcatgacagagcatgaccctgtctctaaaaaaaagaaaagtaaaagaatagcgatgttgaaaatgaggtaatgaggtgcccttccccccaaaaaatgagtagttgttagcttttagctgtcatcgtggtacagctaccattttaagggaagggtagccttcccttaaaaacttagaagtcgggccaggtgcggtggctcacgcttgtaatcccagcactttgggaggctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacacaatactgatagttacttatgctgatttctaatcttactattaacactagcagttcttactgattcatgaaaatgtgcagcaaatatgttatataatatgacaatagagggttggaggtaactttgacttttttctcttttgcagtatatacattcagctgacataattcacagggtatgtattgtgactttgattacattattttggggaagtggggtgagagtggaagaatggcatttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaagactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagaggtgataactagattaaatacatttctaagaggagaaatggcagaaacccactcactcaaaataattcaaataaaaaataagtgaattaattgtttctaaagagcaagcagctctagaacttttgttccatttcatttttttaacttgaaaaaatgtctgtacattagaatgcaccatttcatttggcaaaattatatatccacttaactcacatttatgataaagaccatttctttttttttccttttttttgggatgcagtctcactctgttgcccagtctagagtgcagtggtgtgatcttggctcactgcaacctctgcctcccgggttcaagcgattctcctgcctcagcctcccgagtagctgggactacaggtgcacgccatcacacccggctaatttttgtatttttagtagagatgggatttcaccatgttggctaggatggtgtcgatctcctgacctcgtgatccacctgcctcggcctctcaaagtgctgggattgcaggtgtgagccattgctcccagccaagaacatttggattactttaaaaagtttatggccaggcgtggtggctcatgcctgtaatcccagcactttgggaggccaaggcgggtggattatgaggtcaggagatagagaccatcttggccaacacggtgaaacctcatctccactaaaaatacaaaaatttagttgggcatggtggcgggcacctggagtcccagctacttgagaggctgaggcaggagaatggcgtgaacctgggaggcagagcttgcagtgcgccgagatagtgccactgcaccccagcctgggcaacagagcaagactccgtctcaaaaaaaaaaaaaaaaaaaaaaaagtttattgtgtcccttcctagtcaatccctacccctccacccctaactctggctccaggcaactatggatctgcttctaacactatagattaggtttatcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccatgggtgtatactccttttacttatctctagggaagactctcagtattttgcttttatagtctagataatgcattatgaggtctttcttcaaactgagtagcttgccttgccaagaaagaggcttcagtttacttttgtgagttggaaaaattcctcataagttgaaaaacccatcaagtctgtcttctttttgcaacagtcccttattaatcatcccacagcagttctgagacctgagcatactcatgagaaactccagatcccagtgacagttttagtcttcttgtataaacacttaatgagcacaagatgcccatttataaatgaagggcatcttgctgttatgtttatgtattaaaagggctatgtttggtacctgcagtgatatactgcttacttgttatgtttgttgtttgacaacaaatagtaaaagcaagaagtgaaaagcttaccatgtaatgtacttttgtttttccagcacaactttttcccagattgcagccaaaccctaatttactccaagacttactgtctagtttatggtttattatagcccctttattttagctcctttcctatctgcggtatgcttgtttcatggtttagtattaatgtcatgaaaaatgtggtctgttggaactctcatcagttctacttatggaagatgtttaggtgagaaagattgttaaaatatatgtctagaattagttttggggattttttctttttttaatagaattgagttaactagccttcaggtggttttggttaggcaatattagacatgctacctctgatctattatgcctagagatctaaaagccattttagtcccttacctaaataaactaattgagtttataaaccagaatgtcaattcacttgcttacagtttgggatatacttctgtaatggctatgatgttcatgatatctacccacgtgttctaactatcttctgctagagagaatgtactttcattatgaactgaaaaaacctctatttctcaggtaaagctgtttctttctctctgaatattaggattgataacagagttcagtctccctgtatttagcttaccttattactccctacctctggattttaaattagtttaatacctggtgtttctcctttgtcctttgtttcattcaccttatatctgtttctcagaaatttggtatatatatattacagtccaaggtaagagaattagggaaaattcatacttccccctttcctcaggtacatatctcagagtcccatccttgctttgtcctctagagtagctgctgtcctgatgctattctctgttccctgctccccttcctcttcttgtgtctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaacaacctagtgtttaaactttttaataagggattcattttttaatacatgagaattcatttcaaaattttggttttagttatttattttattctacttggctctttttcagacagatgttctctcctggattgtaaaagtcgaattcaaaggatttttatttgtaatatacttaacctttctcttgtaagttgccatctgtgtagatacagctttgattgcctgacaagaggaaaatgtttcccattatcttttcctgcctgaactatacggtcacttgtgttccagcatagtggttcttaaccctcatagtgtgtcagaatcactttgcagagcttttaaaaactctagatgcctggggaccaccccaaagactccattttgttgtcatgggtcaaagcacagtcttctagtttgcagctagtgttgagtacaactagagtttaacccagttgaattttagtttaatcttggctggtcttgaagatgttagtaatctctattcattttttttgaaaagtaccaatgagatcagaaagttaattagaaaacatctagttgaatcccctgtttttaatagatggggaaaccaagacccagagaatataatccaaagctacctgtcacataggccacaatttcttttccaatattctgttcttcgctgttcttctaatttgcagaactcctctttaaaaaacctttggagaatgtattggcctcataccctcttccttcagcctgaaagacatgcacctgtcacttatttatgatatttaaatgcaacctctagaacaggggtgtccaatcttctggcttccctgggccacattggaagaagaaatgtcctgggccacacataaaatacactaatgatagccgatgaacttaaaaaaaattgcaaaaaaaaaatctcgtaatgttttcagaaagtttacaaatttgtgatgggctgcatccaaagccctgggccacgtgcagcccgcaggccctgggttggaaaagcttgctctagaaggtactcattgtttgagtgtccagttttctccctgttttccttatttattgatcattttgcatttggaattggtggtttgggcttgtaagtaagaactgtgtactagaacttttgtggtattgcaaatgttttatatctgtgctatccaatgtggtggttataggcaccagctgcctgtggctaattattaagcaactgaaatgcagctagtggtgagcagtaacgttgtggagaagaaaaaaaagaaatgtagctagtttaacttggaaattgaattgaaaatatttttgtggttaaatgtatttaacataaaatttaccattttaacctttttttttttgagacagtcttgctttgttgcccacgctggagtgcagtggcatgatcttggctcactacaacctccgcctcccgggctcaagcgattctcctgcctcagcctcccaagtagctgggattataggtgtgtaccaccatgtaatttttgtatttttagtagagacagggtttcaccatgttagccaggctggtctcaaactcctggcctcaagtgatccgcccaccttagcctcccaaattgctagattacaggcgcgagccactgcacccggccccattttaaccattttaagtttacaattcagcggcattaattacattcatgatgtacaatcactactactacctatttccagaattttttcatcaccgcagatggaaacactcagcccgtgaaacagtaacttcccattctcccctctggtaacctctgttctttctgtctctgtggatttgcttattctagaaatttcatagaagtagaatcatattatactgtatttgtccttttgtttctggattatttcacttagtataatgttttcatggttcttccatgatgtagcatgtatcagaatactattccattgtaagtatttaatatatcccacattttgttgacctgttcatctgttagtagacagttgagttgtttttacctttggctattgtgaataatgctgcagtgaacattgtcatacaagcatctgtttgagtccctgcttttgattcttttggttatgtacctaggagtggaattgttgcatcatatggtaactctatgtttaactttctgaagagccaccaaactcttttccatagtgtctgcaccattttacatgcccaccagcaatgcatgaggattcctgtatctccaaacttgttctttttttttttttaatagtcacccaagtagttacaaagtggtatctcactgtggttttgatttgcatttctctcatgactaatgattttgagcatcttttcatctgcttattggccatttgtatgtcttctttggagaaatgtctattcaagtcttgcctattcttaattaggttgtttgtgtttttgttgttcagtggtggttctttatatatcttagacccttatcagatacatgatttgcaagtattttcacctattttgtgggttgtcttttcactttcttgataatgtcctttgatacataaaacatttttaattttgattaagttccaatttattttttttctgtccttgctcatgcttttttgatgtcatattttagactgtattgccaaattcaaggtcatgaataatttacccctatgttttctactaagagttttgtaactactaggaatataatagggtttagctcttatacttaggtctttgatccattttgaattaatttttatagatgatgtgaggtaggggcccaacttcattcttttgcatctggaagtccagttattctagcaccataaagagactattacttcccccatcgaatcaacatgataccctaggatttctcctttgttttttgtttctttcaccttttacctgtttcttagaaatttggtatatataattagcaatacacgtgtgggtttaattctggactctcagttctattctattggtttatatatctatccttatggcaataccacactgttttgatcactgtagctttatagtaagctttgaaatcaggaagtgtgagtcttccagctttgttcttctttttcaagattgctttgactattctgggtcccttgtaatttcatatgaatttaacaattggcatttctatttctgcaaaaaaaaggctttagaattttgatagggattgtgtcagatttttagatcactttaagtgatattgacatcttaaccactattaagtcatcctgttcatgaacaaaggatctctttccatttatttaagtctttatttttttttcagcagtgttttatagttttcagttgtaaagtattttaccttggttaaattttttcctatgtattttattatttttgctgcgattatagatggaaattctttggtgtgttcattgttgatatatagaaaccaaattaatttttgattgttgatcttacaccctgcaaatttgctcaatttatttattagctctagcagctttcttctagattctttgtgattttctatgtatagggttatgtcatctgcaaacagagatagttttatttcttcctttccaatttagatgcttttaattctttctcttgtctaatgtaatggctctgtctagaacttctgctacaatgctgaatagcaacagtgaaagtaggcatccttgtcttgttcctgtcttagggggaaagctttcagtctcttcccattgagtatgatgttagctgttggtttttcataaatgccctttatcatgttggggaagttctcttctttggtagtccatttcacattgctatgaaggaatacctgaaactaggtaatttatcaagaaaagaggtttatttggctcacagttgcatagctgtaaaagaagcattgtgccagcatctgtttctggtcaggacctcaggaagctttcacttatggtggtagggggaacaggcatgtcacatgtcaaaggagggagcaagagagatgccagactcttttaaacaaccagcatttgcatgaactgatagagcgagaactcactcattaatgtggggagggaaccaagccattcatgagggatccaagaccctaacaccttcaatcaggccccacctccaacattggggatcacatttcaacatacttggaggggacaaaacatccaaaccctatcaccttctgttcacagttttctgagtattttaatctgaattttaaatgccattaaaattttatttagattacattgaaacttaattacacatggctagtggtattggtttatgcatttttagatcccttcaagttatcttcctgttctacctttttcttgggttttgtaattagtctccttcttgaaagattattttggtactggttgttagtaattcctggatttcctttaaagatataagaaatactggggaggggacaagatggacaactagaaatagctgcaatcagaggcttccaacaagaagaacgaaaacggtgagtgaatcctgcaccggcaactgaggtattcaccttctctcaatgggactgactaggtggttggcatgacccatggagagtgaggaaaagcagggtggagcgacagcccacctgggagctgcaaagggcaaggggagctcccaccccaagccaagggaggtggtgagtgattgttctaccctgtccaggaaatcatgctttttccaaggatctgtgcaacctgtgattcaggagatccccctcatgagcacatgccaccagggccttgggtcccaagcacagagctgtgtaggttcttggtagccctttggctggagactacataagactactgagttccttgggggaggggttgctgtcatcactgcagctccagtctgctgttttcccctgctggtgctggagagactgggcggttgggacccagaaggaattccctacagtgcagaccctacagtggtggtggcacatcatggccagactgactctttaggctgaactctgactcatccccctacacggggcagggcctctctgcgggaatttcagcaactccagccaggggtttacagacagaattccaatctccctgggatggagcccctggtgggaggggtggccacagtctccacagatcagcagagttagtctttccccttgctggctctgaggaatccaggcagtctggatgagtgagatttcccccagtgcagcacaccccctccaccaaggggcagccagagtgcttcgttaggtgggcctgtgcctcttgactggatgagacccctccaacaggggtcgccagacaccttatgcaagagcattcccactggcatcaggttggtgcccctctgggacggagctcccagaggaaggaacaggcagccatctttgctgttctgcagtctccactggtgacacctccaggtacaggagggacccaggcaaagagtctggagtggacccccagcaaactgcagcagccctatggaagaggggcctgactgttaaaagcaaaacaaatggaaagcaacaacaacatcaacaaaaaggtccccaccaaaacccctccaaaggttagcagcctcaaagttcaaagctaggtaaagtcatgaagatgagaaagaatcaatgaaaaaacgctgaaaactcaaaaagccagagtgcttcttttcctccaaatgatcacaacacctctctggcaagggcatagatgtgggctgaggctgagatggatgaattgacagaagtagacttccgaaggtggataataatgaatttcactgagctaaaggagcatgttctaacccaatgcaaagaatctaagaaccatgataaaacattacaggagctgttaaccagaataaccagtttagaaaggaacataaatgatggagctgaaaaacacaacatgagaacttcataatgcaaccacaagtatcaatagccaaatagaccaagtggaggaaagaatttcagagcttgaagactatcttgctgacaagataagagaagaatgaaaggaaatgaacaaaacttttgagaactatgggattatttaaaaagactgaacctgcgaatgataggggtacctaaaagaattggggagaatggaaacaagttggaaaacacacttcaggatatcagccaggagaacttccccaacctagcaagacaggccagcattcaaatcaggaaatccctagagaaccccagtaagctaccccatgagaagatcaaccccaagatacataatcatcagattctccaaggttgaaatgaaggaaaaaatactaagggcagccagagagaaaggctaggtcacctacaaagggaagcccatcaggctaagagtggacctcagcaaaaaccctacaagccagaagagattcggggccaatattcaacattcttaaagaatttccaacccaaagtttcatatctggccaaactaagcttcatagtcaaagaagaaataaaatcctttttagacaagcaaatgctgagggaattcgtcaccaccaggcctgtcttgcaagagctcctgaaggaagcactaaatatggaaaggaaaaacttactggccactacagaaacacactgttttcttttaccagtaacactatgaagcagttacctcaacaagtctgcaaaataaccagctagcatcatgatgataggatcaaattcacacataaaaaatattaaccttaaatgtaagtgggctaaatgccccaattaaaaaacacagaacggcaagctggataaagaatcacgacccatcagtatgctgttgtattcaagagacccatctaacatgcaaagacatacaaaggctcagaataaagggatggaggaaaatttaccaagcaaatggaaagcagaaaaaagcaggggttgcaatcctattttctgacaaaacagactttgaaccagcaaatatcaaaaaagacaagggcattacatagtggtaaagggctcaattcaacaagaaaagctaactatcctaaatatatatgcacctaatacaggagcacccagatttataaaccaagttcttagagacctacacagagacttagactcccatacaataatagtgtgagactttaataccccactgtcaatattagacagatcatcaagcagaaaattaacaaggatattcaggacttgaactcagctctggacctgatagatagctacagaactctctatacagaaacaacagaatatacattcttcttagcagcacatcgcacttaggctaaaattgatcacataattggaagtaaaacactcctcagtaactgcaaaagaactgaaaatataacacacagcctctcacaccacagcacaatcaaattagaactaagattaagaaactcactcaaaaccacacaattacatggaaattggacaacctgctcctgaatgactcctggataaataatgaaattaaggcggaaatcagaagttctttgaaaccaatgagaacaaagagaacataccagaatctctgggacacagctaaagcagtgttaagagggaagtttatagcactaaatgcccacatcaaaaagctagaaagatctcaaattgacaccctaacatcacaactaaaagaactagggaaccaagaccaaacaaaccctaaagctagcagaggacaagaaataaccaagatcagagtggaactgaaggagatagagacaggaaaaacccttccaaaaatatcagtgactcccaagatctggtattttgaaaaacataaaataaaataaaatagactcctagctagagtaatgaagaaagaagaatcaaatagacacaataaaaatgataaagggggtatcaccactgaccctgcagaaatatgaacaactatcagagaatactataaacacctctatgcaaataaactagaaaatctagaagaaatggatgaattcctggacacatatgacctcccaagactgaaccaggaaaacgttgaatctgccaataacaagttctcaaattgaggcagtaataaatagcctaccaagcaagaaaagcccaggaccagacagattacagccaaattctaccagaggtacaaagaagagctggtaccatttcttctgaaactattccaaacatacaaaaggagggactcccctataactcattttatgaggccagtattatcccaataccaaagcctgccagaaatacaacagaaaaagaaaacttaaggccaatatccctgatgaacatcgatgcaaaaatcctcagtaaaatactggcaaaccaaatccagcagcatgtcaaaagcttatccatccaccacggtcaagtcagcttcatccctgggatgcaaggctgttttaacatatgcaaatcaataaacataattgatcacataaacagaactaaaggcaaaaaccacatgattatctcaatggatgcagaaaaggcctttaataaaattcaacatcccttcatgttaaaaactctcagtaaactaggtgttgatggaacatacctcaaaataagccatgtaagacaaacccacagccagtatcttactgaataggcaaaagctggaagtattccccttcaaaactggcacaaggatgccctctttccctactcctattcaacatagtattggaaattctggccagggcaatcaggcaaaagaaagaaagaaagggtattcaaataggaagagaggaagtaaaactctatttgcaggtgacatgatcctatatctagaaaaccttgttgtctcagcccaaaagcttcttaagctgataagcaacttcagcaaagtctcaggatacaaaatcaaagtgcaaaaatcacaactattcctatacaccaacagtaggcaagcagagagccaaatcatgaatgaactcttattcacaactgctaaaagagaataaaatacccagaactatagctattaataacaagggaagtgaaggacctcttcaaggagaactacaaaccactgctgaaggaaatcagagaggacacaaacaaatggaaaaacattctgtgctcatggataggaagaatcaatatcatgaaaatggccatattgcccaaagtaatttataaatttaatgctattcccattaaactactgttgacattcttcacagaattagaaaaaaactttaaaattcatatggaaccaaaaaagagtccatatagcccaaacaattctaagcaaaaagaacaaacctggaggcatcacactacctgacttcaaactatactacgaggctacagtaatcaaaacagcatggtactagtacaaaaacagaccaatggaacagaatagagatctcagaaataaaactgcacatctacaaccatctgatcttcaacaaacctgacaaaacgagcaatggggaaaggattccctatttaataaatggtgctgggagaactggctagccatgtgcagaaaattgaaactggaccccttccttacaccttatacaaaaattaactcaagatggattaaagacttaaatgtagaacccaaaacgataaaaaccctagaagaaaatctaggcaatatcattaaggacatagacatgggcaaaaatttcatgatgaaaacatcaaaagcaatggcaacaaaagcagaaactgacaaatgggcttctgcacagcaaaagaaactatcgtcagagtgaacagacaacctacagaatgggagacagtttttgcaatctatccatctgacaaaagtctaatatccagaatctacaaggaatttaaacaaatttacaaggaaaaaacccattaaaaagttggcaaagggccaggcacagtgactcatgcctgtaatcccagcactttgggaggctgaggcaggtggatcacgaggtcaggagatcgagatcatcctgactaatttggcgaaaccccatctctactaaaaatgcaaaaaattagccaggcatggtggtgtgcgcctgtagtcccagctactcaggaggctggggcaggagaatgacgtgaacccaggaggcggagctggcagtgagccgagatcacaccactgcactccagcctgggcgacagagcgagactccgtctcaaaaaaaaaaaaaaaatattggcaaaggacatgaacaaacacttctcaaaagaagacatttatacagccaacaaacatgaaaaaaagctcagtgtcactgaccattagagaaatgcaaatgaaaaccacaatgagatactgtctcatgctagtcagaatggtgattattaaaaagtcaagaaacaacagatgctggtgaggctatggagaaatatgaacacttttacaccgttggtaggaatgtaaattagttcaaccattgtggaagactggtgaaatcctcaaagacctagaaccagaaataacatttgacccagcaatcccattactgggtatatacccaaaggaatataaatcattctgttacaaagatacatgcatgtgtatgttgattgcagcagtattcagaatagcaaagacatggaatcaacccaaatgcccatcagtgatggactggataaaaaaacatggtacatatacaccatggaatactatacacccataaaaatgaatgagattgtgccctttgcggggacactgatggagcttgaagccattttcctcagaaagccaaacaccacatgttctcacaagtgggagctgaacaatgagaacacatggacacatggaggagaacaacacacgctggggcctgttggtggggtgggggtcaggcggagggaacgcatcaggataaatagctaaggcatgcggggcttaacacctaggtgatggattgataggtggagcaaaccacgatggcacatatttacctatgtaacaaacctgcacatcctgcacttgtatctcagaactttaatttaattttaaaaaaatataagaaatactcatttttgtcttaaagccaataatgtgttatcagattagaaattattcttgtttgtgactttgcagaacccttccatctggcctaatgatagcattattattttttaaagaatgaagccctttcttaaaagcctagttgactagggatatcaagtggacacagctgacagaactttgtactagaaaggagggaggatacagaatgtctcttcaggtacagtactaacttatttcaaataccatagatcttgaaatgaataagccactttgaaaattctgttaccaacgcttaacactctgcagcttaaggaagagagaaagttttatagccctgttatgcatcaaataccgtttttctaccagagatcacagccttggcttgctgttgttttccttttctccataatcaagtgaatttccttatgtgtaaaaccttctttaattttaacagaaatggtgctcttaagacataatgggttaatggagctgagttaaaatccacttgccatcagttactgccctggtctatgggagttttcctagtgtattaaatttgcttcttatatatttttttttatttcttcttttgcaaacatgttttgaaatatttcagacatactgctagacaaagaataataaacacctctgttcatactgtcctgcttgtgagttaaaacactggcaatagagctaaagcttctggagacccttctctcacatctgcccatcactttcagtcattggtttcaaatactctttctttttttttttgagatggagtctcactctgttgcctaggctggaatgcagtggcgcaatctcggctcactgcaacctccacctcctgaggctggtctagaactccagacctcaagtgatctgcccgccttggcctaccaaaatgttgggattacaggtgtggccactgcaccctgccaaatattctccctctctctctttttttttttttttggagacagagtctcgctctgtcgcccaggctggagtgcaatggcgcaatctctgctcactgcaacctccacctcccgtgttcaagcgattctccctgcctcagcctcccgagtagctgggattacaggtgcacgtcatcacgcccggctaatttttgtatttttagtagagacaggattttgccatgttggccagcctggatgttctctcatttttaaaaagcagtttcactttagacaccaaaagcaagtgtccaataaatgctgaagaagaaaaatattttattaggttatttgccctttcctctctaacttgaaaatacattttctcaggaaaaggtagaatcctcagatttgtccataaaccaagggtcccttaagaaattttctttgtgttacagtgaaaatgactattttgacaacttggaagataaggagctaggctaagtcttattctagtctatcctgtctgtcaccaggaagatttcctaccttcccaaaggttagtgctccacttcacccctatgtggatttatgtctttgaaaattactgctcatggcaggtaggtcctgcaattggtccttttatttatcttcaactttctggcctgtggaggttttttaggagtgcctggagcacttagaactgactagaatatccctcttttactttccctagaaatatcctgttatgcttagtttttttgtttttttttttctttacctgttcattctgactgacttgcttctgttaaagatgacttcgtctaaagagtaatcttaggcttaagttgttcttttcttcatttgttttagaaagattcaggagatttatgatttaaattttgacgttgtgatcattacaattaaaacacattttaaactaatagtaaaaatattttctacctaagagaaacagggctaaacctattacaaaggatggctcactgtggaaataactgattgtcatgatgtggtgagttttgctttactccgctaatgtggctacgtgacgctccttctggtcttaactgcctggacaaatcatagtggccttatagtagctggtactgttggaagactggcctgtatttcagtggatttgccagcttttgaagaacccatggtgatttcttctgaggtttgcatgttttaacttccttcatgcaaatgcttttagttactaagatttttattttatgttgtgtgtttttccatggagtatggtcattctgtgttttgagggcaaggcagtggggtaaagctgagttgaaaagcataatatggctcatcttttcttttcttttttttttttttttcattttttgctgcttttattttacgaaaaagctaattcaaatctacattaaactaagttgaatacaaagcctttgtgaagaaggcctggtagtctcatttacaaaaatggccagtgtcgtctttggccttaaaatttcaggacgggcacttcagatggcttcacatttgcatgtttcagtgctagagcatgggaatagactttggcatccactgtaagatgtttttcagctacgagagcatcgagtccctgcagcaggtcattcttgggtaacgaaatgacttccacaaattctccatcccctggctttggcttgggccttacattttctgcgtcatctccgttaatgattactgtcacgatgtgtgtggtacagtttgacaaacctgggtccatatagaccactggagaacattcagcagcgtcccctttgtagccagtttcttcctcaagctcccaaagagcagctgctcctggggtttcaccatcttctatgagttccctgcagggaactctatgcagtagccacccattggtggtcaggactgtttcaccagaacgatacactcgtagtgaagcgttctctgcagcacagggatgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacggtggctcacgcctgtaatcccagccctttgggaggccgaggcaggcggatcatgaggacaggagattgagaccattctggctaacatggtgaaaccccgtctctactaaaaatacaaaaaattagccgggtgtggtggcaggcgcctgtagtcccagctactctggaggctgaggcaggagaatggcgtgaacctgggaggtggaacttgcagtgagccgagatcgcgccactgcaccccagcctgggcgacagagcgagagactccgtctcaaaaaaaaaaaaaaaaaaaaaacaactgactctcattgttaagtagtcagaaagaagtctcttaaacaagagtaccaatatcaaaagcttcattttagagattacttttgatgcatatattgtaaagccacttgtttgagatttgaagtagtcaagatttttcccatatatgatttactttatcttgtggtggctacccagttaaatatattcctgaagagtgttaatgtgaggaaactaaattttttgaattgagtcattttagatgagcaagaattttttttactgatttctattgtaatataattaatctgattattttagagcaagacagtatccatcccacccccattcctactctgtcccatgaacatatgctataagattttttacttgtcaacatcttgaactgagaagccagtattaaaatcttaacctttataacacaatgatttttgccatttgcagatgacaaaattccctgttattcttaatttagaaataatgtgagtggacttgtttctagtttgtttttgcttgctaaagaacacaagttgtttgggtttagggtggggtttggcgcaccttttctgaaagggccaggtagttaatattttaggcttgggaaccatatggtaactgtgcttgttgtaattggaaacacctatagactgtacataaatgaatgggcatggctgtgttctaataaaactttatatataaaacaggcagagcctggggtttggtgactccagcctagaattttcttccatttaagctgatttcatgtctgaaagaaagtaaaagacaggatgtcaaattactgcattaagttattcctataacgtaggcacctgtggcttatagagactgttgtttttaagtgctgctatgttgcctttatatgtataaccataagcaaaaatttctttcatcctgctctaccttttcctcaaatattttgactacctgtcatgtaccagatgttaggctggggataaatggtgaagaggcagagtggcccctgtcctcgtagagctgtagaccagtacagggggcagacagtaagcaaataaagtaattctaggctgtgataagcactatgatgttatcaagcatggtgctgagagagaattggggggtggggtgttatgtatatagagtgttgaggggaggcctcccttaggaggtgaagttgaagctgagacctgaagccaagaggatttagtcatgtgaaaaacctgatgggtcagaagacagtcatcctccccttctccctccctggaatgtcagtcagtataaacgtggataaactgttcacattttcagaggaaatattaaaagctattttataatatttttccccctctttttaacttcctttttaggtaagattaaaagcaatgagaacaaacaaatttttgtcttctggttaacacatgcacatacattctgagtatacattgaagtgttagctaccaggataaaagttatggcattgtggcctattatttagagcctttgggatgtgtgaagtttgttaagcattgttcatttgcattttataaggttgaaaccgcctgtatttgcgttctcatggcgctcctaaaggaacatgcggtgggagagcgccctctgctggcgactctccctcatagtgcctgctatagccagtgtgagaggcgaggcttccctttccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgttttgtttgtcattgtttgtttttcatttttattttgtcccaacattttcctttatggtccaccattagatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaaatgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttttccctcgatctgctgccaggcagttgaacaaaagaaaaaaagagctatggagccaagctccagttatgccttcctggattctcctcccaacatttatgactgaaggggccctttgcctagttgggaagatggctgggtagcttgaggcaagcataagcaggtgagttggaaccgttcatcatcttcctgacaaaataaagaataccgtcatctggtatgtatccggtacatttcttgaaaggatcccaaagcccagtgtatttctgaacctccactctgaatttgtttcatttacttatttaagataaagaagcaaaagcccagaagggcagtgacttttccatgtcatgcactgaatcacgtggcagagctgagtatagatcccagatgttctgataacatgatccaaactataatcccatgtgattacacactattttgaaagtcattgtcagtgttaccacaatgtcaacctaaagaggtatttttttcccctttatgatatgtagaagctgaattagagtgaatcaaagatatcagatgatgcttagaaagagcagtactttttttttaatgtttttgcttagaaacactgtcttacagtaagaggacctaagggcagagggaggagctcaattaataaatagtgctaatgagaccaagcaaattcatttccttcctgagagtgtctcctagcagccctttcttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggttttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaacagaatggaaaaataaggccaggtgagtaaaattgttcagagattttaaaaattaaaaaaagaaaaaagacattagtgaaggagtgcagtaaatagccaacagctgttttcattctcctgaaaagtagtgaagtagtgatggcaataattatgaagaaattgaatgccgagtaagagaatgcagtaatggatttagaacctattagaatgagccataggaaaaggtataaatgggttgtgatggaggccaaggacagagaattcatttggttaatgtcccagtatctataataatcagtgaaagaacaagaaaatcatattaagaaagcaaaagcagactgggcacagtggctcacatttgtcatcacagcactttgggaggctgaggcaggaggatcactcgaggccaggagtttgaggctgcagggagtggtgatcatgcactgcactccagcctgggcaacagagcaagaccttgtctttaaaaataaataaactaattaattaaattagataaaaaagcgaagacctgactcattcacattttcctccagaaatagaatctttctaacttcttgacagaaaggggatataataacctctttgactaaaggagacaaagacagaaaatgtgcaggccaggtatcattcacagaaagaaaggggaagtggaggatttttacattttaagacccaactggtattctgctattgctggtttactttgtggcccctttttgttatttcccttggcatgaaaagtatcatttgttatgtgatttgttaaaggtaactctaaattctgttatctgtactcctaacaaaataaagaattccatcatctggtatggatctgttaacgtttcttaaaaggaccgcaaatcaaagtgtatttcctatccccttttggaatttactggcctctgtctttgggcttagggagcgtaaaaggcagcgtggagcacatggctctagctccctccctgtggccagccttaaacagattactgctaagtcatctgaccactagggagttcagttcagaggacgagctaaagtagaaaaattatttgggaaagccatgaagtaaaattgcttggccatggtgcttattaaagatgacacttcacctgaatgagggaattagtagttaacaagaacaggactagaaaaggggtttattgaattacattgaatatttttaaaatctcatcacttctgctcttagtaggaacatgataaacagttctgacattttagaagagggtgagttgtattaacattgatggaacagttaaaagagagaagttgtagtacagcttacatatgtgcctatacatatagaaaatctcatagttctgcccttatcagatgcttgcagagtattctgcagacttccctccagctgtttgttaaatgaggttagtctgttcgctagttgaagagacttgtggaggaaatcatgtggcatgctttaacactctcagcagcctgtgacttctgttttgcctttgccattagcctctaaccttctcctcttctcctctttcttcatttaccattttgtgtttgtggcaagtattttaaatgtaccactaactaatgtctttgaaatgtggcattgcttattaacccagatgcccacgtgtgtcttaattcggagggatggtgccttggagaacctgtgccgcaaaagtttagtctcttccttgaatggatatgttggatattttattttgttcaaagttgagtcaaaatttttggaatcatctatatttctcccacaaacaggttttggccatcagtacttgaaaacagttctatggctggcatcctggatcaaggggcagtctgtttccagggaacctaaaatatttaacagtaaagatgatgctaaaaccaaagaaaagtaatttttcttatctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccatgaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgctactatcgtgacctttatcagaagggtagttaactgaagtccattagcatgctttccaattcatccatttttttaatgaccaaaagaggattctttatttaaaaacaaaactgaaatatccaatactaatatgtactatatttaaaagaaaatacacaaataatatagaataaatacaaacactttggtacagttaggtaccttctttattaattattaactacttagtctaactcttgttttattatcagagatgattggggcacttctttctttgtaagatacccttaatattttggggaaccaggttggcatcacagagggcccttcccagcagctttgtttctacttcagctatattcaggtcgtcttttgatttatctttattaaagggatgactgttctctgaatgagatagttctctcttacctgttttcccttcctctttttatttacatgttcaagtagaaagggattacagccatttatgtattcaattcctaaaactttcttttcaaatcagaaagattctcaattgcttttcaaagcagacctttcctcctgactccacatgcaataattaagaagcggaaggctgggtgtggtggcgtgcacctgcaacctcagcactttggaaggctgagatgggaggatcagttgagcccaggagtttgagaccatcctgggcaacacagcaatactgcagctctacaaaaaaatttaaaaattagggcatgatagcacatgcctgtagtcccagctacttgggaagctgaggcaggagggttgcttgagtcaggagttagaggccatagtgagctgtgattgtgccagtgacctccagcctaggcaacagagcagagactgtgtctctaaaaaaatttttttaataaataaagaaggtgaacttgcccaagcaaccagatttttttttttttaagacaggatcttaactctgtcaccccagctggagtgcagtggcacgatcttagctcactggaacctccacctcctgggctcaagcttcctgggctccatctccctgctcaagcgatcctgttacctcagtctcccaagtagctgggaccacaggcatgcgtcaccacacctggctaattttttgtatttttggagacaagttttcaccgtgttacccaggctggtctcaaagtcctgggctcaagcgatctgcccaccttggcctcccaaagtgctgggattacaggcgtgagtcaccgtgcctgggcaaccagaactttttataaacttgtgtgtgtatgtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctactgaagtcagcactgtcaaaagactgctggtccaagactttctttgggaataccaacccctctaccaatttagctgtttgagaaggctgtctcagggctacttcttacatatcttggcctcagtttttaaacttctcatcctgtgatcagaaagctaatgaaagagaatttgattgatgagcattctcgttcacttgaaatgcaactgtgagagatagcaggaataaagaaggtgatgatcataactagggaagttaggatggcagtaagggagaagttctatcaaagacagttagaaacactgaagttagtggactttgtcagttaacactcgttccttagcaggaccaagattctttctttgagagcagtaacattattgaacaaagtcattctgaaaacccttgttttttcaggcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaatgagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccatcctctcctgtttgtggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactacaggcatgcatccccaagcctggctaattttttaaagaattctttgtagagacagggtctcaccatcttactaatcgtggactcctggactcatgcagtctgcccacttcaacttccaaaagtgctgggattcagacgtgagacactgtgcctggcggactatattctttgaaggggaggagtgatgtgtgcttcagatggcccctgaaagctgctttgcctgaggctcattccctgactcttgaagaggacagtggacagtgctgtttaatggtggacacagaaggatcagaccaggacctccctacaatagggaagggagctatgctatggtaacgagtataatctgccttctcacttttcttaagattgtattgtgtggtgtgttttaaaatctcactgcatttctttgcatctgtttgggtcatctgtcttcttaagggtcttggcagctatgcttcaggtttagttttatctttttgagggctgacagccatgctgacctctttagaagctggggtgaaggctaggtgattttacctttttaagtacttcatccatagtgattatggagaggaattttagtgtcgctgtgataattcttataatagcagagatactcacgctctttgaagttttgggcagttgtggatgagttcgtgtcagccttggagacagagagtatgtcatatctcagctgggtcgctctcctgccctaggatgaatccacagtctcatcaggggtgggtacgattctactgagactggcttaggtttgcatctgccctggcatgctctcattggctttgtgtgatttatttgagctgtattatctagttcaagggtctgtgagaagctctctttgagccttaagtactacaggatgttgggaaaagatgttgtgttctttctttccttttttttttgagacagagtctcgctctgtcgtccaggttggagtgcagtggtgcgatctcggctcattgcaagctccacctcccggctttaagtgattcttctgcctcagcctcctgagtagctgggaatacaagtgtgtgccaccacacctggctaattttttgtatctttagtaaagacggggtttcaccgtgttagccaggatggtctcgatctcctgacctcgtgacctgcccgcctcggcctcccaaagtgctgggattacaggcatgagccactgcacccagcccgtcgtgttctttcttgtcgtcattctgttctgaagttgtttcattttataagccttaagttttgaacagggcagtactcactgacaccctcttaacagactcagaaagatgtgttaattcattttttagggggagaggggagatatttgtgttccagcagcttatttaggtcacatacctcctgataggtcttcccattctttgaaatcatgacattgaaacctccaaaagaactagataccactttgctaatgagttgaaaggaggctttggtccatctggtgctcagcactgtacttctcagcatttaaacgtgccttacagcccattgccaaacagtgatgtcatataatgaggctccccttgctgggcagatggagcacagtgttactatcacaagctcgtgcccagcatattaactgagcaggaacatgccagaaatataaatattaacagctctgttttgtcagccactgactttgtttcactgctattcccaaaacatgaattaaaacttaaattaccccttgatgttagtgtatgtatttatctgtcaagattttttttttttaagagatggcatctcactctgtcacccaggttagagtacagtggcacagtcacggttcatgataacctcgaactcttgtgtttaagtgatccttcctcttccctatcccaagtagctgagacaacaggcacataatgccatgcccagctaataagatctttgaggaaatttgttcttgcccctgaccttattggttataagaacatggtcctttttaccctaagggtaacagagacttgtcgtataatctgtgttcaattataaaatcaacagctgataaggtttctttttctaagaagagaagaccatcagaagaatatatatatatataatccaggcattcacctagtactgtaaagtgtaaacttatgaacttgaattgacacatgaatatttactttgtttctgtatccccttgaagcccatatttctccagtggattactctggaattcaagctgtaggacgggtgttttacagcctccaatatacacagcagtagatctctataggaagctgtcctcttcactactcacccccacaccctccacatttaaggagtaatttgcaaagtctcaaaagcctttttcaccacagtgataactggttatatggcagtatttattctcccaagtgccaccatgctgaaacacaaaaatactcatttgaaatatagagttagacaaattaccattttgtaaccccttatgaaataattgcttttgggaaggaaacccagtgaatgcagaaagccataagtgaaaagaatggatatttacttggtaccaaaatatcccgcagattacttgctttggtcaaaggggaaacatcttaacccagtgatcaattttagctcattagtagtgggacagatggccttaatgcactgtcacgtgcacagcatcacctgtatttttgctgaaaatgtttaacctgattcttaccaaaatttttgacctaacttccggtttttgggaagtacaggggatagtggaaagcagggtatagacacatgacagcaaaagaagcaaaatcagacacatcccgagaaacggtcattctcaggacaatcagagggtctctttagatcaaaatcaggaaagaacagggcttagactaagagagactaaagaaaaccagtcagttgcagtgcatggcccctaattgaatcctggtttcaacaaactagttctaaaagacaacgttggaataattggagaaatcttaacatgaactggattttagatgatatttagaaattatttgtcagagataataacagtattatgattatataggaagatgtcttcgtgttgaaatatttggggagggtaaagtgtcatgtctataattttattttaaaacagttcagaaaaaaatacatataaatacagaaatataaaaatgttaattgttgaatatgctaggcatatgagtgttcactttatcatagtttttacttttctgtttctgtatatttgaaatttttcatagtgaaatttttaaaaataaaattccctttgattttaataccatgtctcaccctcatcaccatgtaaaacccccagtttattcactgtttgaagatctgttgatgaatatttgatgttagtaaataaacagcttagggggacaaaaaaaaaacagccctgcctacctattgtaggttacttcagctgtaggctttgttttatacagtttgactacactggtagcagtttgacattgacggtccacaaaagcctgttcaaacagaatcccagtcatttaaaaaaattcttctttagtaacatattctttaaaaatacaaaatacaggaggagggtgagggttgagagataacctatcgggtacaatgttcactatttggttaatgggcacgctagaagcccagtccccatcagtccgtggtgagacccatgtaacaaatgtgcacatgtacccccaaatcaaaaataaaataaaaaaattttaaaacatagaaaatacagatacacacacacacacacacacatacacacataaaggagaagagggctaatatatcctagagtaggtattttggaggagagttctttgtttggatatgaagggtcaaaactatgtttgctcaataaggcatacttttttgtaacatgttaaaaactcttttccttcctgtctctggtactgatagctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagtaagtcctaagggtaggattaacatcttgaaccactaaccaaaagcggtgggaaaaataaaaactgaatggtcataaccaacttgctaaagcttgtagatgaggtctctaatgcagaatgaatatgttctctggtggaaactgttgtagacagtgatactctctggacctttgagatacttatgtctggtctgattttatgcacagcccctcacataggagttttgcatggagagttgaggttttcagagtcattgcatttacaacatctctctgagcttttacagttttacaattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccatagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaaagaagtagtagattttgtagcatgtgatgtaagtaatgtaaaacttaaattccagtatccataaataaagttttatgagaacagagccgcactcatctgtttatgtattgtctgtggctgcttttgtgctacagtgacagaggcaaatagttgcagcagagactataggacctccaaaatgtcaaccatttaccatctggccctttagagaagtctgctgacccttggcccagggctacagttttctcatctataaagtgaagttcaggtttttttcatctttgacatttgagactatctataagccatatatttttattataaaactgccagagagaaggtttggtttgtatatataggtgtacattgtttgtaagcttttaggcgaatgtattttatgactctgttttgtcttagctggctacggtccttgaaaatattcttcagaatgactgaattgcatcacgggatgaaagagccacggggtctcacagctgagttctcagggactttgctgatgtgcttcctttcttggtgtccttggaatgacacccagcaggtgtcccagggtggattgtggggctcagcctgtgaggatattgagagctgggtttttgtccaggccctggctggcagctgggaatgaaggcagtgatcgaaggcagaccaagcatagtctcctttccatccccagtgacttcgtaaggaggtgagagaaaagggccccggttgttacatggggtcctttagctcctgttaagaatcagacagttggccgggcgtggtggctcacgcctgtaatctcagcactttgggaggctgaggcgggcagatcacgaggtcaggagatcgagaccatcctggctaacacggtgaaaccccgtctctactaaaaatacaaaaaattagctgggcgtggtggtgcatgcctgtaatcccagctattcaggaggctgaggcgggagaatggtatgaaccagggaggcggaacttgcagtgagccaagatcatgccactgcactccagcctgggtgacagagtgagactccgtctcaaaaaaaaaaaaagaatcagaccgttgtagggagtattttgccttcacataccagacatgagacatgagagcagccttcctcctaggcttctgagaagagggcctgcttagcccaaagagagctgacaccacaaaaagctcccctgaagtgaatccacttaaaacggggaccaaaatttcatatgtggtggacactgggggataggggaaacctgaatggaactttaatcatgaaaatggaacaaaatgacaaaagcatgttcataattttaaagatatattaattctgacaaggaaattaagttgtttttgaagtgaaactgattttgtatcttacaataattttctcatttgatttttgcaacgtgatcatagaaggaagttttgcaaaaatatttgagggcttcatcagttttcagaaggcctcttgatattttgatattcacattcttttttataagtatctatcggtgatcacctcctcaactttccttttattgttaactggtctgagtctgtcacccacacttttcagagcttttgcttaaggtt

SEQ ID NO: 11931 - DNA, 8180 bp, Human
tggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccggttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctacactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctcatgcgtttcctcatgggtctggtttgttgtctgtttctcctgctttgcaccttccagtctagagtttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatctgtgcttgagttaccttattgtagaatgttcttgagctgagaagttgggaaccacgaggctttagctctgagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatggtaaataaggtcccaggaaggggctgctggtggggcagccaatggcttggtcttctctcctctcacagatcagggctgctccgggcatggggtacaagaagagaggaggggctgagtgcaatggctcatgcctgtaaccctagcactttgggaggctgaggcaggtggatcacttaagctctagagttcaagaccagcctaggcaacatagtgagaccctgtctctacaaaaaaatagccaggcatggtggtatgcacctgtagtcccagctactcgggaggctgaggtgggagatctcttaaactcaggaggcataggttgcagtgagccaagattgcgccaccatgctccagcctgggtaacagagctagaccctgtctcaaaaaaaaccagaagaatcttggaaggaggggtctaaggttctagggggccagcagagctcacttttctagcctcttgaaggactctgggttagaagtaaattaggtctgggtgaaggatgggaaaagtcagtagcaggggttcttggactatgggaagctattggaaggggttatcagctttcccctctccctcagatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgac

SEQ ID NO: 11932 - DNA, 41522 bp, Human
attccggggagctctgctccagctacactgcacataaaagtgcgcaggaagtggatcctggagaggaactgttcttctggactgagcttgctgctcatggcagccccacctgcaggacccaaagccttatgtgatgtttgctggacactcagccacgtggctgcctgttgagctctgcaagtccacgcgggagccaggaattcctccccagaagtctctccattatattcaccaccccctagtaaatcacaacctgacttgctgcagaggatggagtgcctgggactcgtctgaccccagctcccctggggaagtgggggtggtacgtccctgcacccggccacgtgctgccttctcctgggctgcctgtccatgccgagcagacaggaaagtccagtgaggtccctgcctgtgcactccaccaaccacatcgtcccttcccggcagcctcacctaggcccctccagctacgaccccttgtcccctgcaccgatgcctggccttggaggttgctgctcatttttccggaattttttcttagatctctgcagggctgcccctccccctacaagggctccacacgtgttccctccttcatgactcccactgggcttccccgacagggcctcaccctccccaaagctctggtgacacctgccaggtttcctccaggccacagctcggcagcccgatcttagaacagaacgtggcacgcagggcaggtctggctgagggcccagcattgtcagcggggtcggaggtcttcccgggcctcgaaggggagacgtaggcttctcagggcagcccaggacgcgtcctcacgaaccacagcgaaattacagcaggtatctcgcggataggagtctgcatcattccgtctccatgccgtggtttctgaaattatgcaactatctcggcattccagagggctcagagtagccacgcgcagaggccctccccatggggtggatggaagcgtccactcgcggcgcgaggaatatccctgggcccctcgggagagtctgcaggggcagcccctgggtgagcaggcccagtgcggcctctccctgaagggactttcgggccctcccgggtcggggcttcaccggtagcaggcagggctttgatattaatgcttaaagggaaagcagagctgagctgtcaggacgttggttagctacaaaccctactcttgttaaaagagaaatggggtcggggagggggttctccagccctgaacttcccgggccgggcaggacgcggtccctccaggagtcggggctcccccgcctggggacgcactggggcaggcgcgcttctcctctcggggtcccatgtgccgccggctctcggacggtaaatcagggctcgggtgggggcgatgggggacccgcggcctcggtcgcccctggccagcctcggaggcgcacgggccaggccgcggggcgagaagcgagcgcgggagggcggcagctggcggagcgggaagggagcggggcggctgcggctgcggcgcggaggagcgccatttacgttcgggcccgcgccaggcgctgacgtgggcggccctgtctcggcttccgggcccgcagggtcctcggggcggacggcgctcccgccagcggcgctgagtccggcccgaccctgcccgacttcctcggggacaggcggtttagaacgtgcggaacaccaggcccggggcctccgccgggctgcagccccgcgagcttcccgccaggctcccgccccgccccgccccgcagccgcgtcccggccgggcgggccctgagccgcccgcgtgagtccgtgcgccgcccgcgctgggaaccaggagaccaaccgcgaggccccgcccgcgcgcgccgccgtgtccccgcccgcgcggtcgtcggagcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttggtaaggccgcgcgcgcgcgcgtttccggccgcgggcgggggcggggcggggcgggtgccgcgcgggcggggggcgcgggggcggaccgagcgcgcgcccgcgggccgccggctttgtgtgcgagtgcgcgtgcgcgccggcgtccgcgcgtggccgcggtcgggggcgggaccgcgggaagggtcttgcgcatgcgcgggccgctgcgtgtgcgcgagcgccgcagtctgctctccccgcccgcggcccgtgcaggtgacacaaaagggcctgtgggcctctgggctgccccgccggacccccagctccaccgaccccagccccgtcggacccgggacggcaccccgggtcccgatccccggccgctaccccgtccccggtcatgaccccgtggctgggcctgcggggccgggatggggcgggagccgtgcgcagctcggggtgtcctggggcgcgcgctcccgggccactcgcgggagcgcgcctcccgcggggaggccgccggcgaccgtggccgcgcgctgtgggggaaggggacggggcgcgggtgccgggtatgaccgtggaggaggccgctgccctcagaccgggcccaaagcgcagcccccggcggtgacgcgggagggcccggggtctccgttcccgcgaactccgcgaggtcccggaccggcccagcgcccccacctgcccttgcctgggcccgcccaggtcccggggcgccttcctcgcgggctgcggccgcggaagcagggagcacgggcgggcgccgggcttgccaccatcgccatcttgcagcgcccgcgtcctgggccggcccgagccgctgcgcggagcctctctttccctcgacccggctgcaaaggcagagtccgtgcgcctgagccccgggccgagactggagcgttctctggcggcctccaagggcgccggtgtctggaagcccggcctgggccagatcccttttgctgtcgtctccgtgattgccgggacagaattcccttccagtggggaaaagggaaggcggtcgcgcccttcccggtgccctgagtggggaggtgaaaccctgagagttggggcaagagggcctggagctagggccgaggcggcgggtgcgcagggtgttccgttgagcccgagccccccctcccccctccccggcctctccaccgtttctgtaggagcgcggcagggagcacacgtccctcgggaagaaaacggcgctggcggctgggcctgcaccgcggccgtcctcgctgagctcctagcgcgtggcctttgcgcgtctgtgtacccgtctgcagcttggggcagggttgggggagaaccgtggggtaactatttgccgttgcagctgaggatgacagctgcggtttgggggtccccctttctgtgtcctggaactttgtagggcgtggctctgccctgggcctcagcacccggcctcccaggtctcccctgcctgcccgggcctggccacctccctctggggtctgggtttggctcctggttggggctgtcggctccgcagacgccttttgctctctgtgattctgttgcccatctttgagcacctgcttccatacaggcgtcctctgcagagctctgggagggacacgcactgggggtggcatctggtcactcctgggggtgcctcgtccgcctgcccggccatttttggggtgtctgccatgtccccaacatgcacttcttcctgtcagccttgaccagggcagctgttagttctgagaggtgggcgtgtggttggggatgtcagcgagtaggatcttcccttttattcgcttgtcattaacctgagaacgtggcagtgggggaggagaggcttggcccggggtgcacaggactgtgggctggtcctgtccctctgatgagtgggacgagccttggtccagtcctgtgggcttggcgcagagccggccccctgccatgtcctggtgggattggaagtgctggctcgtcctgtctgcctcccccaagggctgggagccccccactctttggacatttgtagtgtaagcagacagcaactgttaaccatcattctgttaataaattttttctggaggaaccctggacagaagtagtcatgctctccaggaaacgggccccaggctcgagaggcccagtctcttccctcggggcttagaggtggccgtcaagccacacctggttccccaccagcctggcagtttttctggtttttctcctctgactgtcacttgccctctcaacttcctgtggccagtacccccagaatgtgacctggtctgagctgacggtggtgtcactgagccaagaggcgtgtggctggcaccactagtgttgctgagaactcttcaggcagcactttgtgcccggctgtgccctggtgctccccatgcagtgcccaagtcaaaggtgtgtgccctgtgaggtgtttaccccggttgactctccttgtagaaggacttaatgtttcccactccactgggggctggagagggctccatccaggtggtgctgacggtgcaggcctggcccagggcccaggggtggccaggaggtggtagaggcagcaggcagtgtcatacgggttctgtggttgaactgcatcgcccgagggaacgctggtcggagcgccgggtggagcgccagggtcctctggtggtcgctggatgttggtagttgtgggtaagagctctgtgccgggagtgtctggacccccgggtcctccattgtcagctgcagtggccggagcccactgctctcccccgcactgggtcgtggtaacccacaaggtgccacctgcgtcactgaccatcgtttccagaagcccctccggccacacattccatgtggtatctcccacaaggaaatgttcgtttttttccctgtgaagccagaaatttcttggtggctctttgccgagccaaacgttaaccttgagttgtctctctgggcggccccaggtggtaccagttctcacgggtgttgaaggagagtgaggatggccctgagggaagcccagttggtttggttggggaggcgttggggctatggccctgagagaggtgtgggcggtgttgggaccaggccccttctgcaccctcccctggcaccgccgttaactctccaggcctggtgtggcccaagccaccctgcctacccgtgctaccctacccacacgtgccaccctgacctgcttgtgccatcctgcccgcccgtgccaccctgcccacccgtgccaccctgccctgccgcccgtgtcaccctgcccgtccatgccactctgctatgccgcccgtgtcaccctgccctcccgtgccactcttccctgccgcccgtgtcaccgtgccctcctgtgccaccctgacctgccgcccgtctgtggtgtgggggctcctgggctgccctgtctgcgtggctggcaggagcctcagaggcatccgaggctgtctctccagtggtgtcgtgtgtagactgtgttgggaaggggaggaaggtgtagccctgataccccacatgtggtaggagccaggaaggtggcgttctgggggttcctggagctcacaggttgtgtgcatgtgctcgctgaacaaacagggaaacgtgcggctccacggatgtcctggagaggaatcttgctggcaaatccatgcctttgatcacagcccctgcgctgtgtcctctgagctgtgatgcggccctgcaggccccgtggagtgcggtggctccctggctcacagggatgctgccgtccaaggtgccgtatcggctcgtggatgacttgggcagtgtctgtctggggtgctgtcgtcggaggagctgtttcaacctgtgggtgacgggctttgtctgtctgggggaggttctgttggccccgtgctctcagcccagtggctccatgctgctgtgcggctccctcttgggggcctgccttctctgccattgcagggcagggcctcagttttctctgggcggcaggtggctgtatctcaggactggaaggctccgggtcaggctgtgcacagccttcgttcatgtcagcccctggctgggcagcaccgccaggccctagtctttgggcctccaggcctggacagccagagggggcatctcaccaatgcccagatggctgccggggactcacggcagggcagctttgtcacgagagggccactcgagcccggagtaatcagggcttatggggacagggcagggtgagggccgctgagaccacccagccttagggtgcccttctggtggtcggggagcccttcctgggcagcggctttaggggctgctgtggggagggggaagaagatggggttggtgaggaggagcttttgggacactgtcctggtggaggtcgtgagggaggggagcggaccggttggcccagcagggctggccagtggagggacgtggagggttggtagctgccgagcctgggtctgagcaggcggggatgaggaccaggtgctgaggctggggaaggaacaggggtagctgcttggtcctggcgcatcttggtgccccctgggacttcctggaacaccccccccccccagtgcccagagacccactgtggctgtctggatcggggcaggtcccagcccatggtgacccccagtgtgccggggcaacccggtccctctccagaccagaatggaccgatgcccagcacacacgtggatcggggcggagtgggcaggcgtggccaacaggagggaggatccggcaggcagatggtgatgtgcatccagagacagggcgttgacatgtggccaggaggctctggggtcatcgggccgccaccgtgcagccccccgggacttgatgcctccagagaacctgggggctgctgcccctcacctcacccccatttactttaaaatcagtttttgttttagagcagtcttagatttacaggaaaataggaagcacaagcttccatgtgctctacactcacttccctcgtgggtcccttgagtgctttcttacaacatgaggttaagcgtctgcagggtgagaagctggagactgtcctcgtgtcgctgggctgagagccgtgtgcggctgtgagtttttgatgaggaaaagcagtgtgggtcctggatttggacagcacaggcccctctgggagccgtgtgccttcacctcggagtgtgtgggcaaggtacagagctggagcccttgaccctgaccggccagccaggaaggccgtaggaggccagctccctggcgtgaggtgcgcagggcctctggcattgccctaggtgagggctccaggactcggacactggctctcagtggggcaggtgtggcccggcagggggcgctttgtgggtgcacagtggccccagggtggtgcagatggtgggcagacctaccccagggctgtttctgagacagaggtccctggaggagaaccaggtgctgggcctcaggtgtctgtcctgaactggagcagccttggaacaaggaaccacaggaagtccctgtggcatggggtgcagcccctcaggtctggcagggctagcccagggagtgcagggccccaggagccctgccacaggttcctcagctcgggagctcacggcctcctcactgcagggtcctttcaggagggccagggtggccttcacacatctgcttcctcctcagagacacaggtgtgggcacgtactggccagtatagataagcattgagcagcattgatgggtatcgatgatcctccaggagcagcggctggtgccatgctgctgtgggcagtattgagtattggccggtcttgacgagcagcagccggtactgggccaccgtgggtagcattgatgagtattgactggtatcaatgagtatcagccggtatcaatgagtattggcccgtatcaatgagtttggccagtattgatgagtattggctggcattgatgagtatcggttggcgttgatgagtatcggctggcattgatgagtatcggctggcgttgatgagtatcggctggcattgatgagtttggctgggcgtgggtggcgcggtgccttgccccctggccaggctggctcgtgggtgaaatgtgacatttaggcggttttctcctgtccttttagtttgtttttatgtggtatccgggtaccatggggagatctggcattcagggcaggaggctgcagcgcaggtcatgggggctcaggcgcaggtgatggggatcccgctccacagtgttgctcttgggccctccgtcagggagtcccacacagcacctgccatgaggagtggtgttggggaccctggatgggaggtgcgtgcgtggggctgcaccccagcccctgtgatggtgtctctggaagctggagatggtcggcatgtatgcttgaatcctgcagagggagttgagggttggagatttgtctgcgaggcctctgcgcaggggcggcctcacagcacactaccagggtcttaggcttggctgagtggccccttctggcctggcaggcagtcgtctcagcccacgcctgccacgctgctgggctggtggtggccggctcctgtcctggtcagcctgatgtcagctgcacgttggggtcagcctcggtgctgtgtcttcatgccagagcaggggccaggtgtgggcagctcagtgacaccctcccgagggctgggcgatcgtgtgcactctcaagcctctactggaaggcttggccctctcaggggccccctgcccctgtgcattcagccactggggttcgtgccctcagcttcccgccaggccctggccgtagcggtcaggaagagctgagcagtttttttgggagaattgagggagcgtcgccaggatgcactgagggtcggaggtggagccggcgcggctcagtgcaggcagtgccaggctggatgctggaaagccagcagcacctctcccggtggctcctgggaagttccacgtccttgcctggtcacagaggcccgggaatcagtgacatgagatagaagcttccagaacaggaggcagagcctttccgcagtttccctgcccacagcacacaccctgtgccctccgccccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggttggtaggggttcctggcgtcggcggcagagtgaagccggccggtctctttgcgaccgtgtggaggaggcactgcctcggatcaagtcgagggacctgggctgcatgggcgtcgggccggactgctgccacctgacccccggtgtgctctgggcgaggtcaggtgcccctcgagggagggcttcctgcacacctggtggcagagcacagctgtggtcaggcctgtccgtggcatctgctgtctgtttctgtcggaaagtgtctgagaggcacggagggcctccatgtggaggccgccagcacgagggtggagccccacacggaaccctggaaatctcaggtgtccacccggctggcccaggagcagggccgtggcccctgtggagctgttccttgtggttggtctgcgctctctggcccggaagtgcgtgcagtcggaaacagccttgggcttgggggatgctgcaaagcctgcttcagcacaggccgtgtgactgtgaagcctcctgggtgtgtccccaagcctgcaagggtgggctgtccggggaaccctggcacggtggtcaggggcagctcatgggtgatgtgaggaggcaccttgggtgcctgagcctgatggggcttggtgtctccacctgctcccccctccccaccgttcagctgagggacccggttcccactcacccagcacccgggagtcccccacgcggttccgacgagggacccggttcccactcacccagcacccgggagtcccccacgcggttctgacgagggacccggttcccactcacccagcacccgggagtcccccacgcggttccgacgagggacccggttcccactcacccagcacccgggagtcccccacgcggttccgacgagggacccggttcccactcacccagcacccgggagtcccccacgcggttccgacgagggacccggttcccactcacccagcacccgggagtcccccacgcggttccgacgagggacccggttcccactcacccagcacccgggagtccccccaggcggttccgacgagggacccggtcccactcacccagcacccgggagtgccccacacggttccgacgagggacccggttcccactcacccagcacccgggagtcccccacgcggttctgacgagggacccggttcccactcacccagcacccaggagtccccccaggcggttctgacgcagccgagcggtctgcagtgatcccgtgtgtccatgccttcctcatcagaagtgaaatccaaggatactgagagcggatgtctatccactcactcagaaacagcaacataaacctttctgctcatgagaagtcatcaccaccacacacagcggggagggaggccacgtgcagagggaggccatgtacagtgtcactgggcggcctgtctatggtgctcgtgggcagctcccgtccagagggaatgaaggaacaggcgaaccaggacgcggttttgaccgtgcagacctcacgtttgggatctggtttcctatcttgaaggaaagtgggtggaatggccagtggctcctccgaggacgccagggcgcgaggacctcacgggaggggcatgggcccagccgtactgggagccctcggctttggggtggtcagtggagacccatgccccgtcccctgcaggcgtgtgctgcaggcccactgcacccctgggctgtccaccagagcatttcttttctctgccatgggttccaggaggcacttccctgcttcctggatactggcagctcggtggcctctgctcacctgcaggcggatggggcagcggatggggcgggagactgggccgagcgtgcttgtggccgcggccactggagagcctgctgggtcactctgctccttggttctgtcctgcgcctcccctcctgctggccgaacggtcctgggtactgcttggtctcctgtggccggtctttggaggaggaggggagggaccggctgggccctggccccagctccgcctctgcccagctgccgtggggctgacagtggccccacctggtgctccctgcctggcacggggcggtcgggcggtgcctggaagctgccatgcttctgtgacgcctcagagcccttatttctccagttggccccgatgaggcttagttgcgtcatacgcgaaaggaatgggtgttaatgagctttaatcatctggttctgggaaggtcaggggcacagagtggactttaacaggttttaacccttttcttcctttgttctgtttcttttctcttcacatctataattggaagtaatgccaggcagagggttgggggcgtcctacgtgaaacactggtgaccccatcagggattccgggcagccacgcggtagcccaggcaggaaagggacaaccatgttcccaaagtcccgtgctgtcatcttgtgtcctccagtgtcctgggtccctcctgtccccctgcctcatggagctgccctggggtctcggacggtctgggagggtctcggggggtctcagagggtcttggagggcctaggagggtcgggaggtgtctcggtgggtctggaaatgtcttggggagtctcagagggtctgggaggttctcagagggtctggagatttcttggggggtctcggagggtcttggagggtgtgagagggtctcagagggtctgggaggatctcggaggggccttggagggtctcggaggggacttggagggtctcggaggtcctgtgcccaagggagatggtagtgggtgtccacagtctgtgtccacttgagtcagcgagctgaggcacacacgagttgtctttcacgtggatttttaatttactttttacaaatatcacaacatatagaccagaaaacccccggcggtcggccctcgttggcccgtgcacagtgggtggcgtggagtgggttgtagccacggggccgcagtggtgcaaggctgagcacttgcctctgtcttgcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacggggttttccctgagccccatcaggaggtggacacggggtttgtcctgagccccatcaggaggtggacacggggtttgtcctgagccccatcaggaggtggacacggggtttgtcctgagccccatcaggaggtgaacaccgggttttccctgagccccatcaggaggtggacacagggtttgtcctgagccccatcaggaggtggacacggggtttgtcctaagccccatcaggaggtggacacggggttttccctgcacaccatcaggaggtgaacaccgggttttcactgagctccatcaggaggtggacacggggtttgtcctgagccccatcaggaggtggacacggggttttccctgagccccatcaggaggtggacatggggttttccctgagccccatcaggaggtggacactcggtttgtcctgagccccatcaggaggtggacaccgggttttccctgagccccatgaggaggtggacactcggtttgtcctgagccccatcaggaggtggacactcggtttgccctgtgccccatcaggaggtggacactcggtttatcctgagccccatcaggaggtggacactcggtttgccctgtgccccatcaggaggtggacactcggtttctcctgagcctcatcaggaggtggacacggggttttccctgagccccacactcggtttgtcctgagcgccatcaggaggtggacactgggtttgccctgtgccccatcaggagatggacgctcggtttctcctgagccccatcaggaggtggacacggggtttgccctgagccccatcaggaggtggacaccgggtttgccctgagccccatcaggaggtggacatttggtttgccctgagccccatcaggaggtggacaccgggtttgtcctgagccccatcaggaggtggacattcggtttgccctgagccccatcaggaggtggacaccgggtttgtcctgagccccatcaggaggtggacacttggtttgccctgtgccccatcaggaggtggacacttggtttgccctgtgccccatcaggaggtggacaccgggtttgccctgagccccatcaggaggtggacaccgggtttgccctgagccccatcaggaggtggacacggggtttgtcctgagccccatcaggaggtggacactcggtttgtcctgagccccatcaggaggtggacaccgggtttgccctgtggcttcttgattcattttcagttttttcccagagagcaggtcctcgggatgccagcttttgtggcgggggtggagtaaggtgcttcccccggccccagttgcgcggcggtcttcacacgggcggtctcggcattgcccgcggcctggctttggtccagcagtgagcagcctttgggcagctttcctgattcttgtttgctcaggagacccacaggctcctccgtgatgagaactaggttggtctggcttctacttgtagccagggatcagtgattcagagcagcttttccctgaagacagacgaagaagctgggcccccaggagctcacaggatagggccaggcccaggctgcagcctggagaggcctagaacctgcaggaacgggcgggccttgccaactctggcctggggtgttggctgttctggaagaagtagctgagaggctgaatttggctttggtggcatcactggcctgctgggtgtggggccctgccgggatatccatggcctgaaaggtgacatctggagtgagggtgacctggactctgacgcgccacacgatcggcacccagcctgctgatgtccaggaaaccttgaatctggatttttggggaccccgcactgccggccccaggtgcctggcaaaagaagtaagacggcccctttagaggaagacagcgtcagccgaggcctcgggtcatttctacaaatcaccatctggtgcggggtccatcacatgcaaacagaggtaaccaggcagtcaaggagatgcgcaaaacgcagaagccagggaagcagtgccacccgcaggagctccccgtgctgcccacgagccgatcaccccagcccagcccccaggaggctgggccagacaccgacgaagagctgatgactctggaacggggcgtagcagcgttaggggagaaaatgagatgcggatctgagaaaacggcgaagctgatcggtggaactgaggggcgggtttaccagctgaccaggcggcagcggacaggagggaaggagagaacgcgggagagggcgagatgaggaagggtcgctcttgcagaaacttcagaacaggagagggaaggggttggaagtgatgatgacagcaaaaccctttccaaaatggacggaagaaaatctgatgttaaaaatgcgcgtggtctgccgggagcgtctgctggggcgttcgctctggaagattcttcacggtttctcacacgggtagatgcgtgcttgtaatgcagcccagtggccacactcctttatcccggagactcggaatgcgcgtccacacacagacctgcacgtcatgctccctagcagcttaactcaccatagcccaaaccagaaggacgccccccaccggctgtccttcagtgggtgagtggccaggcaaatgctggccacctccctcggtgtcctcctcagcaacaggcatgaacgctgggtccctgccacaccctgggtgatctcggcagcatgatggcgagtgaagaagctggtttcaaggggtgcacactgtatgatctcttcatccccaggtgataggattagcgtgacggaaacagtggcccggggtgtaggtgggggggccgccggcaggccggtgtctggaatcggcacatgggcacgttggcacgtcacgtgggcatgtccacacgcatgcaaggggctgtgggtgaactgcccgtggtgcacacctgagggagttgtgtggcaccagctcggtttggacagtgccctttgttaggtacggttttctcattgggaagctggatttgtattaaagatgcacacgtaagaataaaaaagaggctcgtagaaaacttttggtgtcgtaaacaatactcaaacagttttgccaacaaattggaaagctaaggcaaaacagatgtttttctaaaattgcagtaatcccaaactgccttgacaggttcatataaaatgcagatcagtggttggggtggggccggcgtgggccctggcatgagacagacttcctgctccccacccaggctgcacagcccagggcagagaaaggacaacataaatacacagaaaactgccccaggggatgcagctggattcttggaagagacgagagtgttgggaaccgtcctggcatcctggaggggcctgaagcagcccctaaccagaagcagagccggcgccacagaaaggagcccccaagaactaggagagcttgaaattaaaaacatgagtgaaaatctcataaaaacaggaagctcaaagacacagggacattgcagaagccagagaggtgaagagaagccgtgacctcccggggctgtgtgtggagtctgcaggggctgcctggatgccgagtccacgtttcgcagtgtgtggtcctgtgggaggacttggctgcccacgctttcttgccactaggggtggccaaaggattgagctccagaacagaggggagcagggcctctccctgccgtcccctcctcgtccctgctggctggaacccggggtagccaccttggactgtgaggggagccacgtgctgggaaccgtggagcaacaaggcaggaggcagggaccctcgtggctgtggagagggcagcggggccgcaggctccctgtctccaggctttggcgtgggaggaaactgaacacctgctttgtgtgccactgttagtcaggaattctgcctcctggggcagaaacttcccgcatagctggttggaggtcgccgccgtctgagtgccgtggagggagagaacgtgataccgtcagtgcggtcacaggaggagcgggaagaatgtcggggcctgggaggcgccccagtgttcaggttcaggactaggattttactgataccacgggtgggggatgtcacccaccgggacacaagactcagcccagccccactcgcctgctttggaatttccacaggagaagggttttcagcccagcactgcacatctgatcaaactgctgagcaagaaaaaggaagccctggagcctggaggctgcgtccggtgtgggctgcggggcctggagcggcagggcggctccgggagggcacaggacgcagtggcctgcgaggacctgcagccagctggacagttgcactcctgcaagacaagcatctccacgccttgggggtggggaggccaccagaaagctccgccagacagaggtgctggggctgtgcaggaaacgaagtgattagaaatcccggaaaaacacacaagcaggcgttgtcatggtgactgggaaaaacacacaagctggcgttgtcatggtaatggagtgtaggacaggcctggagcccctcggtctcttgctggcggctggcacagagacgggctgccgtgggctctgaccttaataccgggtcacagtcgcttctaggaccaagaggacagagaccccatcaccgtatgcaggggcctgtttccaggcagactgcccagtgcccagctgagcctcgggtgcagtgcgacccccgcagggcatgtccagaccccaggaccccctctcaggtctagaagatccagttgggcagtgttggtaccaccaagagtagacaggacagaggatcagagacaatcccacccagcaggacccaaggactcaggcagtggcttttcaggtgtgtgggccgaggactggggagtcggtgaattctggggcccctggggtggccgttcaggaactgcagcagctccccccaccacagatgctcgctgcctactgaagcggccacgtgtttgaatgaagagcagttagaggaacgcttgcaagagaatgtgtttattacctgaggttatgacaatacagaacatacaatgttttctgtggaaaatgtgatactacagaggaaaaggtcactttaattaaatggcaattagaagtaacagcattgcaaggtggggtgcagcagctcacgcttataatcccagcactttaggaggctgaggcgggtggatcacttgaggtcaggagttcaagaccagcctgggcaacatggtgaaacctcgtctctactaaaaatatagaaattagccacgcgtggtggtgcgcgcctgtagtccaagatactcaggaggctgaggcaggagaacctcttgaccctaagaggcagaggttgcagtgagccaagatcgtgtcactgcactccagcctgggcaacagagcaagactctgtctcaaaaaggaaaaaaagaaagaatgacatagcaaaataaatttaaaaaataaaaacgggagaggtaggggttgggtattttcaatttgtgtgccagcctaagggtgaatgtctgataacactcagagctggtgcaggggctgtgcctgtcatcccagcgtatccagaggccaaggccagaggatcgcttcagcctaggaggtcaaggctgcagcgagtcatgattacaccactgcagtccagcgaggtcctgtctgtaaaataagtaaatgaaaaagtttatatattcaaagactcctcccaatcagtagaaacagaaaaatcctgacagaaaatggatgagggcggtggcgtttggtacagacagagcggtgtatgagaaccggggtgcgcctcccgggttctcacaggtgcagcaggcaccgccggtaacccctggcctggcctgcgctgagccctgcaccagccgtgctgagggagcctgggcctggcccttcatgtgggatagaaacggccgtgccggtctcgatggtgctttggcagtttctctggaaatctgaaacctgcggtcttcagcccagccccaccctgggcctgcatgtggctgcgtgtcgtagagaaacatctgccctgatggtgacctgatgtgagcagcagtttcacagagtaagccacccctgtgcacgaggtctggaaaggtaagtgcgacgtcgagtcctgagcacagaagcaggtggcagaactgcatggcaggaggtgggcttggcgggccccttcctgacccccaagagccagctgccaccaggagcgtcctggggtctgtttccagcccggtggcagccgagcttcctgggcacccagctttccccagcctgctctgagcactggagttgagggcactgagcagagtggggctgagcccctggcggtggaggggacacatcagtgggtgttggcttgaggtggtttctgggaggctgctgggccccgatctaaagggacacacctggctgcacccacctcctgcagactttctccgtgggagaccaatgcaacaggcggggtggagcagccacgtggcagccacgagggggaaaggaaggtagaccctgaggctgacgagccgctgtggcaccctggcctgtggacctgtggatgacgtggccgccacgtggtaaagcgcacatgctagcagctctggccctgcagctgagcacaggccaacctggtacgtggtggaggtcggggcatggggtgccccagccatgttcagattcctgtagtgagaatgctttcacctaatactatgttgttaaacctgtattcagtagggaaaagggcaaggacctgaaaaaagtgtattaagaatcgtgcacaggcaagtgatgaaagcctcgtcggggaggcagcttgcgcttcacagctcagctgggtgggcgcgcccggagcccaaaggagggcccttggccggcgcatgcttcggcttctccgaacttacctagatgagatagattttcatcacggaagagccgatgcgggaagcaaccttaaggctgcgcggatgaatattcgtcatattcatgtgaatctgatcgctgtctcctccgaatgtgcgggaggtgacgtgccgcggttcagaatcgacttttcgaggcccgtggccagtgctccgggtgaaagcaggctgttgcctgcgtacacacaagcctgtgtggtgtgggtctgtccagcctgtccatgccgagcctctgcacacacactgtggaagtggcccctgcacatccagctgcccaggccagccccccgggctcacgtctggcaccaggcctgtccctgaccccagggcccatctcccactgcgcctctgcccaccgctcgcatgcgcagcccctcctgcccacagtgggtgccgacgaagcttcatctgcaggtgactctctcttagctgcggctgctttgccaggctgcccgaagcacctccttggtgtgtgggcgcccatctccagtccacgcagcgcaggggtcttcctggccgcaccgctcgcctccaccacagctgtgcaccagtcgcccactgctggcctctgcctgcccatgctgtccttgtggcctcaccccgtccacactacgtctggtcaagtgtggtacaccagggttcaccccgtccacactgcatctggtgcaccaggggtcaccccgtccacactgcgtctggtgcaccaggggtctgcatgcatgcagcctcaaagccctcccaggaggcccggggcagccatcagccctgtccatgaactgatgagtgttacacacacctgttcctctgtggtccgggtagatgcctccctgcctcctgcagccgaggtgctccaaccttcccttcttcctggagaatgcccaggctagcccagggctcccctcccctgctgcccagcctctgctgtggccctggtctgtgtggtcctccatggtcctctcctctaggtcccctgcggtgggcaggagggaagggaggctgtgccagcctcaaagggaatcatctgttctggctaagctggaggtccgggcactgtaggagaaggggttgcagctgggtggtgagcgtcttcctgggggctgccctcaccctgcccacgtatgcctgcccaacaccagctgctctgcccaggacccaggcagggtcagctcccacaggacgccctgcggtccagcaacccaggcactgccgcccgggatccacaggctccatgctcggcaggaagggagggaaagacgccacctaggccccggcaacctctgtgctgagcctgcgccattgatccgtcaggagtacctggggccccgctggacaggtggtgggtgggagtcatgtccacatgggaggctcactggtgtctccggggactcggacatgcccatgtggacgaggcctgcatgtcctggtgtcctcagccacggctgttcgcacagagcatctctgcacccgtgggtgggcgttgtcatgcacgggagtgtgggatggacgtgtgcgggtggatgtgtttgggtgtgggtggatgcgcaggtggtgcacacacatccccaccctgtgcccagtgctgcacctggttcttcggcctagggcacttcctccacctgtgtgcctctgcaccccacactgcccctgccctccctgggctgggggtaactgggagcccttggcagggtggggttggccgtgaccacagcgatgccatgtactggctgagtggaggcgccagggttgggctgctgtgctgtgtgccaggtctgtgttcgcgggagctgttccggtctaagagttgtcatggacactgaaattaaaaacgtgactgttgtgaacactgctcagacccaagcctcgccagccaggggcagcatttctgggcaggttcttgggcgacacgggggcagtgcatgctcctgtggatgtatccttacggctgggtggcgtctgcctgcctccgccgacgtgcttgtgtgccgcggggacttaccactttctacctgcatccccgggcctgcaggtctcaggttccctggccgccccacccagctgcacctgctcagtgtccttcctgggtgtggccgcacccccctcctgtgtcctcgccaggcgggaccccgtttcttccacaaggctgagcagagtctcggtggggcgcacgctcaaaaggagacatctcagccaccacagtggggagcgggcaactctgaccagtgccggcctgcagcctacatgcggctgaggaggctgcggtgggaattgctgggactcaggacgcctgggcagaggttgaggggctgcgcgtggcggggaagccttcatgtagcctctcccagtgtccgggctggtgcttggggaacaagcctgagggccacaggctaatttcccagccggggcagccccacccccgaaggccaagcccgagggtcttcaggttccgggctgagcctgtgtgctttctcgctgcaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggtaggccggctccgagttctctcctgtgcccattcatgcaagctccgtcccgtcttgcttcgtccatggaggcttcactgccacactgaggaccccgttgcacattgcctggtgtggctggcggtggttcgtggtcccgtctggggccggcatgaggttgcagccattcagttcctcacagagcctcatctcagggcacttcctctcttttgggcagcaggaaatccagctgtggcttcacacaggtctgcatgcatgtctggctggtgccccttgcttgggtactgggaccctgggggtgagggcagggccgtcagtgtatggctgtaatagggctcataggtctctgtcccgagacacagcgggaacagcagcgtgttgcaacccagtacgtgtgcactcagcacacagaacacacacgtctgcacctgtgcactcagcacatggatcacgcacactcagcacacagaacacacacggaacacgcacatctgcatccgtgcatgtgcactcagcacatggaacacgcacactcatctgcacccgtgcacatgcagttagcacacggatcttgcacactcatctgcacccgtgcacatgcactcagcacacggatcacgcacactcagcacacagaacacgcacatctgcagccgtgcatgtgcactcagcacatggaacacgcacactcatctgcacccgtgcacatgcactcagcacacggatcctgcacactcatctgcacccgtgcacacgcactcagcacacggatcacgcacactcagtacacagaacacacacagaacacgcacatctgcagccgtgcatgtgcactcagcacatggaacacgcacactcatctgcacccgtgcacatgcactcagcacacggatcacgcacactcatctgcacctgtgcacacgcactcagcacatggatcacatgctcatcacacagaacacatgcacctctgcttgtgcactcagcatatggaacactcatggaacacgcacgtctgcacccgtgcacctacacgcacatggaacatgcacatgtgtctgcatccatgtacagacactcattagaacaaacttggggcggtgcttggccgtcctgcttggagcgcactttctgttttctgccaggctcggtctgttttttctcctcctctcgatgctggtaacaggcgaggttgtaccctgcccttgcccacagttggccagcgcctcacggttttgcttcccttttcctaggatacagtttatggcattgcaaagttggaaccgtctgtgttcctgcgggggacgcaggtggtgtcggaagccatgcctccatctgggggtctcctgcactggcttcagctgcttccgccggcgcccatgggccaaacctgtgtgccagcctcctcccgcctttgtctctgtggtggcgtcccaggaagggccggctgcggtgtcgggtgcaggcctgggtgtgtggtgtcgggtgcatgcctggtgctttttgaggggtccctgctgtttaccatctctgttacccgtggagtttcccaggcctgggctctgttcttcagccagggatggtctggggcacccctgggatctggcccaccctcaggaggtctttgttccaatctcgtgtggcgcctggcttggctctccctcagtctcccttgtttaacatttttacgtccaagtgagttgtgtctaggggctatgcagcccctgcctgcgccgccccacgtcaggccctctcccggcccccgggaccccttgcggaaccacacggtcctgtccagcttccgggcctatgaatgcagccctgtcctggcctcctgccccctcctcctccccagggagacggatggccagtcggacacaggaatgcaatcatccggatggggtgggaagtgccgtgcaggggcggccctggccagggacaaggcagggatgagggtaaataggctcagggaggggcactggctggggaagggcctgtctctggggacaaggccgggagcggggagtaggggtcacacatgggcgtgcctggccactcgggagaaatgggatggacttgctttccaggaatggctccagcttcagtgttaccgactgcaggggtggggcatggagggcggaaggggcttcggggcccggctgggcctgggggaggcctgaggacatgtgcggatgtccacgtaggggtgtgcaggcggggccggcacccagattctgacctggccacagcctcccagcagggtacccccgagaggaatcggggtggcgaggtgacgcggggagacacgtgcttgtctcttcctgggctgccagcgctgagtcgggaggggtcagggcagcgtctcacaccccagccctaccacacaccgagcagttgccgtgtgtgtgctgccacgtgaacctaaagtggaggtggggctcctggagttgctctgttgcgcccgacctgtgagcaacgtgttcatctcgtggcctcccggggtggccttggggacacggcctttggcttcttccttgggaagcttcaaacccgctccagtcacggcggccccggtgtcctcccggaggctgggcccggcccgggggtgaccgccgtgtccttgtccccacaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtgcgtcggccgcagctccacgcctgtgtccctccctgtgtctggcgctgccgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacacagataacacacggatgtcacagtacacagcctcacacagaaatcagagcacacatgtgggcctcacacagacatcatggcacacacagacatcacacaccgatgtcacagtacacatactggcctgcacggatgtcatagatgccacagcacacatgtgggcctcacagacatcacagtatacatgacctcacgggcgcacacagaaatcacacatggacatcacagcacagacgtggacctcacgggcacacacagataacacagatgtcacagcacacagcctcacacagatatcacaacacacccatgggtctcacactggcctgcacggacgtcacagcacacagggcctgcacagatgtcacacacaacaccacagcacacatacaggcctcacacaagacatcgtggcacacacagacatcacacacggatgtcacagcacacacgtgggcctcacgggcttgcacggatgtcacacgccacagcacacgtgggcctcacagacatcacacacggacatcacagcacacacaggcctcatgggcacgcacagataacacacagatgtcacagtacacacagcctcacacagcacacatgggtctcacacaggcctgcatagacatcacacggacatcacagcacacacgtggaccccacacagacatcacacatggacatcgcagcacacacatgggccgcacggggacatacagatgtcacagcacacacacacgggtatcacatggcacacatgggcaccacacatggatatcacaccatacacatgacctcacatggacacacattgatgtcagtcatgggcacgtacgcagatagataccggcatatgtgtgggcacgcacatcaaccacggtctagcacgtgctcgccccttgagtcccctggagctggctgtgtagatcctgctggggccggggttcgggcagccgtgggcttcctccgtggtcaccagcagctgcccctggcgctggccctatccccggggagtggtttgcctttcagcgacccctcgctcttcatttgcccactcgctttgcagccgcctatcctgggcccagcactgtcctgggtccggcatgcagcggtgaaccggccccacacagccaggcccaggttgagctcagagcggcaagcgtgtgcatgtttgtgcacgtgtgtgtgtgcgtgtgtgagatcctgggagtagagccatgtcttaagggaaagtagagctgggagaggccaggtgaggggccccgtgagggagggggagcatctgggcggggcccaggtgtggggtgggaaggtgctccctgagagggtgggcgggggtggtgtaccttttctgaagactccctggacaccttggcccagctgcctgtctccccagatcgcgggttcctcaggaggccccatggggatgcaagggccttgccatgccagggactccccttgaccggccggccccccgcttcccaaacatccaggcagcccactcctgctgaccgctgtccttgtcccgccagcgtttggggaatcggacgtttcgggtggtctcggtgaggcggccacacctaggttagtgggagaggttggttcacggatgtgcatggaacacgtgcctgtctcttcctggacacgtctctcacggtcttgctggtgcccccaccaggaccccagggctggctggagcctgtgaggatcccagagccctgaggtgcctgttcctcacacctctgcccatctgaggcctgggcggcccctcctatgtcagggccatggcccgcatgtgtggtttgttgaggggaggagggagggtgggcaggaagcccaggttggggcagaggtcgggaggggccggggactcggggctctgtggaccttcagattcgtggactgcctgctggccttgtccaggggcggtgcctccgctgtctccagagcaagcccacaggacaggaggcgcctcatgtgtgccttgcctgcaggtcaccgcctgtcctgcagccacaggtctgacacctcacctgaggtgtacgagggactgtgggatgtggggggggtatgggctgtgtctgtgtggccagggatgtctgtagttcccctggtaagagtaggtgggtgtgttgcccccagagtcatgtgtcctgtctctcctggggtcggggtctgtggtcccggccctgaaggccccgggctcttcccgtggccactctatgaggcctgagggcggcgccttcccaggctgattgtggagctgggcccaaccagcccctcccagggccccgtgctgagtgggggttggaacacccaggtcgggatgccctcagagggtagggctgtggccaccccgttcgttaaggaccccacctgccagggcccccgcccaggcctggcctgaggagtgtgggtggggactgcaggtgcggggaccccggcgtcctggggagtgcagggtggacctggcaggttgtgggggtttaccatgggcgttctgccctgcactggcccaggtcgtcctgtgggctctcgggcaggcccccctggagctgctggggggcagctgcttccctcgctctcggcgcgggcccctctgtctgtggtgatcttgtgatgaaccaggccaggtcagcgctccctcggcctcgggagctgaggagagcagttctgtccttagggacacgagccccctgacgctgcagcctctaccttgtggacgggacccctaccccaccccggctgcccacctggcacccttgactgcagaacacctgcgtcccgtcccccgccccgcccctcgcccttgtccctgagccccatcccaccctctgtggaagagcctcatgctccaggcggggccggtgctgggcaccagccactcaggctctcccagggtgtgcatgtccccatctgccctctgctgtgcacacactgtctgggttgttcttagcgtggaatccgcgtgtgtggtggctacaggaatgtggaagccctgggcagcgtgtggctcacggtgttggtgccactcggcgcagactagggggcggccgcttcctctgctctacgaggctctggtgcccgtgacttacatctccttcttgtttctttctttcctccctccttcccttccttccttccttctgaaaaatgcactgtcttaggtgcacacaggaaaacattgtacacattcaccccatgaacccgccagcacgttgacagagcaggctcctgcacacagacagctccctcgggcccccttctcccgtggcggccccgcgacgaccctgcgaggacccgggtcccgcttcctagagcagagggccttccccagctgtgccgaggtgggatcacgggcacgcagccttctgtgtccgcctcccgtcagtcggggtgatgcctctgggtctcacctgtgttttcatacgacccagcagtttctgataacggttccatcacgtgaacacagcacgatttgcttctccagactcttggtgatgcattttgtaagtttttggctaatattacaaacaaaacttgtgtgaacacatttctgcccgtcttttttgtgcacatagactcacgtctcttgggtttgtacctaggagtggaatttctgagtcccagagcaggacattgtttcgcctggaaggagtcgctgttcttcaggcaggggcgcggcgtcatgctctggcagccgcgtatccttgccagcactctgtgtaattctagcccttccagcaggtattttgtgatattttaattttaacctatagtttcctgataagtgaggaggctgagcacctctttgtgcccttggccactcggagcacctccggccgtctttttcgtgttggttacgaagccctcacgtggtctgcgtcaggttcttgtcagatcgacatgcattgtggatattttcataatttcaaaatttttgttttttcttgtttacgaatatctcaggccgtggcttgacttttcactttcttgacctctctctgtgacgagaacacgttttcagtttttatgaagcccagcgtatcacccgttttttaggtgaataccttttgtgtcctgaggaatctgtttaccccagggtcatccgggtaacaggttctctgtgttttcttctggaagcttctacctctaggtccagggtctcctgggctgccactcacacgtggtgtgaggctggggtggtggcccaccctttcccgggatggcaggtcgctgcggcacgatgcgccgaggagccctccttccggttggcttggctcctctgtggaaaggcagttggccacatgtgagtgggtccgtctggactcttctgttccgtggacctgtttttcttccctttcctcccatgtgacgctgtctgcacggctgtgagccttgagatcctccaccatgttcttgacgagggtcttggctgttttaggtcctgctgtgcatttccatttccattctggaatcagctcatcaattttcattttgttgagtccttaaaatcagttttgggaatgctgacttcctaataatattgaaccttcgggacataaatatgatctctccatttattttaacttttcttaacggtgtttcgtcgttatcagtagaaggtttccacgtagttcattaagtttattgttaggcatttggcatttgtaatgctgttataaatgtttaattctttttttctttttttttttttggagacagtcttgctctgtcgcccaggctggagtacagtggcgtgatttcggcacactgcaatctctgcccctttttttttttttttttgagacagagtcacactctcttgccaggctggagtacagtggcatgatctcggctcactgcaacctccacttcctgggttcaagcaattctcctgcctcagcctcctgagtagctgggattacaggcacacgccaccatgcctggctaatttttgtatttttagtagagacaagtttttgccatgttggccaggctcgaactcctgacttcaagtgatccacccatcttggcctcccgaagtgttgggattacaggcatgagccactgtgcccggcctaattgtttcttgacggttggttattagtaggtagaaatacacttgagttttgtaaaccaacctcatatcccacagcgttctaaattctccatgttaggccgggtgcagtggcttgtgcctgttatcctagtgcgttatgaggccgaggccggaggatcaccaggagttagaaaccagcctggatggcgtaatgagacctgcctctgccaaaaacagattctcttgaattttctcttgcacacactgctgtgtcatctgcagataaacacagatttacattttcctttctgatctctgtaccttttatttctttaatttctttatttttgcctttttgcattagctacaatcatcagcagcagtgagtgtgggtgttaccgtgttgatgtgggagaaaaagtttctgacatttcaccattaagtaggacgtttcctgttggtctttttgtggtctaattaattggtctgatgttgaggcagccatcccagctcttttgatcagtgtttgtgtggtatgtcttttttcatccttttaattttagcttatctctgttcttatattcattcattcagagacaaggtcttgctctgtcactcgggctggagtgtggtggtgcggtcacggctcactgcagccttgagcactggggctcaagagatcctcttgccttagcctccgaagtagttaggactataggtgcgtgccactgcaatttttttaaattaattgttattattattattattattttttggtagagacaaagtcttgctgtgttgctcaggatggtctagaactcctgggctcaagtggtcaccctgccttggcctcccaaagtgctgggattacgggtgtgagccacggcgcctgacttctgtcttttatgtttaaagtgtgtctgttattaatagtatagagttagttcctctttcttttttcagtctgacagtctttgcctcttgagtgttcagttcatttatttttagtgtaattgctgatgatttggatttcggtgtcatctggctacgtgttttctgttcatccttgtttttcctttctggccttcttttatattaatcaggtgttaaatgattccttgcatctgttgttgctttttaacctatactctgcttagtgatcgtgtttagttttactttagagattaggatacgccttcataactcactgccacccagcataacctgtgaagactcgtccagggcggccagaggcccgcggtggctcctctcaccctcgggccgattttccacgtctattatgcagaaaaccgtacaagaagctattagtcatgagtctgtcaaggaatttttcagtaatttttcttttgaatatcaaccgacacatccaccctttctgccttgtttacgccccccgattctggctgtcctcgggcgtcacgttcctgtagcctaaagactgtcttagaaatgtggctcaccagtgaccgattccttttgcttttctttgtccgaaaatgtgttgccttttttttttttgtggaaggtagtctcgctctgtcgcccagtctggagtgcagtggcgcgatctcggctcactgcagcctctgcttcccaggttcacgccattctcctgcctcagcctcccgagtagcttggactacaggcgcccgccaccacgtccggctaatttttgtatttttagtagagacggggtttcaccatgttggccaggctggtctcgaactcctgaccttgtgatccgcccacctcagcctcccagagtgctgggattacaggcgtcagccaccaaggcctgttctttaaaatttattttttaaattcttttctctctgcttctgtttggatgccatctgctgactttgagcccctcccttcaagctcccgatccttttcttgcagttagctttgtccagggagttccgtttcagagggatgttttcgttctggaatttctatgtggttctttatagagttaccattcatcttccggaagcctccatttttctgctgtttacatccacacttgttgtcatctctgagcatgtttatagtagttattaagaggttttgctggctgattccagcctcggtcatctgtgcgtctgtccgcttccagtgttttgttctaattagaaactacatcctcctgtctcttcacctgcatcatcataatttcttatcctaagccagacatcatgtggaagagaatggcagagacagaagtgaagaatggtctcgccccgaacagccgctgctctcccgtgtcaggcgtggccggcgccggcccgcggctttagctggttttcgccaccggcagcccgacttccggggctttgtgttgtgcgcagtgggaaacagcgtgtcgtccgccttctgcgctgtgggagacgcctttctctgtgtctgcctgtgttctcttcctccccatttggtgggatccctggcagggggcgttgacagacgggctgttctgcacctggggagctgcccgggtactccggccgtggctgcaaccctcagaactgctgctcccacctccgcctgccgagccctcctccctcctgcagcagcctcgtccctggggatggaaggagccaccatgttccttctcgtagaacaggcgcctccctttctaggatgtagtgcgtttagacggtcctcagctcttctgactggcctcccagcctcccccagtcctcttcccagagtgactgggggtcccctgggcgtttgggccacgtccggccaccctgtgtgcctggcggtctggtctccttggccctcaggccgccgcgggcccctcgcacgtgttgttccagctctctggctcccttcctgtccccttatgtctccagcaagcttggtcttctcagggaggcctgccctggctgccgcctttgaaactgcgcccacttcccacccgccccggcgctcaacctgcttccttcctgtgtagcggttccctctgaggcaatgcaggagacaccacgttcgcgggcttggggtcctgtgtcctttgcagccatgctgttggctcacagtgggcacgagcactctgcagacccttccccgaggaggagccggccccagccagacacggtggctcaagctccacggctcctgtgctgggacccgtgccagccttggactgctggggtgggggcaggcacgtctgcctgggatggctttctctgccgctccactcgaaggggtcaggacctgagcccagcggggcctccctggtctggaagtttccctcctgccccctttgccgtctccacgtagtggtggctggaattgagatgccggaaacattgatgggtggatcgaaaggccagcggaggggcctgggcacggaggacatgtgttgggtgggtggagacccactgaccagtccgtttgacactgagtggttcatgtcacgtcctgtggacaggctgcaggggagtggtgtggctggcagctggtgtgggccgaggggctagtgtaccctttccacccctgtgcatctcctccgccttggcagtgggcgcgttggagcggacgtggagcgctcgtgtggagcgtgcgtgggcaccttggcttgaccacagctggtgtcatccttggcagatggtcaaactgaggcacagaggccactccgaccctggctttcggggccggcctcccggccacgggtgagcaagggtctcacactgtgtcttgacgccaccaggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcaggtgcgtggagccggggacacaggactctacttctgcggggcaggtacaggtgggggtgtcaggcaggtccctcccagcagccatctgcacctgggcaagaccctgccttcagcgagccacatggcggcggctgccagccctgctgggggaagccctgtctgcccagacagcgttttctgtgttctgagttctactcaggacatctaaaatactctctggacaagacagaacctcatacctttgaacaccaaattcccctgaagcccttgctgttgtcacagtggggacagatgcagctacctgggggcgttgggtcggcccttgtgacttccgtgctgccaggttcaggtttcacatctgcagctggaacgggctgtgctcaggtcggcctctgacatctgcagctggaaagggctgtgctcaggtcggcctctgacatctgcagctggaacgggctgtgctcaggtcggcctctgcctcagcacagctcgcagtgcagcctcagccctgcgttccccttgagtgggtggagctggggatggctgcctcccgctggctccaggcccttcagagagtcatcgtgtgtgcacagtgatgtgtatgtgtgtgggcaagtgtgcgtgggtgcatgtgtctgcatgtttgtatgagcttgtatgtatgtgcatgtgtgtacacacgtgtcagaggccacccgcccactctagctgccccagcagcctgtagccacaaggaggatgaggccaggttcccgctgccccttcctttgttcacagagtcagtgggtttggagccttctaggggacagggtgtggcacgtggatgctggtcagagccctgccgtccctgaggaccttgggtgtgaggctttaatgggcagcagtgcaccaaagaaaagccaccgtgacctgcccagctgtcagccaagcaccgtggctgggtggacttcttggaatgaaatgggggggctgcaggaaagccctggccacgaagccgagggagagccacccgcagggctttttgcaaaagtgcatgaaaagcgagcctgttccgaagacggaggctctgctgcaggccccgctggggttggagtcaaagaccacgcctcagaacagacggccctgggctttgccgtcccagggagtcccacctcgtgggctgaggccctgcgtgggggaggctgggctggaggggacccagaaaaggggtaccacagggggaccaagccaggagcccccgcccagtcctcagctcagggcttgggcaggagggtggagctctctaggagctgtggggccgtgcaggtccatacagggcagatcctcagccagcctgtcagggccgcggtgcagcacgcccgaggccttcagtcctagcgccgtggtgagcccagggtggggctgggaaggggctagggagctgggccttcccaacggcgtgcgtgaccaccttgcttccctggctgcccgccctgtgcggatccctgactgggcctggcctgtccttatgtcttctagatgagacaaggggccttcctggtgaacacagcccggggtggcctggtggatgagaaggcgctggcccaggccctgaaggagggccggatccgcggcgcggccctggatgtgcacgagtcggaacccttcaggtgcccccacggccagtgccgcccccctgctcttccctgtccaccatcctgccggccttgacctccagacggcgcctctgccaggccggacacttgcctgtactcaggcctctcgctggccagcagtgggggagtttgccgcccgctgcggggtgaggatggagccacgggctctaggcctgccttgcctcggtcctgtgaggggctgctcaacctcctcagcccttctttgggcagggctcctgaccaaccaggagagagtgaggccccagtgtctgtgagtggtccccatgggccctggccatggagtcatggcatcccgtccagacctgcagcccctacagcaccttgggaccccaggcagccctgggttggatgttcagccgcaagaggagacacccccacaggggcagtatcagcctgcagctcctggggctacagaccctttggctggaaggggccaggcagcatgtccccccatcagggctcctcccacgagggacttggagattaaatcccttgggctcccacacccgccgctgtcaggagcccctggtgtgtctgatggtcccggggctgtgctcttgagctcagccagcctgccgagcagagcggggccgtggggtctgtggttcccaggcagggccccccacagggggttccagtgcccagccacctcccctccgtacccagccacagcactcaggctgcactgaccatgcctgtgctgttcccagctttagccagggccctctgaaggatgcacccaacctcatctgcaccccccatgctgcatggtacagcgagcaggcatccatcgagatgcgagaggaggcggcacgggagatccgcagagccatcacaggtgggcgtgggggccgctcggtcaggcctgggggtcccttcctgccagccccagatgctcatgggctcgcatccgcctggcagccaggcccatgttctgccagctcagggcccgtggtgctctcactgcacccccagcagggacctctaaggccaaagtcaagttgagccctggcgtcgtgtcttacacacaggacctgctgggaagttgctgggctgagcagacaggtccctcagcaagctgggcacgtgctctgggctgggggtccccacgctgcaagggtgccagtgcccagagagacaggaccctgccgtgccttgggagccccggggctgagagggaggagcacactgccaagaatcctgctgcccgtgtcttcaacccagtgggccacgctcctggggccccctcagagccacagctgttccttcctcctgcatctcccaggccggatcccagacagcctgaagaactgtgtcaacaaggaccatctgacagccgccacccactgggccagcatggaccccgccgtcgtgcaccctgagctcaatggggctgcctataggtgagcaggcccgctggcccagaacagcctccaggagggccccaggcttcccctggatcccagcacagcccctggtgggaggggcggcgtctccactgactgacctggaggatctgggtagaattggtaaggccaacctcacctgaaaggcccatgagaaccagggcctcttggaaggagcctgggctggggtggccttcagggctcagtggacacaggagtgccatgggcacggggcctgtgggaggagggggctttgggtgaggcgaagacctcatgttcaagtcacctggagacaccagggctcccctccccagccctgagaagtagctgccataggcaggaacatccgtgtaaaggccgggatccttaccctgactgctggtcctcctggagaggccccctcggtgctgccgatgctaggagggcaggtggggcctggccaggccgcctacaggtgggcctcacggatggaccctctcccagcaggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagccagcgtgcccagcatctattctggtgactttctctcatgaggacacgggtgagcctcagtcctggctctggtgacctccacggctcagctcagcctctctgaagtgggcggcctaagagagacccagagacagtgcagtggcaggttgggcagtggtctctgtgtgtaccgggcctgtccctctgcccactgggtctgtgggacgctgtagggtcctggcttggaggcggcctgcccgcagtgccccagtgggagggaagcagtgtgccagccgggccgttgtgtggatgatggtgtgactggctgaggtcctgccccactgcccacccctcccttcttggcatagctcctgcaggccggcctgcaacctgggaagactgtgggccacaggaggaaggaaagcagatgtcagggctgaggaagctccccagaccatgggtcagccagcctacggaaatgggcaaaaaagccaaaaggggtcatgcctcaccttggcccacagctgagcctgtttaccggcgtcctcttcaaaatcccagcctcctggtttctcagagctgcttttggaagcgtggtccatgcaaatcagcagagtcccaactcatttatgagaaggggctgcagcgggtccaggcggtgcgaggaggggctgcagcgggtccaggtagtacgaggaggggctgcagcgggtgctggggaacccgggtcccctcgggatgtttccatcccaagcctttccctgcatgcaggtgggttatcctgccaccccaagtgtccagaccctgccgcgtcatccgccaagtgtcaacctccccttgctccctgccccatataaagcagaaagaagcggggggggctgctgcctttggtggggtgccccctcctacctggctctgcaccccagtgctcgcagaggtctcttgggtatgggcagtggctcccagtctcgaggcccacgccgaggacagccccacctcatgactgaggcctctgctccctgccctctccggaggtgagtggcagaggccgcccagcccatctctgacctgtcttgggctcttcaacttggagccccctgggccactgagggaggtggcctgggcagggtgggaagggtgggttctggacacggttaacaagccggccctggttttgctgacgtgggcacgggtgtgaggaggggcagccaaggtgacttcaagtgtctgggctgcaggctggagctgatgttttctgatatctctggtgggggctgcagaggtggcagtgggaagaccaggagttccgcgctgacggctgactccagcctctccacaggcaagccctgggctgggtcactgggccctggtcagcccccacggcagccgagggtggggctggcctctggcagggtgggccgccctcccagctccagctggagacaggccccgccctgagaggcagccagacactgggaactagctctggacacaggcctggaggctcccactcagctggcctcattgtttccatgtttccaagttgaagggtcggggcaggaatggaatgcctccaagggctgtctgtggtgtgagcctggcggccagggagccgggacgctgaagtgtaactgagtctgggatgtaagggacagaaagctgtcagaaaagtgctctgagcctcgaaacgaacctccccttggtgccacctccggggagtcaccccgcccagcaaggccccaggaggggtgcggggtagcaggaggtgggtggggggccctcagcctcggtttcctggcctgtgaaatcggcagcactgtttatctccctagaggctggtattaggctggaggttgtgccaaaacgcttaagacaagaacatgaaggaaggtttgcatgttggaagggaagagataagtctctggtatttgctgacaagcatctgtgtacaagacccaagaaaatcagccaaagcct

SEQ ID NO: 11933 - DNA, 59240 bp, Human
tcaggtgatccacctgcctcagcctcccaaagtgctgggattacaggcaggagccactgtgccctgcccctggcatttatattcttatgttattagaggatatagggtctaagcttttttcctgattttatatccaaattccgtatggtgttactttcctccaaaggaaccgctcagaaaaagaagttcgagcagcagcacttgtattacagacaatctggggatataaggaactgcggaagccactggaaaaagaaggatggaagaaatcagactttcaggtatagtaacttttgagaccaagacttttactttttttttcttggtcccaggataatgcttctgttttctttcgtttcttccatttcaccatcatgctaaacctattttttttttctttttcggagacagagtctcactctgttgcccaggctagagtgaagtggcgcaatctcggctcactgcaacctctgcctcccgggttcaagtgattcttgtgcctcagcctccccagtagctgggactacaggcacatgccaccatgcccagctaattttttatatttttagcagagatgaggtttcaccatgttggccaggctaatcttgaactctgagcttaggcaacctgcctcggcctcccaaagtgctaggattacaggcatgagccatcacacctggcctcatgttaaatctatttttgacccatatttcttaattaggaattatttggccaggtgtggtggctcacacctgtaattccaacactttgggaggctgaggcaggtggattgcctgagcctaggagtgtgagaccagcctgggaaacatggcgaaacccatctctaccaaaaataaaaataaaagtagccaggcgtggtgttgtttgccagtagtccgagcaactcaggaggctgaggtgggaggattgcttgagcccaggaggtagaggttgcagtgagccgacatcacactgctgcactccagcctgggcaacatagctaaaccctgtctcaaaaaaaaaagaaaaaaaaaaagatttggtttactcctcaaaaggatgatgtgtctacaattcatttgttgccgacacagctcaggtatccctctatgtcataacatactttaggtgcaggtgatgatgaaggatgatggcctttttgacttttgcccaaatctaccgtagccctttgagggaatttttactattctctgaaactgtattttcttctgatagtgtcaatatttggatcctttgtaatctcctgttctggaacacaaatagaagccataatatcctagtttgtctcactgtctagggtatttattcaactcttataagttgctttttcatgattctatttgggaataggaacctagaggtttatgcccattagagcataagatagggtgaattcagtattctgtcacattgtcgcatttgtgtttgcctctaggtgaatctaaacaatgcttcccgaagccagagcagtcattcatatgatgatagtactctccctctcattgaccggaaccaaaaatcaggtgcagtatccagaaggcacaccctctccttttagccactcttgctgttctaggtggcttactaagaaataggatatatattatttctgaattagctagccttttgtgggaggggaataattttccactccaggatcctaacgcagaaatgggtaggtcttaagcattagaaatcaaaacaaaacaggtaattagcctgaatgtgattcctttatcattgcttgtgaacttaaaacactggaaagtgaactctagtctgttttgtctattttttctccttttaaatttccatttaatacttaatattgtaatagatagttactattttaaaattacaaaatataaacaatcagaaaaataacaaaaaatcacttgtttcttttatccagagaaaaccacttgtatcttttaaaacatttttatcatgtgagtaaacacatttttcctctgagatgaattatatattttgttttgtaaattttttctttttcacataaagtgtatattgtgaccattattatcttaatcacacttggctttttccttgattattggttcttaaagtgtggtctgagagtcccaagattgttacaatttgtactgatggcacagaaagcagtgatgcttcttgctggtggcttagcacaaaccagggcagtgacataaagctgaatgagtcattgtagtcttcattgccactcacataggtaaaagcagagagccattttcacttaactggagaagaaaaaacatcaggccaggtgtggtagctcatgcctgtaatcctagcactttgggaggctgaggcgggcagatcacctgaggtcaggagttcaagatcagcctggccaacatggtgaaaccccgtctctactaaaaatacaaaaattagctgggtgtggtggcagacgcctgtattcccagctactcaggaggctgaggcaggagaatcgcttgaacccaggaggcggaggttgcagtgagccgagattgcaccactgcattccagccagggcgacagagttgagactccgtatcaaaagaaaaaaaaaatcacttttattgtttttctacccttgagtatacatctttttaatattctgtgctgatgaaatagcatattaaagcatgatggttgtcttaaggaaatgtacttgtgttattgtttcagttactagttagactagccactttttaattgtttatttatttattttgagatggggtctccctatgttacccaggctggtcttgaactcctggggtcaagcgatcctcctgccttggccaagtgttaggattacatccggcgctcagccacactagccactttgtttaatggaacactgtttttacttggaaaaaaatgtgtggtagacaaagggattattcagatgtgcgcatttggcagacattttctcaaaaacgaatgcgataagcttgttgctttgaggaaaataacacagtgtttgctgcctgagctttcaagtggaaattgtagttttgaaaaacttttatttgccactgtgagcctggtaacttcccaatactgaaaagacttttctaggctgagtgtagtgtctcatgcttataatctcagtacttggggagactgaggcaggaggatcatttgagcccaggagtttgagaccagcctgagcaacataatgagaccatgtctgtacaaaaaaattagccaggcatggtggcacattcctgtagtcccaattactttgggaggctgaggcagggagatcacttgagcccaggtggtcaaggctgcagtgagctgtgattgtgctactgcattccagcctgggcaacagagcaagaccctgtctcaaaaaatacatgattaaaatgaaaaaagacttttctaatgaaataaacagtgatgttaacgaatgtgatttcaaaatattgtgtaatgctatgtgttagcattttgaatatctggataacttgaagcagtattttgcaagtgacaaatacatatgtcaaaatcgtacataggtaattgatccgttaaaagtgcaagatggaccaatggattttaactaaacagaatatgaagtgattgttaattatagattccacattactgtcaacctttaagaaactactactaattagtatactattaaagaagaataaccacaattatctgaaaagactattaaaatcatcctcttttccaactttttatctgtgtgaggctggattttcttgatatacattaactacaataacatatcacaaaagattgaatgcagaagcaggtatgagaatctaagccaaatttcaaagagatatacaaaaatgaaaaggatgttattaaagattatttatgataacatgtaagaagtttaccattaagtgaaatagatactttaaacttgtcagtatggtaacaattaatacataaaactcacaccaatgaaggttctttagatccttataatttttaagactgtaaaacggccttgagaccaaataatttgaaaactgctagtttagatggaattgttttttgatttaagagtctgtaggggccaggtgtgatggctcacacctgtaatcccagtactttgggagactgaggtgggagaatcacttgagcccaggagtttcagaccagcctgagcaacatagtgagacctcatctctacaaaaagcttaaaaattatccaggcattgtgatgcacatagttggtgctaagtagaagtgtgaatgaagggaaggaaggaggaccagagagcaattttcatgatgtgtacagattttgaagaattgtttttgacatggataactttctgacttcatacagataagaaacctgatcgggaagaaattcagatgagcaatatgggatcaaacacaaaatcactaggtaggtgattaattcctgcctaaggatgtggagtaatatttcactggctaaggagagctgtctagctctatagttttttttctaatacccttaccatttaccatcctgggagagcattggctgatcatttccattttgaaggatgtaaggaaatttaataaaatctgatccgtctactttttctacattcctacatgctcaaaggttttcagaaatctttctatgcctctcctattactacacattcaagtttgtagcccattatattcctaccccagtctccttctctggagtgaatggatacatctgtttctgcccaactattctgcttgctattctatctattcactctatagtttgattctgctcatgtaatacctcttactggtatgtccttcccttttgtctttctaaattctctttatctccaaaggcttaactcaagtcctgttttcccttgtcaggtccttcctaacgattgcagcatatttcactcgctcttcttttaattcccataaccttttcagacaaacctcttgtttagctttattatgtcatattctgggtattttatacatattgtcttccatcttagattcaagttctttttttgagacagagtctcactcgttcacctgggctggagtgcagtggcgtgattctcatacctcagcctcccgagtagctgggactacaagtgtacaccatcacacctggcttattcttatatttttagtagagatggggtttcaccatgttggctaggctgatcttgaactcctggccttaagtgatctgcccgtctcagcttcccaaagtgctgggattacaggcatgagccaccacggtcagccagattcaagttctttaagtcggggaccatcagactttaatgcctttgtggagcatttgacaagctcagttcccaacagtgatgcctaattacacctatctgtttgatatacgttttacactagaggggaatgtcatatttctgtgtacttttttttttttaaccagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatggtatgtccttcagtcacccccaagattgttcttgaggaaggaggctcctgagtgccagcaacttgtcaatcacgctaatctgatcaggccagagactaagtagtctcagccacatggggctcgaggggttctgcttttgtgattattacctcttacgagtctgggacatgcagctggtgatctgattctccgttatgtgctgctttcctttctccagatttgctcaacttttttggggggggtctccttaatcccaaccccattaacattctctctttctcttttttctccacagcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcctatatgctaagcgttgtgtcaaggttaggtttagattagagagtgaaacagatggatcttttctcatagattgcaatccatgagaatcctctatagctaagatctatgatcagacgagatcgtgtgcgttcagggtgatatggccatagacaagatctatgatcttaaaaacacttctctctgtgccatatctaaatacaatgagatgttacacagaatgatgtgtaaaggccctatctcacaagtttcttgacactgatgtactttgtgacagaggtcaaagctgggacctcacttggccacttttttttttttagacagagtcttgctctgtcactcaggggcacaatctcggctcactgcaacctcagcctcctgggttcaagcgattcttctgcctcagcctcccgagtagctgggattacaggtgtgtaccaccacgcctggctaattttgtatttttagtagagacaggatttcaccatgttggccaggctggtctcaaactcctgacctcaagtgatccacccttcttggcctcccaaagtgctggcattacaggtgtgaggcactgcgcatggccggccacttgtttttcttgctgaactaattttctttgctacaaactggaatcacctcacccaggaagaactaagaaccagtctttccatatcatttttttctcattttgtctatttttatatctgaagcaaaggttcttaatattttcatagatggaattgactagacctagccctgtatatctgagcaagttacataagaattccctgtatgcttgttgaaaatgcagagtcccatgttccatttccaaaaatcgattcagtaggtgggactgaggaatctaaaatcatggtaagtcatccaggttatcctctttttttttgtttttgtttttgtttttttttttgagacggaatttcactcttgtcacccgggctggagtgcaatgccacgatctcagctcagtgcaacctctgcctcccggattaaagcgattctcctgcctcagcctcttgatgagctgggactacaggcacccgccaccacatccagctaatacttgtatttttagtagagacggggtttcaccatgttggccaggctggtcttgaactcctgacctcaggtgatccatccacctaggcctcccaaagtgctgggattacaggcataagccaccatgcctggcccatccaggttattctgatgtatgtggtcagttaactgtgacttaagggactgatctagtgacttgcttaaggttatagcctcaaagtggaacccaggattactggcttcaactccactggcagtaatactagcatggtgaatgtagacaatatgatgtggtgatcaccattttaagagagcattcatagaggaaactttatctcaaaggaatgcattgctttcaatagagtttgagataatggtaagtgataggttggtgtgtggtatctgggtaggagaagcttctcatcctgaaaatcatatgtaggtaatgctcaggttgctgaggcaggaagctagcccttaatttggggtcctgtaggtcacagagaatcccctggaattgccgactttgacttaagtgtcacttctagctacaaagggtatctcaactggcgagcaagtggccccattggctaaagccaaggagaccacatctggaaacttaaatcactctggtagcttccagaaagagctacctcaggaaagctcaaaaaagaaacaagataattgttaggaacaattttttttcacacagctttaagactgttctgttgcctgtgtcacttaaagcattagttcttcaactgatccatccaggatttagagacagacatggatgaagagaaagctggaggaggtaagataggttgattggtctgcatcattttaacctgacatttttctccttttatgcagtgtaaaatgaccatggatagctatccatgaatggactaagagctttacacttgttataattgtaggagctataagcatgtggcaactagctttaaaatttttttttacctgagaaaaagtgctatacttatctccatatactactttattttttaaaaaagacaggttattccacttttattgaggacacaaaagtattactaccctgctgtcttttcccccagtatctctagtgctaatggacagtgccataagacatttatgcctgaggaaaaagaaatatgggatatttgtggtgatgttccagtcaattacccaatttttgtcttcacctcaattctttttttttttttttttttgaggtgaagtttcgctcttgttgcccaggctggagtgcaatggcataatcttggctcactgcaacctccgcctcttaggttcaagcaattctcctgcctcagcctctggagtagctgggattacaggcatgcgccaccacgcctggctaattttgtatttgtagtagagacggggtttcttcaggttggtcaggttggtcttgaactcccaacctcaggtgatctgcctgcctcggcctcccaaagtgtagtgattacaggcgtgagccaccatgcctggctcacctcaattcttcttttccttccaccttaaaggcaggcttagctttggtcttacagttcacgcgttggcagaatcggggcagggggagtgcgttggtgtgcgtatttgaaactaattcagggctctgtttttggcagtatgctggattagataattctgaaaagtcctttcagcagaagcaaccaagatactgggtaaatatatttataaaaaatacttttaaacatattgctgagcaggcacgaaagtaaggaacctacggctcttcaaaatgaagcaaaagctggaatcctaggaagtaactgccaaagccagcttttcctcagaatttttgccaaattcagcagaccataaccttctattttagtgattacacaaagtatgggcaacaggaaatgagaaatctagtaggttccctcataaagctggacaccctcagtgtaaaggtgaacaagaaataaacactccatagaagggcgcagcaaggaactcatttgtctcaaccttagtggcacatggaaactatagaatattttccctgatgatttataaccacaaatggccttctatgggctttcagtccaaacttaggctacctgtgtggtccaaaaagcttaactggggaatttaaagtggtactcatttgtttatgcttccaggtgattttcagaagcaaatgcaattcctctaaggcctcagaacaattcccatagatatactttcaaggcaaatgagtgctcttgcccaaaaattataaactgaacaaagaaataaggcacaatgagtgaaaagacagacacagaagctgatcttttaaatacttcagatgttggcattgttgcacagactataatgaaataacgattaatgaactttttgaattagtggaaaaacctttttgaattagaagtgaaaaatacaaatttgaggtaagaagtcaatgcatggattaaatagattagacaaattgaaggaggatttgtgaattggaagataagaaattatacagaatgcactccagatagagaatggaaaataggcaagaggttgagacaacaatggaataagatctaataaacattatttggaacatcaggagataggaggaggcaatattcaaagagaaattttttagggttggatgaaaggcaccaaacctcagacttagggagcccagtgaatctcaagcaagataaaccaacttacctagtacatcagggtgagatgcagaaaaccaaagaaaagattgtgggcatctggagagaaaatacagactacctgtagaaaaccagccagatggtgacttctgtgtcaacaatgaaagccaggaaacagtgaaatttatcttcatcatgttaagagaaaaaggaacttattatgaaagcttacctgaggtgacactttttaaaaagctactaaaaacattttccgacaaaagcagagtttccacttacaaaaggatgtccttgaggtggaaggaaaatgatctcagatggagaatcagatgcaagaaggaacactgaacgaaattgctaaagccttcactgtaagaggagtgtgtaatttatgggagagaaatacagactagaattaaaatgctggacaacaatagcatgtaaagttgagggagcaattacaacactaattttcgggttcttcaggaggaaagtaaagatactgataagacttgaaaaactaaatagattggtacagaagtaattgcattgaaatggcaaaaactgcaatgacttttgcaccaacctaatacatattagctggaataaccactaaagaatgaatataggacatataacttccaaacaagtagagagggaagaaagcaaaaggagtatgggcaaggttagtactggtgctgcatctgatggaacaagctgagcctgcagggcagtggtggtaggtagtggtgaagcccccacctttatatcacagcactgggtatagcgtgtggcaagttaagtagatgtgtgcagcaaagagcagagtgaagaacaagaatagggacaaagggaatagctccaagacaatttctataaaagcaaagttaaaaattggctggtaagtgagttggtcagcctggcttaaagacacagtcagtacaaatgctttcatattttgctgatgaaattgcaaagtcttctgtaatcccagcactttggcaggccgaggtgggcggatcacgaggtcaggagatcgagaccatcctggctaatgcagtgaaaccccatctctactaaaaatacaaaaaattagctgggcgtggtggtgggcgcctgtagtcccagctactcgggaggctgaggcaggagaatggcgtgaacccgggaggcggaagttgcagtgagccgagatcatgccactgcactccagcgtgggcgacagagcaagactctgtctcaaaaaaaaaaaaaaaaaaaattgcaaagtcttacttgtctgagtatcctccccatatcctaaaagggtttgacccagagtagggctggactgaagctggaggctaccctttgacatgaagatgttatcatttttaggtaccactggctttagagtaggagaggtcacagggaagcattgggctattcaagctcatctctgggtcatcatttcctgggcactaagaagggcttactcaggggcattgattcaattttgaattggtagtgcattacaatgtcacacatttgcaacagacatttctctgtcccttatggtgcacttaaagcatatctatactagtgaaacaagcttagatttatatatgggatcaagatgtactatctactgtcttattcaaatgccttttgctttaatcttttatttattatttatcatttttattttttgagacggagtcttgctctgtcacccaggctggagtgcagtggtgcaatctctgctcactgccacctctacctcctgggttcaagcgattctcctgccttagcctcccgagtagctgggattacagttgcccgccaccatgcctctctaatttttgtattttagtggagatgaggtttcaccatgttggccaggctggtctcgaactcctgacctcaggtgatctgcccgccttggcctcccaaagtgctaggattacaggtgtgagccactgtgcccggctttttatttctttttatcgaggttagtgactctgaaatctagctcagatttttgagatgatttagaatgatcatttatattaaactactcagcacaaaattcaggctctggaaccaaattgtctgagttcaagtccttgctgtgctactttagctgtgtgaccttgagcaaatttctaaagcatttggtacccttcatcatgggaagaataatatctacatattatgaagatgtaatgagataatgaatgtaattggacttaaaacagtacctggcacatagtgtattattactattgtatttgtcaccaggtgcttttacatatatatgcatataattagctatgcgattgctcagttattatgtccaactacttcagggatgatttcaaggggaactcaaaatgacaagcaagtggtatacatgtccacaccctagattaggaaaagatagccttagtcttttggtgggtacttagacctcttttgtccaggctctgttgtaggtgcttaagtgttaggacctttaggaatgattcttgcaaaagtgaatgttaaaggcttagagattactatggcacgcccacatggaagcatctgtttattctggtagtgcttgtgacaacacatagacttctcagaaccaagatgagaaaagacatcctcacaagatatcaaggtttttctgtgtgtctgaaacctcaagagataaaggagtaatctttgggcatgagaacccatgagagatatgaagggatttaattgaatgaaagaatgaataaaaagctacatacatttattaagtattttgttgtatgttaggccctatactggtgatagacagacatgtagtgagcacatgtcctcaaggaacatttggtaaattactccaagggcaaagggtttcaagcagtgaagtccttagatcactagctatagagaagagtatggagaagaaaagactggatgatcagaggaagctgcaagattctaggcaagggataatggtggcttagactaggtcatatagtatagaaagaaaagaatatttccagttcagtaatgttaacaggtaatatttagcgctgtgtgaaactttctaagtactttgaatatattgacatttaatcacacgaaccctatacgtaggggaatgacatgaacatatataatagtagcaaatattttggggctaaccttcgtgctaggcttcacatgctctgtcacccaggctggagtgcagagactgtgatcttggctcacagcaacttccacctcccagattcaaacagttcctgcctcagcctcccaagtagctgggattacaggcatgtaccaccacatctgcttaatttttctatttttagtagaaatggggttttaccatgttggccaggctggtcttgaactcctgacttcaggtgatctgcctccctcggcctcccaaagtgctgggattacaggcattagccaccacacccagccatatatgcattattcttgtttaatattttccacaactctgtgattctccccatcttatagcagttaagtaacttgccttaggttacactcagtgacaaaggttaaacatttttttgtttttgatcagatttgtttgattagaaatgctgtgggtttttcttttactactaacataaattgcttcagaaggtagaattggtagaacatagggtgaggagaagagttgagaagaacatagggtgaggagaagagttgcctgggcaacatggtgaaaccctctctctactaaaaatacaaaaaattagctgggtgtggtgtcatggggcttctggtcccagctacttgggaggctgaggtgggaggatggcttaagcctgggaggcagaggttagagtgagccaagatcatgccactacactccagcctgggtaacagagtgagaccccatctaaaaaaagtaaaacaaaaaaggaatgattttctgatatctgggtgatatcagccactgattgagacaggaaacagtggcaagtagaaggatatgttggaagagaaaaatttagttacaagtaaagttcgaagtgattgaggaacactgaagtggaagtatccaataggcagctggatatgtgacactagggctcaaaagaggcctggattctgaatacagatttgacggtctactttaagcaatgtactttaagctataagagtatatgagatggcccagggagtgtaagtatgagaagagtggagagtttagatctgaaccctgttggtacataaatatttaagaagggaaaggagaccctgaaagactagggaactagtctgatttaggagaatatttttgtttgtttttaaattttcttttttttctttcttttttttattttttgagagagagtctcactctgttgcccaggctggagtgcagtggcgcgatctcaactcactgcaacctcctcctgggttcaaacaattctcctgccttggcctcccaagtagctgggattacaagtgcgtgccaacaaacctggctaatttttgtatttttagtagagacggggtttcgccatgttggccaggctggtcttgaattcctggcctcaggtgatccgcccactgtggcctcccaaagtgaggcttgaaccaccacacccagcctgtttgttttttttaagaagccaatgctgcttcccattgcaaagtaactaacaaaaaagtagggtttgctttgatctgtttcatcgttggaggatatttaatttttcttccaatcttcctacaatatttggatctttggggtctggaaccctagagagcatggattcagtcttccatttaattctccttccctctggtataaaaccaggattcagaatccagaaaggccaccttaccgattgggcaaaatgggcaatagttccagttcttcccaccatcaggcctgtgtctgactgtcctgcctcatcctgttctccctactcctctcttgcttgtcccttgatccctctctttctttgctttcctcttcatttatttccactagttctctagttgcttccactccagacctctacgaccaggcagcctatcaagaattacaaatctggttttatttctcctgctcaaaagtttgtccctcaaagagtggttagcatagccaatagggcacagccatattccaccctgtgacttataggaggaagctacttcatgtgaggtggtcccccttggtgagtccttcctgcagagcagagattgccagcttacttagggtagtcctgagtcctggaggactgacaggactgactaagaacccatatactcctttactctgtctgcttttgtcccttactctgattccaacagactcattgccacataaacccaggctttcaggggtcagatgggaccagtgcgggctggggatttctccttattgagcagctctctacctataaggccagtaaaataccaagtacagagcatagtaggtgctgaacataggcgtacatagtaaccactagtgatagttgagataatgaatgagtgtcctttgctggcagagcccatcaccagccaggagtctccacctccagcaacagtggagtggaccttcagcacacaccccaaccccaccttgcctcaccctgaccccattctgcctcatagatcgattatttttaatattttggtttaaattaaaagaccctatatgactttttaaaataacatgatttaacacggcagattacggaattaaaattcttgcctctcttttatgtcactccccaggaataactactcttaaccatttgttacatatcctttcagatatctttctccaagtgcttattcaacaaagacttcttttttattttttattttgagacagagtctcgctctgtcgcccaggctgatttccgctcactacaacttctgcctcccaggttcaagtgattttcctgcctcagcctcccaagtagctgggattacaggtgtgggccaccatgcccggctaatgtttgtttttagtagagatggggtttctccatgttggccagactggtctcgaactcctgacctcaagtgatccacctgcctcagcctcccaaaatgttgggattacaggtgtgagccaccatgcccagccacaaacatttatttctaatggaatgtatgatgtacatattctgcaattttgtttttttcccataaagcatgtcatggacatctttctaccatagtgcatattagtcttccttgttttcctcgtgattgcctattttaccattataagtctgtgccattttagacctggtatcttcctgcttctgggcaatctttttgtggccaacatggaagtctatagcccacttaggagacatttttcccagtatggaacctcagtccagagcccatgatcctgtggttaggatgagcagacagtatggccgctttgccccctctctggacaattcagccttatcagcctccaactcacttccccagaggatttggaaatatgcttcctactgctctgtgcccctgggcagagatgctaagtatcctgtccaccccttccttcggaacataacacagaggatttttggctttttaaacctgcatcttatctgaaggtagggattgctctgcctgccatcccaaagcctacagtcctgacactgtgaaatgagtgcagaggaaggaggtggaatgcagttggctttgagtcctagccagccgtttgaaggctacagcctgcttctaacttgtttctgatggaattcccaggaatgaccctggctcaacctgattctcatcatgtcttctctgtactttggagaaatcaggtcccaaactctcctttctgggcctctctaatgtctgactgtggacattcagtatctcagctctgacttcgcctttacttcctgtagagtgtcttgaattctggtaactcatattcttgtgatggtacctcattgccagttgctttgtaacctgcattccatagtgttgcttacatgaaactgacttaaaaagtgaaaccctgaccccatcagtactgtcactcatcacttaatcacaaggatatgttctaagaaatgcatcgttaggcaatttcattgttgtgggaacatcatagagtgtccttatgcaaatctagatggtaccatttactacactcctgggctatgtggtatagcccactactcctaggctacaaacctgtacagcatgtgtgtaccattattatagtaataatgaatactgtaggcaattgtaatatggtaagtatttgcacgtctaaacatagaatgtttacctgcatagggtacttacgtgaatgaagcttgagaactgaaaattgctctgggtgagtcagtgagtgagtggtgagtggatgtgaaggcgtaggacattactgtacgcttgggctacactaaatttataaaccatttttcttcagtaataaattagccttagcttactatagcttttcttcacaaactttaaaaatttaaaaaaaaacttttgactcttttgtaataacagcttaagacaaacacattgtacagctgtacaaaaatattttcttcttccatatccttattctatagctattttctatttaaattttgttattttactttaaaaattttttttttttggttaaaaactaagacataattccagcactttgggaggccaaggtggcaggatagcttgagatcaggagttcaagacaaggttgggaaacatagcaaaccctgtctctacaaaaaaaatgaaaaaattagctgggagcaatgatgcactcctgtagtcctagcttcttgggaggctgaggcaggagggtcccctgagcccaggagttccaggttacagtgagccactgcactccagcctggatgacagaataagaccctgtctctcaaaatgaatcaatcacacaaagaagccaaaaactaagacacacacacacgtgttagcttaggcttacatggggtcaggatcatcactgtctttcacctccatattgtgtcttactaggtcttcaggggcaataacgtgcatggagctatcatctatggcaataatgctttcttctggaagatctgctgaagagacctgcctggggctattttacagttaacctttttttatttttgaaacagtgtcttgctgtctcgcccaggctggagtgcaatggcacgattttggctcaccgcagccttgaactcctcaggctcaggcgatcctctcatctcagcctcctaagtagctggactacaggtgcatgccaccatgccaggctaagttttgtattttttttggagagacggggtctcaccatgttgcccaggctcaggctggtcttgaactcctgggctcaagcaatcctcctgccttggcctcccaaaatgctggcatttcaagcgtgagccaccctgcctggcatagttaactttttttaataagtaggaggaatatactcaaaataataaaatatagtaaatacataaaccaataacataatcattcattattatcaagtattatgtactgtacataattgtatgtgctatacttttatatggctgacagtgccgtaggtttgtttacaccagtatcaccacaaatacatgagtaatgcattgtgttatgatactacaaccgttatgatgccactagtgatgggaaactacttcatacagatgctagggcctaaggctattcctgtctttgaggagctctgatcccagggatgaaggcagtaaattcattaatgaggtaagcattactataatgatttctttttaacatttagaagatggttgacttctgccaggaaggagggcaaggcttcactgaggtgacattttggttcgtttgaaaggataattaggattccatcagttggagaaggtgtgaagtcattcaagtcagatagaataatgtgcaaaagtacagaggtataaaaagaatgctgttcattaggtgtccacataggcaagaggaagtttctctttatagaaacatttcatctcataattgaaggtgtgattgaaatataatattatcattttgcaatccctaataaagggatcttaggcattgagcatcaacagctgctaacatcacaaaaagagatctgtatcacctatgaagtagtttaaaaaaatatcaagcctgagtctgatcaaacttgtagatccaaatactattttataggaaacacagaagatgggggcaatgtttaactataccataaggatgtaactagcaacatgggaggaattacaaatgacccaatttctttaataaattaattgcaagaagaaaaaaagtggagacagacctatagattaaaaaatatcagtctcaatgcatgcgtcttatttggattctaacataaagaggacattttatgagacaattggaaattcgaatactggatatttgatgttactcagggattattatttttagatatgacagtggtatcatgggttatgattaattcattgtaaattcgagcaatgtactgaaattttaatggataaaatgttatgatgaggaaatttgcttctaagtagtatgggagaagagtagatgaggctataagtgacacaattggctatgggtaattcaagctggggtatgggtacaccaagtttcattatagtattttgtttgatttttctgtatattatttaaaatttaaaattagaattccctgtaataagttttttaaaaatggtatatttgggatctagtagctccatgtggctgaggcacagggacatacagggcagcaggatatgggactatgaagggagttagggtctcaggggtggtgcttgggctataaagttcttttcatgcaggcaaatgagtttcacaccaccctggagacctagcgttctgaggtggagcctctggagcaaggatgggggacaggagctgaacagaggggatactaggatattttaacaagaacagctttgcttctaacttttattaaattgggcttccaggtaatattttgtttaaaaacgggattctgaggcttcaaaaaatttctctgtagccattgagagaacagttgaatattttaaagaccgtcacttgagccatagtgcagaagattggaggtagggaaatcagctgggaggctattttaatatagctgggaggcaaatgaataaagcatttgttttgagaggaatttagccagtgaagatttggtcccaggaggtaaaccttttaagacaatatttgtaattattatttcccaggccatactcctagggaagacaacaaagagggtgtggaaatatgcttactccttgtaacaagaaagccagtccttcttagcacccactggggaataggctggaaccctgctcctttctcttctatctggctcttgacagagcacacggagaactatgtctcccttacaactgtctcagcatcttctttgatcagagtctccagtctgtcctcctgtgcaccataactgataatttggtgaggtagggagtgatgccagctgtttgggtttacagtgaccacttctattattgttgctccgtttcaactatagctgctttcagtatgcaccaccacatctacttgaccgtactctaccttcttatagcagcttaaactccagagtgtaagaccccaacaactagccatctcttcttcccttttctgtgaaatcttagagtctgtctgactaggcaaatccactgactttccctcctagtaatctccctcaaatgtaatgtctcactgagccctgcgcctttaaaacacacggacacatactcatgcatcaagctgctaacagctaataaaaatgaactattaacattccagactctgctaggtgcctgtaatcctaacactttgggaagctgaggtgggaggatcgcttgagcccaggagtttgagaccagcctgggcaacacagtgaggccccatctctacaaaaaacccaaaaattagccgggtgtgggatcacgtgcctgtagtcccagctactcaggaggctgagggagaaggatcatttgaacatggaaggttgaggctgcagtgagctatgatcatgccactgcactccagcctgggtgacaaagtgagaccttgtctaaaaataaaaataacatttagatcttgtctaaaaataaaaaacattccagacttggtgaaaatcatttaggtacatctttatgtgtctctatccctctggctttcagtctacaatgtcctggtgggcgggacgcatgtttcttaaccttgcctttgcccctctgacttgatgcttgagtgaagcctctttagttcttactttttgtgctcattaagatcttagccttcttgaattatggaactccttgagaatctgatgattgttacggacctgctccagagaaatgcacacacatagtattttgcctacaatttgagagtctcttgaattttaaagccgttgcaatttaaatgcatcaggaagacttgacagcagagagtttcttgataaaaatgcagtattcctttattgctgcttgtttggttggtttaaaaatatgcgatatttcttgtcctaccctagcatttctggtgccagtatcaccaatttaaacaatctccctggtaattctaaagttcactaagatttgagaagttctgccctaaagactcagcttgtcttcatagtctatctcatcttctgctcccagccacttaactcctgctacaggggttcaaactctggagtcctggttgttatctaaagggaacaactgccttcctgtagggctaaagtgaagccccttcatggagaagcactagagtctgacagtgggcccaggtcttcttcattttcaggtatagttctgaattcagaaagccaagtcatgtcccagagagctgcacttctctccttctttctgtccatctctcatcaattatttctgtactcaccttcccccacttcagactggaactttccctcttctggagttgttgctttccaccatacaagatgtcttgtgcttctgcatgttggcatccaggtgtattattattcctgtgtggtagccagcggtgcagacttagaatgccttgtaagtgcctctaagtaggatatagtaaaaaggtttgcagagttaagcttacatcccagcaggtccaggtacttctttgaggtacaaaactgatgacagggctgggcgcagtggctcacgcctacaattccagcactttgggaggccgaggtgagcagattacttgaagttaggagtttgagaccagcctggccaacatggtgaaatcccatctttactaaaaatacaaaaattagctgggtgtggtggtgcatgcttgtatttccagctacttgggaggctgaggcagaagaatggctcaggaggtggaggttgcagtgagccaagattgtgtcactgcactccaacttgagtgacagagtgagtgagactctgtctcaaaaacaaacaaacaaacaaactgatgacagagcagagaaggtcatattgagtaacttaatttattatttttactagctataaacaatttaaaaaatgtaataattgaaaataatttagaaagttcagaaggggccaggcacagtgggtcatgtctgttatctcagcactttgggaggctgaggtgggaggattacttgagcctaggagttcaagaccagcctgggcaacatagtgagatccctgtctctacagaaaaataaattagtcaggtgtggtggcatgtacctgtactcccagctacttggcagactgaggcaggaggatcccttgaacccaggaggttgaacctgctgcatagctagggtgacagagtgagaccccatctttaaataaataaataagaaagtacagcaaatgtttttttttttttttaagtggaggctaagtcaattataatcctagttttttaagtagaggctaagtcaattataatcctagttcctgccatccagaggcaaccattattaacattctggcatccttccatctagtgtttttctattttttaaaaaatagaaattatacaatatatacaacacagttacctgcttttctttgcctaaccttgttttataacatttcccaattaatgcttcaaaatcgtattttcttttcatggctgcatgatatttaattaaataaatataccattatgtaacttttgctcaattgttggatacttaagtgtaatacctatgtatagtattataaatatgctgtaataaacatcttagtacctaaactttttcttctggattttttccttagaagaggaattgctgggttagaaattatgaacatttttaagactcttgatatacagtactaaattattttccagaaagattagagtatgtagccttttcagattgggttcttttacttagaaatagcatttaaggctctttcctgtcatgttatggtttgatagctcatttcttcttattgctcaataatattccattgtatggctgtaccatagtttatccatttacctggataaacaaatccaaaaacatcttgggtacttctaaattttagcaattatgaataaagctgctgtaaacattcacgtgcaggtttttgtgaggatgtaagttttcaattaatttgagtaaataccaaggagcatgatatggtatggatttgtgttcccacccaaatctcatgtcgaattgtaatccccagtgttggaggaggggcttggtggatggtgattggctcatgggggtagagttcccccttgctgttctcatgaaaatgagtgagttctcatgagatctcattgtttaaaaatgtgtagcacctcttccttcactgtcttccttctgctccagccatgtaacatgtgccagcttcccctttgccttcctccatgattctaagttgcccgaggcctcccagaagcagaaacctgtacagcctgcagaaccatgagacaattaaacctcttttctttataaactacccagtttcaggtatttctttatagcagtgtgagaacagactagtacagagcacaattcctgaatcatatggtcagcctgtgcttagctttgtaaactgaaattgccttttcctccagcagtgaggaagagttcctgccgtttcccatcctctccagcacttggtgtaaatgtttgtgttttggatttcagtcgttctaataggtatgtagtggtatctcgttcttgttgttttctctctcatcattgccttgatttgcagtctcctaattatgcatggtgctgagcatcttttcatctgcatatctatcatctttatatcttctttgtaaagttttcagatcttttgccctttttaaatttttttaaattaagtttttagagttcatatattttggataccaatcctttatcagataagtggaattttttttttttttttttttttttaaacagagtctcgctctgttgcccaggctggagtgcagtggcgtgatctcggctcactgcaacctccgcctcctaggttccagcgattctcatgcctcagcctcctgagtagctgggattacaggtatgtgccaccatgactggctaacttgtatttgtagtagagatgggatttcaccatgttgtccaggctggtctcaaactcctgacctcaggtgatttgcccgcgtcgacctcccaaagtgctgggattagaggcgtgagccaatgcggccggctgttttccagacagggtctcactctgtcaaccagtctggagtgcagccttgacctcctggacttaagggatcctctcgtctcagcctcctgagtagctgggactatagtctcactatgttgcccaggctagtcttgaattcctgggcttgagcgatcatgctgcctcagcttctcaaagtgctaggattccatgtctttgctattgtgaatagtgctgagatgaacatacatgtgcatgtgtctttatgatagaatgatttttattcctttgggtatgtacccagtaacgggattgctggattgaatggtagttttttattttattttattttattattattatactttaagttttagggtacatgtgcacaatgtgcaggtttgttacatatgtatactgtgctgcacccattaactcgtcatttagcattaggtatatctcctaatgctatgcctcccccatacccccaccacacaacagtcccgggtgtgtgatgttccccttcctgtgtccatgtgttctcattgttcaattcccacctatgagtgagaacatgtggtgtttggttttttgaccttgcgatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaatcaatctagatgcccatcaacagtggacttgaaaaagaaaatgtggtacatatacactgtggaatactacacagccataaaaaagaacaaaatcatgtcttttgcgacaacatggctggagctagaggccattatcctgagagaattaatgcaggaacagaaaaccaaatactgcatgtccttacttacaagtggaagccaaacactgagtacatgtggacacaaagaagggaacaatagacaccagagcctacttgagggtggagagtgagaggagggtgaggactgaaaaactacctattgggtactatgctgattaaatgggtgacaagattatttatataccaaacccctgcaacacacaatttacccatgcaacaaacctgcacatgtatcccctaaacctaaaataaaagttggaaagggaaaaatgtcaataaataaataaactcaatgttcatttagaaaaaacaaaacaaaacaaaaaaacaaacacaaagtgctaggattatgggcatgagccacagcacctggcccatcagataagtgttctacaaatattttctttcggtctgtggcttgtattttcatttttgtaacttacaaacttctaaatgattgagtaaatcaagaaggaaaagatagagtacacaggcattaaaagttacctacataaacaaaataagatattcaaaaaatggcaaaatattttcagcagatatgacaaatcattaaatgtgttcattatatgaaaagctgatatatacatatacgtatgtcatatatatacatatatgtagccagaagacttgaacagataattaataaaagtggttatataacaaataaatatgtggaaaattgtttactcttgctagtaataaaataagtgcaaataaaacaataaagtatttccactttttgggcttatcaagttagccaaaaaattttcaatgctattgtctaataatgtgttggaaaagctacttatacatggctgagaggagtctaaattggcaaagcaattcgctgatacaggaggtcttttaaattatttttatttattttttaaattttttgagaaagggtctcgctgtgtcacccaggctggagagcagtggtgcaatcgtgtctcactgccgcctcaacctcatgggcccaagcaatctttctgcttcagtcttctgagtatctgagaccacaggtgggagccaccatgcccagctaatttttttaatttttatattttgtagaaacaggtctcactatgttgcccaggctggtcttgaactcctcggctcaagtgaaccttccacctctgcctcccaaagttctgggatcacaggcatgaaccactgtgcccagccaaggtctttaaaaatgtcaatgaatgaagcatagttgttaagaatgcaaagtttggagtcatgaaaactttattataggccaggcacagtggcttacgcctgtaatcccaacactttgggaggtcaaggagggcggatcacttgaggtcaggagtttgaaccagcctggccaacatggtgaaacctcatctctactaaaaatacaaaaattagctgggcatggtggcacatacctataatcccagctactggggaggctgaggcatgagaatcacttgaacccgggtggcagaggttgcagtgagccaagatcacaccagtgcactccagcctgggcgacagagtgaaaccttgtctcagaaaaaaaaaaaaaaaaaaaaaagaaaacttgattataaattctgactctatttttatccataatatagggataataatgctgcctatctcataaggttattgtctggtttaaatgagagaaagcctgtaaagcacttgtaagagtaatggacacatggtggcagagctgaatttccaacacagttcttcctgatatcagtgcttttctttgctatttagtctttttttttaatgaataggaaattcaaacaacgtagaagtaaataaagcatcaaagccttccctttccctctgcatctccacttccattttcatttttcacagaaaaatatttgctgttaagagttttattcaaaacccctcctatatatttataggcataaaaagatacttttacatgcacagttcccttcttccctttctctcttctttctttcctcattccctccctttcttccttcgtccctgcctccatcccttcctccttcctttccttccttctttaaataaagaatgatgattctgtgtgcattgttctgcaactcaacagtatgatttgaacatctgcccatatcagtccctgtgcagagcactctattatatggccacactaaatttatttgatctttcccctattgatggatgtttttgctgtttccgatttctgctccatcaaataatgtttcattgaaaatcattttgcctatattttgcatatatgtgggagaagcacagtagcattttttttagttgtgatgagttatatggggtaatgcttccatttttattctctgtgcttacctaggattattagcatttattgaagaatgcagagctcagttagggggtctagaatgttgtctttgagcaggattatgccatgcacattggtaagtctgagatacttgctgtgttttcatttacttgacactgttgtgctgctgagccaaccactaacatgagttgaactacatgtctatgcctctaattgctgacagtgtgctgagaagagaggtaagagacccacagaaaagttttagagataataatagcagacatgtaaaattctagggactttaaaatcacggccaggcacagtggctcatgcctctaatctcagcactttgggaggccaaggcagacagatcacttgaggtcaggagttctagactaccctggccaacatggtgaaaccctgtctctactaaaaaaaatacaaaaaattagccaggcatggtggtgcattgtgacaatgtcctgggacataaattgctcccagctacttgggagtctgaggcaagagaattgcttgaacctgggaggcagatgttgcagtgagctgagatcgttccactgcactccagtctgggcaacagagtgagactccatctcaaaaaaacccaaaaacaaaactcgcagggaaaagcttttgtgagagatgggcttaggatgaggatttggaatgaatgtaatacattatgtaatgccctagaagtatactggtaatacaatgtgataagtaacacatttgacaatttctaaatttttaattccatgatttatgaacttagaaactatatatgacagagtgttcaaaaaattgttttgtggggtttcacttctgtgtgaggaatattaatgtgaggagtgttaaatggagcaggacactagaggtggtaaggacagattgtattcagtactactgcaataggggaaagagacttcagtgtagaactgagctcaattctgaatacaacaaggacaaatggggacttatagtcaaggagcagagtgagggaggtcagaggatggaaaaattagtttgcctaaagcagagctgttacctagagagaagcacaccagtgatttctatccccactactcagctctggaactgtggctctggtatctttcctagggggagaggcggactctaaacaaataaatctaaagtcttcccataaggaatggagtttgatacaggatgtagggaagttcaagtctaagggttctctcaaacaatggcagtttcattagaaagcaattaagaggcagctggtggctttatgatagatacaagcgagcccacttaccaactagtttaccagagagcatcagggaaaaggattgctaagaagagccctcctggggacagagcaaaccttaaacatgcatctcaaaaatgaaccctgcaagggagtcctaatttaattggattagctgtggagcaatttatgtctcaggacattgtcacaaacaatagagcaatcagctgacaattagtgaagcataagagctgggagtgatcaagggaagaggcagtagaagagagccctgctaaaataacattactgacatcctagggtgcctgtgcatatgcccaatgttgcaccttctgaggaacaacatcagaggctttacagtgtgaaggaaatagacttcactaaaataatccacccagacaatatacaaacaggcatacaacaataacaagccttggcatcagagggaggggagtgatatccagaacttctacaatatatcatctgaagcatttgttttcaacagaaattatgctaacgtcaaggaaacaggaaagtgtgacctatacacaggataaaaatcagtcaacagaaactacttgtgagagggacagatgtcagacttaacaaagacttcaaagtagccattatgaaagtaaggaaaccatgcttaaggaagcaaaagaagataggatgacaatattttattatgtagagaatatcagtaaagtggtagaaactataaaaaagaatcaagtagactttgtgaagttaaaaagttcagtaactgaaataaaatcactagagaggctcaacagtagatttgaactggcagaagagagaattgaacttgaagatagatcagcagagattatgaaatccaaagacagaagaatgaagaaaaatgaacagaacctcagaggtatctgaagcagctataacaatgtcagacaaaataaaatttaaaataaaaatgttaatagagataaagaaggacattttataataataaaggggccaatctatcaggaagacataacaattataaacatatatgcacctattaacagcatcccaaaatacatgaaacaaaaactgacagaaatgaaaggagagatgacaatttgataatagtccttggagacttcaataccttcagcaatagatagaacaaataggcggaagatcggtaggaaacagaagacttgaccattataaacaaactaatcctaacagatactccaggagtagcagaatataaattcttctcaagtgcatatgaaacattcttcaggatagaccatatgctagaccataaaacaaacctcaatacatttaaaaggattgaaatgcttcaaagtatgttcttcaactacatggaatgaaataagaaatcaacaactgaataagagaaattcacaaatacatggaaattaacacactgaaaaccaatgggttaaagaagagtatcaagagaagctgagtgcagtgtgtgcctgtagtcccagctactcggggggctgagttgggagaatcactggagctgaggagtttgaggtcagccagggtaacataatgagaccctgtcttaaaaacaaacacaaaacaaacaacaacaacaaaaaacacacaaaatacaagagaaaattcattgagatgtataaaaactaagaaaaaatagccaggtgtggtggctcatgcctgtaatcctagcactttgggaagccaaggtgggagaattgcttgagttcaggagtttaagaccagcctaggcgacatagcaagaccttatttccaccaaaaataaaaaaaaatttagctgggcagtggtggggcatgcctgtagtcccagctactcagggggctgaggtgggagaattgcttgagcccaggagatcgaggctgcagctatgattgtgccactgcactccagcctaggcaacagagtaagaccctgtctaaaaaaaaaaaaaaagaatgaaaaaaaaataacttatgggatacaactaaagctgtacttaaaggaaatttttagctataaacatctatattataaaagaagaataatctcaaatcaataaactaaacttccaccctgacacttaaggaaaaagaagagcaaaccaaacctcaggcaagtagaataaaggaagtaataaaggctagagtgaaaattaatgaaatagataatttaaaaaatagagaaaaaaaaatcaaaaccaaaagccaattccttgaaaagatcaacaaaatcaacaaacattttagctagactgaacaagagaaaaagagaagactcaagttgctaaaatcagaaatgaaaaagggacatcactactgacctaatagaaataaaaagtattataaaataatactatgaacaatagtatgccaataaattagataatttagataaagtgaataaatccctggaaagagacaaattactaaaggtgactcaagaagatatagaaagtttgaatagatctttatcaagtaaaaatattggacaagtaatataaaattgccaacaacaacaacaacaacaaaaacaacaacaaaaattcaggcctagatttcttctctggcaaattgtagcaaacatttaaagaagaattaatagaaatatttacaaacttatctaaaaaaaaaagaaggatgaatacttttcagtttattctatgaggtcagtattatcctgataccaaaaccagacaaggacataaaaataaaactgcagaccaatatctttatgaatatagaccctggctgggtatggtggctcacacctataatcccagcccttttagaagttgaggtgagagaatgcctttgagcctaggagttcaaggccagcctgcacaacatagtgagacccccatctctacaaaaaaaaattaaaaattagctgggtgtggtggtgaacaccagtagtcccagctacttgggaggctgaagtggaaagatcttttgaacctgggaggtaggggctgcagtgagctgttatcacactactgcactccagcctgggtgacagagcaagaccctgtctcaagaccctctccaagacagacaaacaaaaaaacccaaatgagaagacagactcccaaatcctcaaaaaaatactagcaaacagggtatatcaacatataaaaatgcttgtacaccatgagcatgttaaacgtatcccagtgatttatttatttggagacaaagccttgctctatccccaagtctggaggtcagtggcatgatcttggctcgctgcaacctccgcctcttgggttcaagcgattctcatgcctcagcctcccgagtagctgggattacaggcacccagctaagttttgtatttttagtagagactaggttttgccatgttggccaggctggtctcaaactcctgaactcaggtcatctgcctgcctcggcctcccaaagtgttgggattacaggcgtgagccaccacacctggccctagcgatctattataagattggtttaacatccaaaaatcaaccaataggacaaaaaataataggtgtgttcccatagatgcaggaaaaaaaatttgcagaaatctaacatgctctcatgataaaaacactcaacaaactagaaatagaagataattttcttaacctgataaaggacatctacaaaaaaacccacagctaacatcatacatcatctcggctcactgcaacctctgctcccagtttcaagagattctactgcctcagcctcccaagtagctgggattacaggtgcatgccatcaccctgtggtgcctggctaattttttgtattttagtagagacagggattcactgtgttgcccaggctggtcttgaactcctgagctcaggcaatctgcctgccttggcctcccaaagtgctgggattacaggtgtgagccaccatgcccggcttaatatttttaagatggcaatactccccaaactgatcttcagatcaacacagtccctgtcaaaattcaagctggcttcttagcagaaatggagaaggtaatcctaaaatcatatgggaattcaaaggatccagagtaaccacaacattcttgaaaaagaaaaagaaagttggaggactcatgcttcccaatttcagaacttactacaaagctacagtaattaggacaatttggaagtggcataagaatagatatatagaatggaatacaattaagagtcaaaaaataagcccatatatttacagccaattgattttttttcttttcttttcttcatttttttttttttttgagatggagtcttgttctgtctcccaggctggagtgcagtggcatgacctcagctcactgcaatctccacctcccaggttcaagtgattctcctgcttctgccttccaagtagttgggattacaggcgcgttccatgacgcccagctaatttttgcattttctgtagagacagggtttcaccatattggccaggctggtctcagactcctgccctcaagtgatccacctgcctcagcctcccaaagtgctgggattacaggtgggagccaccacactcggccccaattgatttttgatatgaagagagaacaatctcttccacaaactgtgttgagacacctggatatccacatgcaaaataatgaaatttgattcctacctcacactgtatataaacattaactcaaaatggatcaaagacttaaatgtaagacctgaaaccatacaactgttagaagaaaatacagggggtaaatctttatgaccttagatttggcaatggatttttggatatgacatcaaaagcattagaaacaaaagaaaaaaacagatgtcttagtgtgagctgctatgacaaaataccataggctgggtggcctaagtaacagaaatgtattggcttctagttctggaggctagaaatctgagatcaggtgtcagcatgatcgcgttcttgtgaaggttttcttcctggcttgcaaacagctaccttctcactgtgtcctcacacagtgaagagagtgagagagagcgagcaagttctctggtgtctcttcttataaaggcactaattccatcatgagggctccaccctcatgacctcatctaaatctaattatctcccaaggccccatctccaaataccattatgctggggattagggtttcaacgcatgcattttggaggcaggggacacaattcagtccatggcagtagataaattgcgatgatttttatagataaaaattaaaggacattgcagcattccaatatggccgaataggaacagctccggtctgcagctcctagtgtgattgatgcagaagatgggtgatttctgcatttccaactgaggtacctggttcatctaattgggactggttggacagtgggtacagcccatggagggcgagctgaaacagggcggggcattgcctcactggggaagctcaaggggttgggggatttccctttcctagccaagggaagctgtgacagactgtaccaggaaaatcgggacactcccgcccaaatactgcacttttccaatggtcttagcaaacagcacaccaagagattttatcctgcacctggctcagcgggtcccatccccacggaaccttgctcactgctaatgcagcagtccaagatcgaactgcgagatggcaagcctggctgggggaggggcatccaccattgctgaggctggagtaggtaaacaaagtggccaggaagcttgaactgagtggagcccatcccagctcaatgaggacccctgcctctgtagactccacctctgggggcagggcatagctgaacaaaaggcagcagaaacttctgcagacttaaacgtccctgtctgacagctctgaagagagcagtggttctcccagcatggtgtttgagctctgagaacggacagactgcctcctcaagtgggtccctgacccctgtgtagactaacttggagacacctcccagtaggggctgactgacacctcatacatatgggtgcccctctgagatgaagcttccagaggaaggatcaggcagcaatatttactgttctgcagcctccactggtgatacccaggcaaacagggtctggagtggacctccagcaaactccaacagagctgcagctgagggacctgactgttagaagaaaaactaacaaacagaaaggaatagcatcaacatcaactaaaaggccatccacaccaaaaccccatctgtaggtcaccatcatcaaagaccaaaggtagatgaaaccacaaagatggggagaaaccagagaagaaaagctgaaaattctaaaaaccagagagcctcttctcctccaaaggattgcagttcctcgccagcaatggaacaaagctggatggagaatgactttgatgagctaacagaagtaggcttcagaaggtcagtaataacaaacttctccgagccaaaggaggatgttcgaacccatcgcaagaaagctaaaaacgttgaaaaaagattagataaatagctagctagaataaacagtgtagagaagaccttaaatgacccgatggagctgaaaaccatggcacaagaactacgtgacgcatgcacaagcttcagtagctgattcaatcaagtggaagaaagggtatcagagattgaagatcaaattaatgaaataaagtgagaagagaagtttagagaaaaaagaattaaaaaaaacaaacaaagcctccaagaaatatgggactatgtgaaaagaccaaatctacatttgattggtgtacctgaaagtgatggagagaatggaaccaagctggaaaacacgcttcaggatattatccaggagaacttccccaacttagcaaggcaggccaacattcaaattcaggaaatacagagaacaccacaaagatactcctcaagaagagcaactccaagacacgtaattgtcagattcaccaaggttgaaatgaaggaaaaaattttaagggcagccagagagaaaggtcaggttacccacatagggaagcctatcagactaacagcagatctctcagaagaaactctacaagccagaagagagtgggggccaatattcaacattcttaaggaaaagaattttcaaccccaaatttcatatccagccaaactaagcttcataagtgaaagagaaataaaatccttcacagacaagcaaatgctgacagattttgtcaccaccaggcctgccctaaaagagctcctgaaggaagcactaaacatggaaaggaaaagctggtaccagccactgcaaaaacataccaaattgtaaagaccattgatgctaggaagaaactgcatcaactaacgggcaaaataaccagctaacatcataatgacaggatcaaattcacacataacaatattaaccttaaatgtaaatgtgctaaatgccccaattaaaagacacagactggcaaattggataaagagtcaagacccaccagtgtgctgtattcagcagacccatctcacgtgcagagacatacatagcctcaaaataaagggatggaggaagatctaccaagcaaatggaaagcaaaaaaaagcaggggttgcaatcctagtctctgataaaacagactttaaaccaacaaagatcaaaagagacaaagaaggccattacataacggtaaagggatcaattcaacaagaagagctaattatcctaaatatatatgcacccaatacaggagcacccagattcataaagcaagtccttagagacctacaaacagacttagactcccacacaataataatgggagaatttaacaccccactgtcaatattagacagatcaatgagacagaaggttaacaaggatatccaggaattgaactcagctctgcaccaagcagacctaatagacatctacagaactcaacccccaaatcaacagaatatacattcttctcagcaccacattgtacttattccaaaattgaccacatagttggaagtaaagcactcctcagcaaatataaaagtacagaaatcacaacaaactgtctctcagaccacagtgcaatcaaattagaactcaagattaagaaactcactcgaaaccgctcaactacatggaaaccgaacaacctgctcctgaatgactactgggtaaataacgaaatgaaggcagaaataaagatgttctttgaaaccaatgacaacaaagacacaacgtaccagaatctctgggacacatttaaagcagtctgtagagggaaatttatagcactaaatgcccacaagagaaagcaggaaagatctaaaatcgacaccctaacatcacaattaaaagaactagagaagcaagagcaaacaaattcaaaagctatcagaaggcaagaaataactaagatcagagcagaactgaaggtaatagagacataaaaaaacccttcaaaaaataaatgaatccaggagctgggtttttgaaaagatcaacaaaattgatagactgctagcaagactaataaagaagaaaagagagaagaatcaaacagacgcaataaaaaatgataaaggggatatcaccactgatcccacagaaatacaaactatcataagagaatactatgaacacctctatgcaaataaactagaaaatctagaagaaatggataaattcctcgacacatacaccctcccaagactaaaccaggaagaagtcgaatccctgaatagaccagtaacaagttctgaaattgaggcaatacttaatagcctgccaaccaaaaaaaaatccagggccagatggattcacagctgaattctaccagcggtacaaggaggagctggtaccattctttctgaaactattccaatcaatagaaaaagagggaatcctcccgaactcattttatgaggccagcatcatcctgataccaaagcctggcagaaacacagcaaaaaaagagaattttagaccaatatccctgatgaacatcgaagcgaaaatcctcaataaaatactggcaaaccgaatccagcagcacatcaaaaagcttatccaccaagatgaaattggcttcatccctgggatgcaaggctggttcaacatacgcaaatcaataaacgtaatccatcacataaacaaaaccaaagagaaaaaccacatgattatctcaatagatgcagaaaatgcctttgacaaaatccaacagcccttcatgctaaaaactctcaataaactaggtattgatggaacatatctcaaaataataagagctatctatgacaaacccacagccagtatcataccaaatgggcgaaaactggaagcattccctttgaaaactggcacaagacagggatgccctctctcaccactcctattcaacatagtgttggaagttctggccagggcaatcaagcaagagaaataaataaagggtattcaattaggaaaagaggaagtcaaattgtccctgtttgcagaagacatgattgtatatttagaaaaccccatcatctcagcccaaaatctccttaagctgataaccaacttcagcaaagtctcagcatacaaaatcaatgtgcaaaaatcacaagcattcttatacacaaataacagacaaacagagagccaaatcatgagtgaactcccattcacaatagctacaaagggaataaaatacctaggaatccaacttacaacagatgtgaaggacctcttcaaggagaactacaaaccactgctcaacgaaataaaagaggacacaaacaaatggaagaacattccatactcatggataggaagaatcaatatcatgaaaatggccatactgcccaaggtaatttatagattcaatgccgtctccatcaagctaccaatgactttcttcacagaactggaaaaactactttaaagttcatatggaaccaaaaaagagcctgcattgccaagacaatccttagcaaaaagaacaaagctggaggcatcacgctacctgacttcaaatatactaaagtctacagtaaccaaaacagcatggtactggtaccaaaaacagagatatagaccaatggaacagaacagaggcctcagatataacaccacacatctacaaccatctgatctttgacaaacctgacaaaaacaagaaatggggaaaggattccctatttaataaatggtgctgggaaaactggctagccatatgtataaagctgaaactggatcccttccttacaccttatacaaaaattaattcaagatagattaaagacttaaatattagacctaaaaccataaaaaccctagaagaaaacctaggcaataccattcaggacaaggcatgggcaaggacttcatgactaaaacaccgaaagcaatggcaacaaaagccaaaattgacaaatggggtctaattaactaaagagcttctggccagcaaaagaaactaccatcagagtgaactggcaaccaacagaatgggagaaaatttttgcaatctacccatctaaagggctaatatccagaatctacaaagaacttaaacaaatatacaagaaaaaatcaaacaaccccatcaaaaagtgggcaaaggatatgaacagacacttctcaaaagaagacatttgtgcaaccaaaagacacatgaaaaaatgctcatcatcactggtcatcagagaaatgcaaatcaaaaccacaatgagataccatctcacaccagttagaatggtgatcatttaaaagtcaggaaacaacaggtgctggagaggatgtggagaaataggaacgcttttacactgttggtgggagtgtaaactagttcaaccattgtggaagacagtgtggcaattcctcaaggatctagaactagaaataccatttgatccagtgatcccattactgggtatatacccaaaggattataaatcatgctactataaagacacatgcacatgtatgtttattgcagcaatattcacaatagcaaagacttggaaccaacccaaatgtccatcagtgatagaatggattaagaaaatgtggcatatatacaccatggaatactatgcagccataaaaaggatgagttcatgtcctttgtagggacatggatgaagctggaaaccataattctgagcaaactatcgcaaggacagaaaaccaaacaccgcatgttctcactcagaagtgggaattgaacaatgagaaaacttggacacggggcagggaacatcacacaccggggcctgtcgtagggtggggggatgggggagggatagcattaggaggaatacctaatgtaattgacgagttaatgggtgcagcaaaccaacacatatgtatacatgtgtaacaaacctgcacattgtgcacatgtaccctataacttaaagtataataataaaaaaaaccctagaaaaacataaaaaaattaaaggacattatgagagaatgaaaagaaaagatattcaatgggaggaatatttgaaaatcatgttatttgttaaaggatttttatctagattgtgtaagaactcttacaagtcaataataaaatgacaaataatccaactaataatgagcacaggatctgaatagacagttgtttccaaagaagatatcaaaatggccagtaagcacatgaaaaggtgctcaagattttagttatcaggaacatgcaaatcaaaaccacaatgagctactgcttcatattcattaggatggctataataataaaagacaaataataagtgttggtgaggatgtggggaaattgaaactctcatgcactgttggtgaaaatgtaaaatgatgcagccactttggaacagtctgacaattcctcaaaaggttaaacatagagtttccctatagcctagcaattcctctcctagatatataaccaagagaattgaaaatatatgttcatgcaaaaatttgtacatgaatgttaatagcggtattgttcacaatcgctgaaaggtagaaacaatccaaatatctattaactgataaataaataaagagtagtctagccatatacccatacaatggaatattattcagccataaaaaggaatgaagtactgatacaaggtacttcatggataaacttaggaacattttgttaagtgaaagaaacccatctctaacacatttttttgtgattccacttatataaaatgtcaaaataggcaaattattgtggcagaaagtagactaattattgcaaagaactgcagggtatagagggattggcagatggtggctaaagagtacagggcttctttttgggataatgaaaattttctaaaattgattgtggtgatggttgtacagttctgtaaatacactaaaattcattgaattgtatgctttagttttattttattttattttttgagacggagtttcgctcttgttgcccaggctgcagagcaatggcagatctcagctcatggcaacctccacctcctgggttcaagcgattctcgtggctcagcctcctgagtagctgggattacaggcacccgccaacacgcccagctaatttttgtatttttagtagagatgaggtttcaccatgttggccaggctggtctcgaactcctgacctcaagtgatccacccacctcggcctctgaattatatactttaaatgggtgaaatgtatggtatgtgacttgtatctaaataaagctgttacaaataattttttaaaataattgtttatatttaagagatatggagctaggtgaagatgaacaaaaattaatgaatcaaaattcaggtagtcattagcttttacatgactatcatttccatatattacacataaacacttctaaacttttctataccaaattttgactttcttattttagtagacaaataactatttcaagttacattatgttactgttgtctgccagccaatagtttcattttagcagtgttgccatctaaatatggcaatgtctgtgcagtgatttgaacattttgttgcatatttgcccttatttataaaagtatagtggaattggaaaaataaagtgctgatgttaatgattttccaattgtgtcaaaggaagctattatttagtatgccagaaacagtaaattttgatgcttatcaaatttaagcagatctgacaactgtgttcaattataaaagaaaacagtcaaacttaaaacacatgtacaaaatgttataagtatgttggcaaagcttgtggctaaaaataaggtgcagtcatggaacaaatgtgtggatctttacaactacgtgtagcagaatattattttgatgtatcaggtttttttccagataatatatatattttttaacctgggggtccttcccagttcaaacttgacctcttggcagccatgcctcgggatagggttgttgcagcatagtgcagataccaaagaagtcaatccttggcctttgaggtttaaaatatgttttggaaactcaaggtagagataaaaacctttgtgattaaaaagcttttgaacttcaaaagctagaaccatcctgagaataaattcagagaataacccagagaataaactcaggccttaaccacaggcacatgagaatatgtgatcagtcagagccagtttttccagtgtcttcttttctcttaaagactagaaaaaaattccttagacttgtaaagtgaagacagtcagaggagaagtgagctctaagtctggtgaatctttaaggaggaatctatccagtggcccaacttgctagagcttctgcaccttttttcgtttttctttttttttttttgagataagagtcttgctctgtcacccaggcttgagtgcagtggcgcgatctcggctcactgcaacctctgcctcccgggttcaagtgattctcctgcctcagcctcctgagtagctgagactacaggcatgcaccaccacgcccagctaatttttttgtatttttagcagagatggggtttcaccatgttggccaggatggtctcgatctcttgaccttgtgatccacccgcctcggccttccaaactgttgggattacaggcgtgagccaccacgttcggccgcttctgtgccttttgaagtgtagacattgagaagaaatgttcgtgtggcagggccaggcagagagagtctgagacaatattcctatgaacccagagtggcatgggacagtggatggatgtgtccactgccctctgagagggaaaaaggagtagctgagagcctggagaggctttccttctgggacatggagtcataaatatgatcaacgtggttgggcagttggaaaccaaatgggaataaagatgttatggtaaatgccaatatgcaggtatccctctctgtcccattcttattccttggtactttgtgaaccctgagagaaggaatatgccaaatatcatttcaagtaaactgaatgaacaaggattttgagttgcaaggatacaccagaaggattttgagttgcaaggatacaccagaaggattttgagttgcaaggatacacgcctgtaatcccaacactttgggaggctgagatgggcagatcacgaggtcaagagatggagaccatcctgcccaatcaacatggtgaaactccgtctctactaaaaatacaaaaattagttgggtgtagtggcacacgcctgtagtgccaactactcaggaggctgaggcaggagaatcgcttgaacccgggaggcagaggttgcagtgagccaagattgcgccactacattccagcctgggtgacagagcgagaccccgtctcaataaatacataaataaataaataaataaattaaataaaatacaatctgtttttaatagtttaaatatctgcatatggtgtataacattcagatgtaaaatcaagttaagcatttatatcatgtttgagacgtcataatttttttctctagctctatggattgaattccttcctttcctcctttcctccttcccccaccaaataaaacatttaagtataaagttcaaatttcaggcattctactttccaaaacattttccaggaaagcattatgtattattaaaggcagggactgtctgaatgggaaaatagctttcctacccaccccccattccagaatattgcaatgaaaatgatcaaaccactgaagcttctagtagtttatcaatttttatcatgggcttttgtccatccagttgcagcatgaccattagaaatagataaattcggcggggcacccggtggcttacacctgtaatcctagcactttgggaggctgaggtgggcggatcccctgacgtcaggagttcaaaactagcttggccaaattggtgaaacgccgcctctactaaaaaaatacaaaaattagccggatgtggtggcaggcacctgtagtcccagctactctggaggctgagacaggagaatcgcttgaacctgggaggtggaggttgcagggagccaagatcgtgccattgcactccagcttgggcaacaagagtgcaactccatctcaaaaaagaaaagaaaagaaaagaaatggataaattcattgcagtctgttcatttactgtcttggggcaaacactcagttagtgggccttattcctttgctactgaggagaaagatggagcctgggtctcaagcccacctttgctgtacctttgccaaatggtactgtatgcttgccggctagaaggagggtgagggatttttttacagcctgagaatgagtgtgtgtgagtgaggtggtatccacattcttacattctttttttgttttgttttgtttttgagacagagtctcactctgttgcccaggctggagtgcagtggcgcgatctccactcaccgcaacatccacctcgcaggtgcaagcaattctcctgcctcagcctcctgaggagctgggattacaggcgcctgccaccacccccggctagtttttgtatttttagtagatacggggtttcaccattttggccaggctggtctcgatctcctgacctcaggtgatccatctgccttggcctcccaaagtgctgagattacaggcatgagccaccaccgtgccccgcctgagccaacactgcacccggccattcttaactccaagtcattgcagtttctttttcccagaaaacaaggggttagatgttgcatttcataaaactaaccaaagttctgtttactgatgcagcacaagagatgtaaaaaaaaaaaaaaaggtagtgggccttattatatcattatagtgagaatagccctggattttgagtctaaatggtttcagttctttgtcatctttgtggtcttcatttttgtttctgtctttatacatatttttaaataaaacatcattaaaactatatagttcaaaaatattatttttctttttaaaaaatttataatagagacgggatttcaccatgttgcccaggctagtcttgaactcctgggctcaagtgatccacttgcctcggtctcccaaagtggtgggattacaggcgtgagccaccgtgcctggcctcaaaatattattaattataaaatatatgatacatacaaaagtgtattaaaacctctggcatttaaagaatattgctaaaataaacacccatttttgtaccatccaccttagaaatagaactttacaaatatctttaatagcttatgaatcacctggggatcattttaaagtgtggattctgatttagtaggtgtgtgaaagagtctgagattctgtatttctaacaggctaccaagtgacccagataccagtgggccaaggatcacgcgtggagtagcatgatctgagatggctcccgtgtgcttctcctaattctatcccttttatctccataagaggtagacactttcttaaattttgcatcaattattccttgttttattttaaatagtttatctgtaatacatttttaaacattataactgtttagttttgcctattttaaaattttatacaaatgaaaaaataagttgtacattctctgtgacttgcttattttattcaatcttgtgttttacagccacattcatgttgatgcggagacctgtagttcattaatttttgccacttgttagtttctgatgtatgaatagcctctttttttttttttttttttgagactgagtttcatgctattgcccaggctggagtgcagtggcgcgatcttggctcactgcaacctccgcctcccaggttcgagcaattctcctgtctcagcacccccctagtagctgagattacaggtgcctgccaccatgcctggctaatttttgtatttttagtagagatggggtttcgccatgttggccaggctggtatcgaactcctgacctcaggtgatccacccgcctcggcctcccgaagtgctgagattacaggcatgagccaccgcgcttggccatgaatagggcctatcttatgcatgaatttctattgttgatggacatttggttgctttcacttttttgctatgacaaacaaatttctggtacatgttttacagtgcaaatgtgccagaacttctttagattatatgcctacgaatagaactgcaggatcatagagtatatatatcttcaatgtttattttgatgctaaattgttgttgaaagtggtcaatccaattcacaccccaccccacattccacatccactaacactgggctggtcagatttttttggagattaggtggctgtaaaagtgtattttggtatggaatcaacctgggtgttctacaacaggtgaatggataaagaaaattggtatgtatacacaatggaatattattcagccataaaaaaggatgaaaccctgttattcctggcaacatggatggaactggaggacattatgtaaagtgaaataagccaggcacagagagttaaaaaccatatgttcttactcatatgtagaagctaaaaaaagttgatctcataggagtaaaaagtagaacagagggtactagaggctgggatgggtagggaaaagggaggaatagggagagattaaaggctacaaaattacagctagttaggaggaataaattctagtgtcctataccactataggatgactatagttaacaataatatatagtttcaaatagctagagggaggatattgaacattctcaacacaaacaattgataaatgtttgaggtgatggataagctaattaccctgatctgatcactgtacattatgtgtatcgaaacatcagtatgtgcccccattaatatgtacaattgttattcgtcaattaaaaaattaaacaaaaacaaaccacattgcttaccaaaagccaagaaagtgtatcttgagatttttaattgctacttcaaaaaatgagattttcatgtttattagctaaccaggtccttcatatctttactagctgtgagaactcatatgaactgcttaacttttttgccattatcaaaattacttagtttacttttagatatcactttggccagttttgctggggagaggtcactattcccatagtgacctattccttcctatcatcccacttcccacattaggtaacatgatgactttgttaatgctgattctcctcctaatgctcattttaatgtagatcacatgcaatggtgaaagaggatcagggaagaggacacattgttcttttctcacttcttggtctttgctatgcttttccctctgctaagaacactctcccggcctaaactgtgagctctggaaggagaagaattgcgtactttgttcacaaatttagggctagattgagtcatatgtttcagtgcttctcaaactttcacgtgcatgcgaattatatggggatcatgttaaaatgcaaattctttttttttttttttgaggcagagtctcactctgtcgcccagactggagtgcagtggtgagatcttggctcactgcaacctccgcctcccgggttcaagctattctccttcctcagacttccaagtagctgagattacaggcacctgccaccatgcctggataatttttttttttttttgtatttttagtagagacgggctttcatcatgttggacaggctggtctcgaactcctgacctctggtgatccgcccgccacggcctcccaaagtgctgggataacaggcgtgagccactgcgcccagccaaaatgcagattcttattcagcaggtcaggagtggggccccagattctacatctgaaagttcccaggtgatgacagtgctgctagtccaaggaaaacaatcatgtggatacccattcactcatttattgaacagatgtttattgagtgcctgccatgtgccaggtattattctagacatagaagatataacagtggatggggcaggataataatttatcactctcagattgaaagcctgtaagtatttattcaatatttatatagttgaggtggatagcaacttatagtctactagctaaaattgtacagttgagccacatgatatgcacattcaacttttgtatttttatctgactttcatgctttccaatgcgtttttgttttgtagtttcttctttcttcatgagagtatgtgtttgtgtgtgtaccacttcttgggtgatagattatggggttaaacttagataaaatcactcttagtagataccactatgttgtacattatttagttttataattcaaggaggtaactgtgacgtgaagcttcaggcagccatcaaatgactggtctcatcattagttttactgcctgtagtggcaccatacaacttgggcatgtgattcaaaaaatgctgaacagagataggtcagtccaggcaaggagtgttttaaaatgtccacccaaagaaacagtctacctcaattatgtagaaacatgagttaaccagtaccttatttctgatttattccagtgatgttttactacttcttacagatgatggtctaatcaaatgtccagttggccagtgacacacaaagctatgtatttactaaatctcatttctttttcctcctctgggtgaaaaaaggactgcatttcccagccttctttgccatatattagctgtaagactggtttcaggccaatgatacacgggtcaaagtgatgtgagccaacctcaggccaggtgcttaaaaatgctgtgtgaccttgaccatttcccccaccattaagatcttggaggtcaaagggtgagatggcaggattgcaagatgagaggggctcagatgtggagacactggatggataaatttccctgagagtcacctgatgtgtctcaaatttagcataggtggaaagctttgtggtatgaagtcactgacatttggggtttgtttgttactatggcataagcaatctgcctaataggtgttctgactgtcaagctagggcctaccacattgtgttacacctaattgccacataaatattttcgagatgaatgaattagattaatttttactaaatctctttaccataagattctagtcctgacttcaactgaatgtactaaaaatttagtttataagttaaaagtaggtggagcataggaggaatttagtaaagatttgctgaatgaaagaagacaaaaatgagaaattttcaccctcagcttcctggaagggatttttaaattgttcatttttagaatgtaggtagtaggtaggtaggtagttaggcagacatgatcagggcaagacaggtcccccctccaggaatgtcaggcaagcatcaagtgatggtcagggggttgttaaactgtctctctaaagtaataactggttgcagccagtgccagggagagacagtcttccaatagaaaacacgtgggcccggcaccgtggttcacacctatagtcccaacattttgggaggccgaggtgggttgatcatttgaggtcaggagtctgagaccagcctggccaacatggcgaaacaccttctctactaaaaatacaaaaattagctaggtgtggtggtgtgcacttgtaatcccagctactcaggaggctgaggcaagagaatcgcttgaatccaagaggtggaggttgcagtgagtcgagattgtgccactgcactccagcctgggtgacagagtgagactccatctcaaaacaaaacaaaacaaaacaacctaaacccctacccccccaaaaaacacctgaagctgatgatcagcagcttccccataagatgtcaggagttgggtgagtgggctcatgcatgcatgctaagaggtaaaatggtgaagtttaattgctgtgtggtcttctttttttttttttttttttttgagacggagtctcgctctttcgcccaggccggactgcagtggcgttatctcggctcactgcaagctccgcctcccaggttcacgccattctcctgcctcagcctctcgagtagctgggactacaggcccccaccaccgcacctggctaattttttgcatttttagtagagatggggtttcaccgtgttagccaggatggtctcgatctcctgaccttgtgatccgcctgccttggcctcccaaagtgctgggattacaggcgtgagccactgtgcccggcctgtgtggttttcttccaggaacacttaactggcaagggaaaaatgcctcaagtgagcatgcctacagcttcagtaaacacactgcgcatgtggcccccctcccaagtgctggcggcccactgagcatgtgcacgacccaccccaagggaagaatcaaaggaggagaaaagaagacccagaaccatgccaatgtaataaaaccccaagtcaagagttgatcaaggcacctggatctctcaagttgcccacttggccctcttcgaagtttacttcctttcattcctgctctaaaagtttttcataaactttcactcctgctctaaaacttgcctcagtctctctctcttccttaaccctacatctgcccctcagctgaattctttccctccaaggaggcaaggatcaaatttgctacagagctgtatggattcaccactagtaacaagaacaaagtatcaaaattaaacatgcttattaggctgggcgccatggctcatgcctgttatcccagcactttgggaggccgaggtgggtggatcatctgaggtcaggagttcaagaccagcctggccaacatggtgaaaccccatctctactaaaaatacaaaattagccaggtgtggtggcatgcacctgtaatctcagctacttgggaggctgatgcaggagaatcacttgaacctaggaggcggaggttgcagtgaactgagatcacgccattgcacttcagcctgggcaaaaagagcaaaactccgtctcaaacaaacaaacaaacaaaaaactaattaaaaaagttttggaaaatgtttgagaaaaatagaaaaacatttttcctcctttaatactataatgtacattttttgtatttttaggcttcttgtttctgttagattattgtgattgcactctagatgttctggcctgctattttctatgttattacatagtcttcacaagcataatttgtaatggttgatgttataatacatctagggaataagttatttaatccttttctcttttgaacatttaggtcattaccaatttttcattttcacgtgtgctgctatgatagacctatttgtatagtaagattttctgtatttagaataattgtcttgaggtatatctgaaaaaaaaaaaagctttttagtaatccaaaaatctcaggctgaaaccaactccattcagattaggactttgcattggtttaagagtatgctttctaatccagtgctcaaccctgaattaggtcttcaaggtcagcttcatcatttgtgtgattctataaaacacatgtgctcaccatatacatgtacacttaaaaataggccaaatataaacatttaaaacatcagtttcccaaagcacagtatctaatataatgatgtaactgcctaatcatcatacacgtccccctgccaccaaacccttgagaattatgagacacacacacacacacatttggctaagatacagacgtacaagaaaagatctgtctggatccggaggttatcatggaacagttcagcaaaatgtggttgcaataagaaataaggacatttctatcctggttatctctccttttagagcaggaaaaaagaactaagtcacttgttgcccattcccagttcatgaaatcagtggcaaaacagaaatgactgtgttgcaccttgtctgatgtttcttggaagttacaataagctgccaataaagactcaacttgtggtcgtggtgtaattgaactatctctggtcgtgatgtgaaatccctgattttagatactcaccctctcactcatggcatgactttaggtaattaatttattttttctgagtcatgtatctttcatttgtaaaatgggatcattgtaacaaagggtgcctcacaatatggtggtgagaatttgatatgataatgggtaagaagatgctttataaactgtaatggtctgtacaagatatatttgctgtttctcatttactttttctatctcctccaaaaccagggctgctcttgattggttacgttaattcatagtgtgctttggaagatgttataccttcctcattccaacaagtcaccttgcagggctcagccgggaaagatgttgacctgaagcttcctctgcagagcgcccttcacctccttgttgcggaggctatagatgaagggattgagcatgggaattatgatggtgtagaagacggacactacttggccattggtattgttagtagatccatggggctgaacataggtgaaaaccacggtgccatagaaaatggcaatggccagaaagtgggaggcacaagtggagaggtccttctccctccctgctactgagcgcatcctcccaatggccaccaagaccaagcagtaggaggtgagaatgactgcagcaggcagaagggtgaccagagcagaaaagacatagaggaccactcttgctgtggctgtgttggcacaagccaggtggagaaggggtggtatgtcacagtagtagtgtgttagctggttgggcccacagaaaggcagggcaaagacatttccagtctggatagcggagttggctccaccaaatgcataggacacagctaccagctggagacaggtccccctggtcatgatagaaccataatggaggggttgacagatggctaggaagcggtcataggccatggaggccagcaggaagctctcagctgtcacatgcactacaaagaaggcgagctggaccacacagccctcaaaagagatggacttgtcagagaccaggaagttgaccaagagcttaggtgtgaccacagaagagtaacaaatatcaagaaacgagaggacattgaggaagaaatacattgggctttggagatgggagtctgtgaagatgagtgccatcattcccaagttgcccaccactgttatggcatagatgagcaggatggctccgaagagaagctcctggaggtctggataattggagaatccctgcaagatgaacttggtgactggggtgtggttgccactggcaagggctagttctccaggtgtcatctgcagaggttacagttggcaatcactcaaacagtattacttgagcacgtctacatctgtgcaaggtacaatgaggaagaatttcaatctgttttgtgttgctattaaggaatatctgaaactgggtaaatttataaagaaaagagatttatttggctcctggttctgcaggctgtgcaagcatggcatcagcatctgttctggtcaggaactcagcaggcttttactcatggtggaaggcgaagggggagcaggcatgacacatggtgagaaagggagcacaagagagggcaggaggtgccaggctcctttaaacagccagctattgcatgaactaacagagcaagaactcactcattaccatggagggggcagtaagacattcacaagggatcttcccccatgacccaaatacctcccaccaggccccacctccaacgctggggagatttggaggggaaaaacatctaaactatagcattcttcccctggccccccaaatctcatgttcctttccccttgcaaaacacaatcatgccttcccaatagtcccccaaagtcttaacttgtaccagcatcagctgaaaagtccaaagtccaaagtgtcatctgagactccaggccagttccttccacctatgagcctgtaaaataaaaaaccatgtaacttacttctaagacacattagtggtacaggcattgggtaaatatttcattccacaagggagaaactgttgaaaagaaaggggcaacaggcctcacacaagtccaaaacccagcaaggcagatattaaatcttaaagctccacaatcatccttgactccatgtcctgcatcctggtgaaaggggtggcctcccaaggccttgggaagctccacccctgtggctttgctgggtgtggcccacatggctgttctcatgggttaaagtggcttttccatgctgagtttgcaagctgctagtggctcatcctgggatctggagggcagtggctctgttcctgcagctccactgggcagtgccctggtggagactttgtatgggggctccaacaccatctttcccctcaacactgcccttgtaaaggctctctgtgggggcatttcccctgcatggggcatctgcctgggcacccaggcttttccatacatcctttgaaatctagatagaagcttccaagcctccttcactcttgcactctgcacacctgcaggcttaacaccacatggaaaccaccaaggcttacggcttgtgccctctagaatggtggcctgagctgaacctggggccctctgaaacacagctgtagctgtagccgtggcatctgggattaggggagcagtgtcctgaggctgagcagggcagcatggactggggccctgctcctgaaaccattccccccacccctccaggcctctgggcctgtggtagaagaggctgcctcaaagatttctgaaatggcttcaaagcctttttcccattgtcttggatattagcacctgcctcccttatactcatgcaaatctctctagcaagtggttgctccacagccctcttggcttctcctgaaaatgcttttttcttctctgccacatggccaggttgtgattttccaaatttttacactgcactaacattttagtaagtttcagtatgtcatcataggtgttagaagcagccattccacatcttgaatgctttgctacttagaaattttttctacctgatactctaagtcatcatcattttttttttttttttgagacagggtctcactctgttactcaggctggagtgcagtggcaccgatcatggctcactgcagcctcgacccccaaggctcaagagatcctcccacctcagcctcctaagttgttgggactacaggcatgtgccaccatgcctagctaatttttaaatttt

SEQ ID NO: 11934 - DNA, 266293 bp, Human
cgtgaaatctggagttaagtgttccaaggtgataacgcagctgtatcccatagagtcttcagaaacccttctagccatatggcttcttccagccatagctcccccttccttatgggatggctctcttaccagtgaccaggatggtggcaccagtgtctcagtgaacaagacatttccatatacagtatttgtttttaatttttaaattttatttattttaaagttccagggtacgtgtacaggatgtgcagtttgttaaacaggtaaatgtgtgccatggtggcttgctacacctagcaacccatcatctaggtattaagcccagcatgcattagctatttttcctgatgctctccctcacccaactccctgactggccccagtgtgggttgttcccctccctgtgtccatgtgctcccattgtttagctcctacttttaagttaagtgagaacatgcagtgtttggttttctgttcttgtgttagtttgctgaggatagtggcttccagctccatccatgtttctgcaaagaaatgatctcactcctttttatggctgtatagtattctatggtatatatatataccacattttctttatccagtctatcactgatgggcatttgagttgatttcatgtctttgctattgtgactagtactgcagtgaacatacatgtggatgtatttttataatagaatgatttttattcctttgagtatatacttagtaatgggattgctgggtcaaatgatatttctggttccaggtcttcatggaatcaccacattttcttccacaatgattgaagtaatttacattcccaccagcagtgtaaaagcattcctgtttctccgcagcctcgccagcatctgttgtttcttgactttttaataatcaccattctaactggtatgagaaggtgtctcattgtggttttgatgtgcatttctctagtgatcagtgatgttgagcttttttcataggtttgttggctgcatgaatgtcttcttttgagaagtgtctgttcatgtactttgcccactttttaatggggttggtttttttcttataaatgtgtttaagtatttttgtaaactctggatactagacctttgcagatagatagactgcaaaaattttctcccattctgtaggttgcctgttcactctgatgatagtttcttttgctgtgcagaagctctttagcttaattagatcccatttgtcaatttttgcttttgtggcaattgcttttgatgtattcgtcatgaaatctttacccgtgcctatgtcctgaatggtattgcctaggttttcttctagggttttttatagttttgggttttacatttaagtctttaatccatcctgagttaatttttgtgtaaggtgtaaggaagcggtccagtttcaattttctgcatatgtctagccagttctcccagcaccatttattaaatagggagtcctttccctgttgcttgtttttgttaggtttgtcaaagatcagatggttgtagatgtgcagtcttctttctgagttctctattctgtcccatttgtctctgtttctcataaacagtctttttaagggagttgtagttagttgtgctatggtaagattagactgctaacatttatatatgggtaagtcaagcttaataccccttctttattacctttgtcacagagtaggactttgcagatgcctctagagccaatatgtcacattatttcctgtgttttacattcttattgttgtccaatgtgcctaacctgagaatccaggtattctctgcatttctttcttgtggaccaagaagagataagcatacatttacgaacacccacacttaccggtcatagtgctacgtaccgtccagtctatcattgccttgaatactcctgaggtcctgtgaggttggatgtaaggggcatgcttaaagtcacagctggtctgtggtactagtgtagtccttgatttccaaagccagtctgctttacaccagtgattttccagtttctccaatcataagagtttctttggaggcacttgataaaacaatacatatttctggaccctagattttcacgataatagcttgggaatccacacatttagcaataccctctcgaggttcttaggatcatgcatgtttgagaaacaccactttctactttaacaggaccaacaattacagtggactgcagaggggtggaggattaggagacatggatgtgttttgagagacgccaaaataatttgacgctaatggtaactacactatccaatgaaaatatatggcccgtttatcacttttttcaaattagaatgaatttgaggttacctcatattacagtgtgcttcctcaagtgagagagaaaataagtggaatcgcttccactggatatagaagaaatttcctgtatccccctctgacttacagccagcagtaagcaactgttactgatggcagtgttaactggggtggagcttgcatatattatagtcctttacttccctatgaaaccttgtgaagtttcatcagaaccttctgtacaccgatcagagagtgttttgtgagcatgatccattttacattctgcagcagtaaaatgttggatgttcttgaaccgtctgaagttgccttcagttttcacctccgtgatcattagggctggtgacgtgagatgtatctgtgcttatctctaattacatttcagagcatgccaaaattgtataaaggcttaaaggaaagtttttctgggtctttgtgctttgttttgtatttgccgagattgaaatgtacagcgcatttccatttgttaggtctgacaatgcataactgatttgtggctttactttgcaactcacgagttacaagttaattagaaacacttttccctaattatatttgagagtttgctctatttgctctacaattatcacaaaaattacattaactagtgttaacgaacacaacatagcaatccccactggatcctggaggagaacaccaaattatataacgtctacatcccttgcccaacacctggtttcctttccaacagatgtttttgtttgtcattcctgatgaaacgtttgaaataaacttcctttttggttatccgttagaggatgaaactcagcctagaggaggagaagcttcagttttgcacatgcaaaactcttttcacttagcaactcgctcttccatcatgacggctgttgtcgttgccatcatggcagctgtgtacatcaactgtgtgccatccccagggaatgcccagaagaagaatctctgtgaagtggtttcctaaaataggagcctgtatcatgaggcctgtaatcccagagaagtcaggaaatgggactgcttagaaggtgaccttcttgtcttccttctttcttctccagttcacaatagatgcctgagcagcactacaaggttgctcagtcagggtagacaagagcatatggaaatgatgtagatgtgagctctgttctccaggagcagtccactgagttagggagagggagatagagaactgttctataagaaaagcatggagagagggccagaggagcttagaggaggaaagagaaacttcagttgaagagatcaaggaagactttatgaagaaagcaacatttgaaatgggttttaaagatgcatatgggtttggcgtgcaggtaatgggagcaggagaataaaacatgggccacgaaggttacaggggcaaactctctttgcatgcttctttaataagaatggattgagaactgagtcatccgtgtgcatgcaggggtgggcatgtgtgttcttgcacacctgctcagactaaggcacaagcactcctgcgcaaagcagcttccttctgcatatctgcttgccactctccttgcattgagtccgagtgctgcgggttcaaacagtctggtcttctccttccatccatatttgccttttaatctacaattcttctagaagttaagggcctttgggtggaaggaataatgaggaacgtgcttgataagtttctacataacttgattcacttcacacaaaaattgctagggacacacccagagtcagctgtgtcctcgttgatgagacaaaataattccacagactattaattcacaatagtgaacaaggattaatctactatgcaaatgacagtcggccaacttaaaagttaggacatattttcaggcaatttaaaaaccatggaaccttgagcataaaagcattcagtacttcaagtacagcagtctatagcaaacacagttagcacttaaaattatgatacatattagttaaaagagctgcttgccctacatagtatttggctttcatgcatgttggatttttttttgagaaaatggattttaattcataagtgcaattctgttttcaagtggcatacctgctctgttcacaaatttattttctgaggcttatctgtgcagttaattaaaagcaaacataaacatgcgctcttatctggtttccagatatacttaacagtgaaccacatttgcattcacaggtatcagtagaaaaaaggctactttcatttctcacattttatgtcaaatgattctttttagattagaaagaaccatcccccatcctttattcttaaaaattattcccctccatcgttagtgagaggcagtaatatgcatggaaatctaagactgcgagatactgatttcaaagcattcagaaacacttttattaaccaaaagaagtcttggacattaactttagcggtttttgttatgtttcagtctttgccttttaagtgagtttgcagttttgaagcagatgtttaattttatattggttctacgcatgcttgtggtaatgaaagaaaagagtttgagagaaagagaaagagggagggacagagagagacagcatgagcgagtgagaaagagagagagtacacaaaactaggccaggcgcggtggctcaagcctgtaatcccagcactttgggaggccgaggcaattggatcacttgaggtcaggggttcgagaccagcctggccaacatgataaaaccctgtctctactaaaaatacaaaaaattagccaggcacggtggcaggcacctgtattctcagctagtcaggaggctgaggcaggagaatcacttgaacccaggaggcggaggttgcagtgagctgagattgcaccactgcactctagcctgggcaacaggagcaaaacttggtctcaaaaaaaaaaaaaccaaaaaaaaaagaaactaaattgatttgctcttctttagcagtggggccttagctgctgggtatctgtacccgctagctggagagtgtcgatgccatcctctctacttttgaccttggggcattttctgatctgtgtaatcacttatgcacagccaatcacgtgcatcctttattaaggacacgtatgggtggaggggcatgttaatatgccttactttccatgcctttttcaggagacttcctaaggcttcgttaaattaacaggagatagaaatttgtatttaacatacagttgtagttatgagatgaacatggatcatttaggattttcaagcagtctatcaatttaataattttctgcaaaactgcccttgctattaacttagttattgaagtgtataaacacagatgtgaaatttttttgtcatgtataaacttcacattgagcatggctaggtatttataatttgaatctaatgaaaatgggattgaaaagaaggaaatgatcaggtgatctcagaagggcaactctcccaaaagcaaacactatgtctgattagataagccacatgcttagtgaatggaaaggaatatctctaaaatttgctgatccaaactccaaataccaggatcttactaaaattccctttacctccagggggctccctcaccatctctaggtagctttcctaaagctgcttgccattagggctgcagtgtaatgaaacacaatctgagttgctatggaaacagctatatctatgcaaattaccttttaaaaaatcattaggccacagaaagtctgtcagtcatatgaaatttgcaaggacaacagcccacagctacccttggcattgcttctccccattgactgttgccagtttcttttgctgtatctcttttatacaaagatagtattacccaatccttgggggacatggctagtagtaagagttgcgggtgggaagttgagggcgggaagttgagggcaatcacctgcaattaagagttttgaagccatcgtgggcagtggaaaagctacctagacatggatgggggaagagagaggttgaagttgaggcaaatttacttaaaaccaagtgtctcacatccatccctctcctccaaaaactaagtcactaactttacttgcacacacagacatatatatacaggtgtgcacactcttagatgtgcacacgaaggtgggtgcatgcaaacatacctgtgcaatgtaggcatacccacacagaccagcacatgcaggcatgaacatacatgcccgggtgtgtgcatgcacacactacacacgtacacaccacacacatataccacacacacactacacacacacccacacacacataccccacacacaccacacgcccactcacaccacacacacaccccatccacacacacacaccccatccacacacacaccacacacacactccatccacacacaccccacacataccacacacaccacacacaccccccacacacaccccacacacaccacacatacatcacacacgccacacacacccacacaccacacacatactacacacacaccacacacatactacacagataccacgcacccccccacacacacaccacacacatagcctccacacacaccacacatacacaccacacacatccatgcacacacgccacacataacacacacacacatccacacacacatgccacacatacacacacacaccacacgcattcaccacacacacaccacacagacacacacacagacacacacacacacacatacacacatccacacacacatgccacacataacacacacacacaccacacgcatacaccacacacacaccacacagacacacacacagacacacacacacacatacacacggagcctcctgggtttttggctatcacacagccctccctaccatcctgctctaccagacgcagttccacactggaagcactactatccccgacttctttgtgtatctgttctatacactgggcttggcagaagcttccacagtgcttttagagcttgcagttctctcagctggtcaccatggctccccggggcacagcctgtgtgctctgctggttgtcgccatctcacctgctgcttcccgggcaaagtggccccacatgtgtctaccctgagcccccaggagactgcagctatgaggtagtaggtaagccagagagaaagaatggctcactgccccttgcattacaatttgtactagaatccctgaagagcacttcttataccccaggcattacagaaagagcttttcccaccttagcctctttcccgggaattgagacttgcctctctgttgctgggctaagggcgagtcaaataatggctcccactccagtcattgggtccaccctccccgccactgcaccctgctcctggtacccgctggctggtttgcattcacatcagttccctcctaggagcttttcctgccccaccagtcagcctctgcccagcctgcctaacctgcccaaacacatcccagacctcaagtgcacagacttggttcttccccagaacctccgggcccacatactagtagactctgtcagctccacatcctcaggcaaccgggagtgctcagccctgtctgaactctgaagaggacagagacatcaactcagatgggagccagcatccctgctacatgggaactctttataggagttgccagttggcatcgttaggagtgatgtatttcagtttggttctctaaagagccagatcacattttcactgttttctacgaggtagcaggatctagagtgtgttgctcagctaagccctagggcaaatatggaaaagagatcagtgttacagaccctgtccccagcaggataagtgaggtccttcttcactctacatcctgccttgggggtcagggacatgaacagaggagcccatctgcttgcagggaccatgatgctgagactctacaatatgtgaggcacataagccttgcttgtgctttcagtgtgtgaaacttaaaagtgagttctcaaccaatcgctattatgtttctttctttaaatgctttaaatattaacctaggactctgcttccaaaataacatattacatttaaggccacatgacccttgtattagtctgttttcacactgctataaagaacttcctgagactgggtaatttataaaggaaagaagtttaattaactcacagttccacatggctgagtagtcctcaggaaacttacaatcgtagcggaaggccaaaaggaagcatagtggaggagagagagagagagcgatgcgggggaagtgccccactttaaaaccactggatctcatgagaattcactcactatcacaagaacagcatgggggaaaccaccccccatgatgcagtcacctcccaccaggtccctccctcaacacatggggcttacaattcgagatgagatttgggtggggacccagagcaaaccatatcaaccctgtttttattgctagttacagaattagtgctctagcctcagcgatccctcaatgaaggtcattgctgtgagttatttcttcaatgagcagagcctttagtttattatttccagcaaataaaatgtgtgtcattgttatccccatgttaggttgagaaggaaatattaaaaggttaatgtaataagcaccaaaccaaaagttcttccatgtttacgcagcatcattttggaatacaaatacctgctttctccaagccaattacatatttttttaaatattatataatatccagggttatctattctgagagtcatttaagcctttaataagagggttgaggtgtcaataggtcctcagccctcaaatttactaacttttagaagtggaggtcagaaaatgattttttaaaaccatatctcttataacaaatatatctcctatctcctttgtgaagataactaaaaatggagacattatagaatgtcagggttaggtacagataaatatgtatatttagtccaggcatagtggcttatgcctgtaatcccagcactttgggaggctgaggtgggtggatcatctgaggtcaggagttcgagataaatatgtatatttaaaggcatggttcatattttctgtgataaccttgttttaggaatatagtacagtgctctgttttatgtttttttgttttttgtttttgtttttgtttttttgtttttttgttttttgtgcttttttttgagatggagtctcgctctgtcacccaggctggagtgcagtggtgcaatttcggttcaccgcaacctccatctcctgggttcaagcgattctcctacctcagcctcccgagtagctgagactacagggcacctgccaccacgctggactaattgctctgctgtatctttaagaataaaggcccatgtgatttgccttgaaatgtgtccatccaagagactgtaggcaactgaaattgagaaaagttagtcaagctatgaaaaattatctgctcattgttgaacataccatcttcataattaagaaatagttgtaaaatatatgcactgtcatctcagtggggtaattttaaataagagttttctagctataagctattgtagttccacagtatcataaagatcagtaggacatatgtctttctaagagttaaatttcaatataaggcgaagaatgtattgtatatgtcttcctggtacactaaattgataatcatcattacattctttgccaacttaaaatgattcaatgttgtgagtgccctgagtctaattaattttaacaaaaccatttatataccataaatttccaattatatatatactttttaaagagtaaaattctgctaggctctactgatgtcttacatctcaaatttctcagacctccataaccagcatttgcctcattttgttagcatcatcttccattatgacgcattgttaatcatactcctcctaccaggactcatatcacagattttccattcaagttgtatcatctctgcctctctatcacctacattaacctataagctccttaagagtaggggaagtttcatagtcatgattgtttccatgatgttcaacccagcatatcataggagttcaataaatccctcttggactaatttggtggaaactatattccaattttccccacattgagctgcattcccaggcttcaagagtattcctcaactaataaccactgttgtgttctccttttaacctactgagaaaaaggcttaggtcagtagcagacttattggtattcactgatgctcatccatctttgatttcatagtaagacttgcttaatgtgtgagtcatcatgggtgacagtatgttaacacatctataaagaatacttgaacactattgcaggaatagaaatgggcattgagagatcccatttctatcctaaacaatataaaaccagcttgaatcctaagccaactttgtgtcttcttcaagtcttccttttctatttctttgccttcgccaacaccactgccagaatatcagtagctaccaggaaccaacaagtatcatcttatatacattcctctggtataaacaacttgctatagtatttaaattaattgatgcatgttttcttgcgatggaattgaggatactttttatctgatgatatgattttatcatcacaaatcataattcacctaaggaaataaatggcacttctatctaattattgccataaagaacaacttaatatcaaaatgacaaaggttgtttttgcaatatattattcagaatttagatggatgatataaatttccatctaacttgatccatgtagtttaatgagagcattttgtagatctaattatctgtgaacaagaccaaaaaaaagttcctcaaaatttcacttcctttaaatatttttttagtctccaggaggtgataggtaaaagcttctcttaataacttataatacatatattttatacatatattttgattaatttttctatattaaaaaattctggaatcacaaataaggagtgccttagagtcttgtataggccaataattttttagctgttttttgtcctttctttctgtctaagaacaatgggtgtcctgactatagacagtgttaggtatcaccatgttgtagatacatagtaagaaactgaaaaccaaatgccttgaattttataattgaatatcaattttcctatctagacacctagaaacaaaagcaccaggatttcccctgagggtaaaacacagaatgtctaaacctcactctcttcttggggccttaccatcaacttatatagtccctgctgagaacctgagtgcattggaaattgttgacgtgaaataagggatgtaatactcatgcatctttgcaggaatttataaactccatctgttcataacattcaatcacaagattatgtacctggacctcattagctcagctcccagaagagaggtcatattttaatgttattactcttactcttattaagagtttatgtaagaaacttatatgaaaaacaagtcagcaaatcctacaaacttggacttttagatgctgttatgtcatttgttgctaaatctgtggaggatgggacaaacagatggttgttgagtagggcagtgccatgaatccctcctgcagggtaggaacattaatctgagagcaatgacatgatagattggaataaatagccagttgagataaacagagggggtgagcacagtcaggttatggttggatttttagctagaaattatgaatcagtcatgacagtagagcccaattcagattttgctggatcttgagttcccattattgcaagttaggataaggaaaccagtcttcacagagtaaggtggtttggagaaagaggtagaagctactagatagttcaataggatctcactccatgaaggaattcatcttgttttcaactgtatcagtgcttacattctcaacctccaaacacagtaaaatggataaacttggtaaagtgaatgactagagctttgcatccttagactagcaacagagacaagagtttgccatggaaacagtgtgtgaatattaatgtccattgtcaacaatgaacatgtcggtggctacatgtttccaaagcctttttacaccttgtgtttataatcgtcaaagcttgctctcaccaagacagaagatgggggaatcatgtcagtgggaaacagcaaaaataaatgtcccctgaatttttaaatagaggattcactgtagaaaacaaatgaattaaatgataccatgaaaagagaaatacaggtgtcaatagactaagggtcacaaaaatgataagaagaaggaaaaataatgatattgggcatcagtactagttctgataacttctcagttctttagcgtctctacagctctgcaacttttagtagcttaacttatgtgttcattcccatgcatgacccaactgggaaataaaataacaaaagaaatgaattggcatttcaaaaaacaacatgcaaccagctactacactcataagaagaaggttaattaaaaggaatgcgcatgggaaggagatgccatgtctgctagtagatctccaaagatgagaatgattgctggcacccagggttgctgaggggcagcaacacacactattgggtgacagtgtcaagagggtgatctttctggagagcattttggcaatatacctcagtatttaaagtgtgtagactctacccagcgatccaagttttaggaattcatattgagagactattaagaagcatctttagagcagatgagttaatatatggaaagcatttcaaacactctagtacatagtaagagccaatgtcagcaaaaaaaaataaataaataaaaaaagaaagaaacaacttaaatgtccatcaatacacaatcagataaaaatggaccatcaaatagagcattaccaggcattaaaaattaagatgtggctagatgttgatatcaaaatatatccgtaacatgtgttgaatgcaaaagtcaagttaacgaacagcgtgcgtgctgggattctatttctgtaaagtgacatgtgagtatatgataagaatagagcgataaacaagagcttgtctcccaaatctcattatcgctgggtgattttattcttactttattctttatccctttttaataggctgaagattttaatattaccatgtgtattttataatcatagaaaataatactattatgttcttctagaaaacttgagaatatataccaaaaacatgcactttttctgaacctaagatttgataaagattaattataatataaaatggaatttattttataccatatatatccatacagagaaattactatgtaaaaaaaaatagaagcaatctaaaatttggtttgaaatacacaagcatagaaattccaaagttttggtatcacaactcaggaaagtcaccttccattctcaggaaacaatgtagctttatactaacctaagggttagttaatagataaatgcattacctgtgttcagcatattcaataatatcttgaaaagccagtttatcagttttgtaattttacctcaaggagtagtgctgaatgtcacatagcatttaaataagcaagattgtcactttttctaaattgttttctgaaaatcctattacactttacattccaatcataatagaggctgcaccgttctgcgtgctttgccacgctctgctgatgttgctcctgccttgactcaggaaattcctaaaataagtgatttttatcccctcttgtgacgtgctctgcgtataatcactgaatacgtgccataatgatcaactggctaacgcatttttatttgtcctcaatcaaccctctgatagtcctgaaacagatgcttttaaatgggaactgcggctcagtattttttacaaatatgcacaataaaagagaaacagtttcaaattacttgtgatatttaaaaaaaaaataagtcagcaactaacagaagaaggtttccactgacattcaagagtagcaaaccatcccaagattaacagtttgtgcaactacatttttttacactgctttttcttctttataccaaattaccttcaccaccagactcttcaatgcaagaccagccctgggctgctggttcttaatttgaaccctttatttctttacttctgtgacttcatccagtcccttggctttaaataccatttaaatgctgaaggctctacatttctacctttgtgcagcactcaactcatgcacccagctgcctcttgatagtgatgtctgattggaatctcaaacgttaacacatcccaaactggagcccacaacttcctgccaggcctctccctcctccagtgttcctcacctctgtgctcaaggccagaacgtctccatctccctgcacccccacatccagccgagctgccagccagccagtgttacgtctgaattacgtctcagacttgaccacgtccatctctgctggccatttctcccttagggttctgaagtggcctcctaccttgcctgcccacttcttttcaccacacttcagcctgttctctgctgcatgcctccagaatggtgtttaaaaaccaaccatccttttggggtgacagaaatgtttgggaagtaggtagaggtaatggctgcacatcgctgtgaatgcactaaacaaccctgaattgtgcatgttaaagctattaactgtatgttatgggaatttcatcttaagttttaataaaagatttttcaaagcctaaccttatagctccaattgggaatttatcttgtactttgttatttaatgctattgatccaccaagaaggaatgaaacattataaaacaaacacaaaaacccaattatgacagttacctgcttaatggtatccctcccactgcacttggtggataaaattgaaacttcttatagtggcctctgaggtcctttttagaaagtgccccctgcacatcagctctcatcaaggtttccacaggacatgaaaagaacactcagctgggattctctacagaatccaatgcagggactcttccgaggagtcgacagggttagtatactgatctagagggtggtcagcagcgggaagcagtggaagcaaacacagtctccagaacttgggaaaattgggagccgtgaagagaggctgctctagccacaaggcttcccagccctaggggcacagcagaggagtgggcataacattccccagctctctctcctcctgccctctgactgcctacttattcttccattagctgaaccctgtggttggctgcaagccagagggcacgggtacccgggaagttcggcatgtgggcaaagttgacattttttatgacaatgtgagtcctgactgtatacagtgccagacattacagtgttgtatatatggagctggtaggaagctgaaaattaaatgccttgaatttgatcattgaacatcagtttcgccatccagacactaaaaaacaaaagcacagtgatttcccttaggtccaaaacatacaatacctatgtcccactctcttcctggagtcctcacttccactgtatagtccttgctggaaacctagctgtgtgcacagggagtgaattcagtgtccatcataccttctccaacactctctctccatgcagaccttccttttatttccaaggaggacgttctctctgcctaattgatattatgagttttgtgacatcctgttcttggtagtgccaggaagctccacgctgcatcttctcttaacgtcaacctttgttatttcctccccattggcgctctccatccttaaccacataccacatgtgtttgctttcttgttttatcctctatcacccactgaagctccttgaggcttgagaccacttctttcattttcctatcattgtcttcccagctctgcagaggaactgaaccaaaattgctgaatgtttgtgagattgaattctttagtggtttgcttgccctaaggcttgaaacagttctggacccaaagaagattttgtcaactgaaaggatggataatgagacaaatgaacaaataaataaatgaatgaagttgttcagtcatgattaggctaaagtatgaagatctcacatatgaaactcagtagtcactttcccatagtcataacttagagttttttttcctgtttctcaggaggaagctgatgttggtgaagtcagttaaagtcaccaggactaagataaaataactcccagccccagtggtccctcactctggctactttttaaaaaaaattcttaggtagcaggacccaccccagatcactttccagattttccagaggtgaagctagtgcatcggtatctttcttaatgccccccaggtggatcacatgagaaatattatggcgcgaaagtaattgccatttttgtcattgtttttaattacttttgcaccgacctaatactattctagtgtaagaccacaattgtccgaatgtaagtataattttgttgttgaacttttttactcaattaatattttaggtggcatctactctacaattaggcccacggtctttaggattgttatccatcaccctttcttatctgtaagcctttgctcactttttcttgatacctgaatgttttctctcattctggctaattctgctcgttcttcaggggccagtgaagacctccctctcccatagaaccttccgtgatgccctcccatggtgacttttcactgtcagaattttcatgacacaccacctctgacagttgatggactttagcatctacaactctataaaatgtgttttatttttccctgggcaagtgtaatttggtctccccaagtggactcttactaatttactgcgtattccttagagtacctagcaatgtcttgtctcaacaggcattcacaaaatacctgctgaaaaaccaaaaggaagaagagaatatgtttggaggaaaatatgcagtaataaatgttcacattcagaattatagaaatgaaactcagaaatataaatttgagcatgatcagcagaaattaaagatgagtgttaatattattatccagtgatagcatattttccatgaaaaataatctcttattagaatgtctgtaagaaacaatataattggaagtgtgagagcctgtgtttataccccagctctctctctcattcattacctgtccatgggagatttctgtaaccactttagcctttggtttccttcacagatcagtacccctcttctaaggttgtggtcaggatttaattaaatagtgcatgtgacatggtaatgtctcaggaaatgagggctcatgatcatcagtgacattattatgatagagcaacagtatctgatatagtttggctctgtccccacccaaatctcttcttgaattgtagctcccagaatccccacatgtcatgggagggaccccatgggaggtaattgaatcgtgggagcaggtttttcccatactgttctcatgatagtgaataagtctcccaagagctgatggttttataaagggcagttcccctgcacgtgattctcttgcctgccaccatgttatacgaccctttgctcctccttcgtcttctcccatggttgtgaggcctcctcagccacgtggaattgtaagtccattaaatctctgtttctttataaattacccagtctcaggtatttcttcatagcagtatgaaaatggactaatacagtatcagacaattttgatgtaactgaaaaaaagatctagtcatgaaattagtgtggtgaatagatgaacaattgggttttttgattaccccaaatctcaatctgatgtttcttccatgcttcccacagaaggttgtagctgtgtgtgtgtgtatgtgtgtgtgtatgtgtgtgtatgtgtgttttagtagaggtcggcagaattaaatgcttgcaagaaaaattagttgtaaaagtagtttcaaagctgaaagttctttttaattaactatggttaatcattacacaacgtgtatatacttcaaaatatcatgttgtatgaagatacatacatacaattgtatctgtcagttaaaaacatataaaactgaatgttcttccttctgtgaactcaaatgccttctttaaatttctcaagctacattacctgggcgaaaagggaactggcaaaagatgaaaagcagaacattctcttgtgttcatatattctgcttgaaaggatagcacgccacatctcttccctccaattcaaatagcaaatttatgtgtctgacgtttgtctgattgttcatatgcatcacagtcagactcttatctgaccttcattttccccaaaagttgaatgactttgacaggtaactcaacttttctgtgtctcagtttcctcatctgtaaaatggacttggttgaaggtttacacaagttaatacatgcaggtgattaacaaaaatcctagtgcatgacaagaactcaaagatgttagatattttcggctacaatttgtgttgtgtttttttcaatgtggtcttgttttggacatgtagttcagtgatgctctgtgaaaaagctgttgctctttttactctgccaccatatcttcatcaaggttgctttgcttttctttgaaagccgtagaacccaagatgctctttaaagtggccccagtgcataacagggtctccaatccggggactcttggataagcaagcgtccacgaattcaattagcgcgcttatgttgacatcaacaggacctatgaggtagatgtgctacctatattataaaaaaagaaaccccaaggcaatagccgtctctatctttgtaagaggttatatatgcatgctcactcgagacccagagagtttggaatggcagctaggggccttgccaagatgtgtgctggctgtgtaacttctgggttatagtacttaatggaactgtaaacagctcaataccctttgttccatgcatagagataaggtgatgaatttatggataatggatcccctgaatattcaagaatttgccagactctattttttaccaaagatgacattagccatccacccattttcagtaatttatatggtttgtcagctgtcagctccccaaagactaccataaaaacccattgatcagcaaagctgggtttgttagacatactgcagtaagtatcctccctcactgcagtggatctaaaatgctcccttgaaagagtcttagtgtcaaaagggaaaatgaaggcagggtatttataaggctgtaggtccttggctgggagattttaaggtgggtattgcaaggtggggaaccatggggattgggcagagttttaactagtagcacagtgaggggagggtcttgaaatgggtcatgatgagcaaactattactcttgataagccagctctctagttcacagcctaaacattcacaggcgagtgtttcctagagcaagcacttaaattatttttgatcagtctcagcatggtctaacacagggataggaaaatgtatctgtcccagtatcgtttaacccagggccaaaaattatggtgatttcacctcctgcatttacttttttttaatcagatagtgggggtattttgtctttaaatctctctctctctctctttcactttctctctctcctcttcctcattatgctatttattgaaaagtcaaacttaagttactttatttaatgtatgtaattcagggcacaaaactaccaagaaacacaacaaagtataagaaatcattttacacatagaagaatatgacagctgtcagataaaagagtatagtctttaactgtcataacttttaggaaaaaagttccaggaccactttccagagattatacaactcagccttggtgctttggtgacattttttcaaagttcttgcacacccaaggtcattgaggaaggctatagttctaagcaagcctaattttgtattcctaactgttgatctcttggggcctgagaaatatgaaattctatggttcatttataaaatgctgtgatcaaagatgaacccatgacttttacagatggccactaccaaacactgacatacaaattattttcaattataattacttaaaaaaactactgtgtgaagagctttctacttcttgtagtagctgcattgccagttgcagataggcatccagtttgggacaggcatcattttccattaatagagcctgatctgttgtgcctttttggtaaacatctaatagaagaattctaaagaaactaggatatgtatactccattttagaatgaaaagagagatcatagatacatctgagttttgattttcatttttaaaaaaatcagtcaattatagtcttttgtctgtaatattaactgattttaaataaaattaattcaggctctgaaaacaaaagtgaaggttattttttaaactaatcaaaaatttaggtgagggtcaggcatagtggctcctgcctgtaatcccagcactttgggaggctgaggcggcaggatcacttgagtccaggaattctagacctggctgaacaacatagtaagaccttgtctctaccaaaaaaaaaaaaaaaaagtcaggtatggtagcacgtgcatgaagtcctagctactcaagtggcggaggtgggaggatcacttgggctcaggaggttgaggctacagtgagccatgtgagccatgatcacgccgctgcactctaacctgggcaacagagtgagactctgtctgaaaaaaaaaaaaaaaaagtgaatatgacttctggcttcttgccatctaaatgtttatcatcttgatctaaacttttaatgtttgctgctggtactgaaatttgaacatcagaatgttgctgggatcagttttggcttcgaacaagacagtaccttagtattgatggctgtatcttataacaaaattgttttagaatctgcagatttaaaacattgcatggagacccaggtaaatttagtcagtttaagccagaatttgccttgtatgcaacagcaaagatctgaattactttcaaatgtcaaggacaactcattcttcatccattctggggctaaataaattttgtatgtattttgaaaatgagcaagaataattctacctaattctcaatatttgtgcctaagtgattctgtttaaaaaattctgtatttggacctgaagcgttatgtggcaactgtagaatgagagtttacggtgttatggaccatggcactccaattctctctcttcacctcccacgcctatcagcctcagaggccctttcttcccattgccggctctctgagactcagcctagaatgatgattcagcctgttgaaattctaaaagaatcgacctttgtgtaatccccactgcaaaggcaacagcaggttcctcttctggaatattaaagaggaaaacgtagaggtcatttgttgtggccaaccaacccctgggactcctacaagaagccttggcctaaggagctgttattacagcaacatttggtaaactctatctaacatcgactcaagataaacgctttaattttttaaaagcattcagtgagtgtggtataggaatgttttccatctagaaggactctcaaaatgatctccattagcagccactccagagggttattgcttctcggggccatattgagagtttatatgcatccaaatactcgtttgtatagcagatgcacacacacaatagtataacaggacttcagggcgtcctgggcctctatattttaatcattcaacctccacacactagggactcaaagtgtgaatgggtgtgggtggaggaggtagtggtgacagcccctttatacccctccccctcccactcccaccatcaaccaagcctaactctggtttttttaaaaaatgaactttttttggccgggcgtggtggcgggcctgtaatcccagcactttgggaggccaaagcgggtggatcatgaggtcaggagatcgagaccatcctggctaagatggtgaaaccccgtctctactaaaaatacaaaaaatttagccgggcgtggtggtgcacgcctgtagtcccagctacttgggaggctggggcaggagaatgacgtgaatccaggaggcagagcttgcagtgagccgagatcacaccactgcactccagcctgggtgacagagcaagactccatctcaaaaaaaaaaaaaaaaagaacttttttgtccccattcttctcctttttcctccccctccccccaggtacacaaactgtcactcccaaaagaaatgacaaatttgtttaaaataaatcctcataaatacactaagtagatgccttaattcactaattaattgtaaatacatttttataaacatttatttaaaatgaatgaagcccagctttcctttgggcttggtttgagcctcacccacatgagaggattcatgctacgtctaaagagctgaaagcaagccagtgggctgtcgtaaagtcctgcatagccaccaggcagtgtttgattctaccatcatttaaaacttgcttttattaaaacattctttttgttcatctggggtttttttaaccaagatagtcttcatctctttcagtaaaaagaaactacaattaccctgtattaaagcattataaagaagcaaatgaaagtaattaaggttttattaaggaatttttattaaaccaatcattgctcatgaatatggataatatcaaggaaaagagccattctgtgcctgaaataaaaataaactatatttttaaatatctttagtatacgtaaatgtcttcgcaattaaactttcaaaattatatttggaacagcaataattttacactgataaaggaaagctattggatggaaataataaaagaaagatgctaataaaacaaatttgtcacagattataatctggaaggaattagcatattttcatcagggaaatttaaattttctagtgaccatcaaccaaaatattaaaccatttttcatgttatcctcagatataaacaaacagggtaatttgttatgaatgctgaaaattggtgtgaatcccatcagttttatagtttttcctcagattgaaattttagtattacctgggctaatttagaattatcagggagttaatataagaaaattacccaaatgaagcaccagagataagccttttaatacaaagcagattaatatgtttcagtgctataaatttttctctactagctaaaaatggaatttctgtagattcaaagtaaataatcccacttaaataacatttttctattcttgtttggatttattatttgtgaaattacatcttgcagctgctgttttattttctctaggcatgacgtcattttgctaacgctataatacttacagaagtttcgatgcttacagcacatggcatcctataagatcataccatccagctgttattttttatttttctttagtgcttgtttggttcatgtttgtcagggcatattctgtatgccagggattctgtagctctgtgttctgcatacgatgggcattcagacaagtgtctgctttcattttatgcctgggaccctgttggaggatggaacagtgatcaaatgacagaatgagttagtgttgaggtttctgctgaaattaaataggagatctgacagcaagcatctgggaaggtagactagactgatccaggaaagcctctctgagtttagcacatttaagttgacgtgaatggaagaagtattggccatgaaaagatctaggaaacaatgttccagaatgaggcagcagcaagtccagggatctgcgacacaaaggagcttgtgtgttcaagaagaaacaggccattttggctggagcacagtgactagagctatatggtacctggcccaccagcacagggattttttgttttcttcactgatgtctccactccacgtcaaacagaaccatgcatgtactaggtccttaatattatggaatggataaatgaatgaatgaatgtgatcaagatgaatttagagatttagagaaaggcctgatcatgaggctaccataggaagtttaattttattttaagcataacaggttatttttgaagggatacgtagtagactgaataatgtccctaccctgcaaaaaaagcccaccccctaatttccagagcctgtaaatgttacttttcatgatgaaagggactttgcaggtatgactaaggtaggagggcttcaaatggggagattatcctggattatccaggtgggctcaatgtgatcagagtgcccttatgagagggaggtaggagggtcagagtccaggaaggagatatgatgatggaagccaaaatcagagggatgtaagatctcaagccaaggaatgcgatgcaggcagcccccaggaggttgacaagatgaggaaacacatcttccccgggatcctctggaaggagccagccttgccagcccatttcagactccagccctccaaacacaaacctataaatttgtgtttttcaagcccctgtgtggtgatttgttaaggcagcagttggaaataagagcaggattattccaaattaaagaaagtgttgggtcacttattgaattgcaaacgtgaagaatgatacatatttttaaattaaatacttgtcacttaaaatgcattttaaatttagttacaaagtgtagctggatcatccttgctatatcttgtatactctcacattggaatttggaaggaataagggaacaagtggatttaggtaagagaggagtaagaattaaagtgtcctgggaaggcgagagggaaaaatgagtccatccattgtagaaaggcaaagggataggaaagtgaagcagagagaagaaagcaacagagagagtgggagcttcataggaaaggaaaggtatattgtctattgctgcataacaaattactccacaatttagcagcttaaaacaaccaacatttatgtcacccactgtctaagtgtgagggagtacaagtaggagccacagatttgggtggtcctggctcagggtctgtcatgaggctgcagtcattcgaaggcttggttggggttggaaaatccacttccaaaatttcggctgaaagccctagttcgttgccatgctggtctctctataaggctgcctgaggatcctcatgatggcatgacaattggcttcccctcaaataacaatctgagagagggtttggagggagccacaaagcctttttaatgacatagtctcaagtcacagtcacttccaccatgtttcattggtcacaaatgagtcactaaatcaaatccccactcatggagagaagaattaggctccaccatttgaaggaaatgtccaagaatttgtggacatattttaaaccactatggaaaaggggagggaggagtgaagtaaaagtttgaggaaaaaatttattttccatttgttcagaggatgcctagatacgtccagttctctccactaatctctcttccgtcagtcaagacatgtgtgtgtgtgtgtctgtatgtgtgtgtgtgtgtgtgtgtgtgtgtgtagcaggaaagatgtggaattcccagttgtttcccacttgaactcctgccagatgatataaatcttcatctcagttgtctccagaaactgctgcttctatgcttaaacctgtctcatgtccaggtaatctaaccaaaactcaaaattttgacgaccccatgcagctggtttgctgaattccccctcaagaaaatctgccgcgttccatccactttaccaagacttcatcaagaggtgataaagttgcttgatagagattcattgcagttgtaataagtccaggaagcattgtgcattgcagttataaattgagatagatggttcagagatatggatcaagtactgtgatcagttcactggaatgtgactcgcagatggagacagcctggaagggtggaatgaatgtgagcttctgtttgttcgtgattctgaattaggttacactaattaactaattaaggaaaagtgaaggagatagaacagcctataaaaagatattccagactgcatctgcctttccattctttcacttcttgtcaggtactagatttggcctttaggttttctttgatttccttcctccctttccctatttcttttctgtttgtaagaaaacagtaaaaatagctgtattctcatagaaagccttgagattttcatactcactgcatgtaaaaaaatgcaaaggtttctctctgctattttgtttgtttgtttgcttgcttgctttcccgagatggaaccttgctctgtcacccaggctggagtacagtggcacgatctcagctcactgcaacccccccccactcccaggttcaagcaattctcctgccccagactcccaagtagctgggattataagcacacgccaccacacccagctactttttgtatttttagtagagatggggttttgccatgttgcccaggctggtctcgagctcctgacctcgtgatccacctgcctcagcctcccaaagtgctgatattacaggtgtgagccattgcaccctgcctgctatttagtttttaaaggatatataccatacagcaaaatatgtcacccatattttaaaacatttataagcctcaatttttagatattggtattttgagtctggatttgggaatgaaaaaaatgcacattttgttcctatattttcgcattgtatactttgaagagcagacacaaatgtcttaacatggtattcctgaaagttatcctcaaatactggggtagatactaatttctttttaatatactatttaaaactgcaaaatcaattattttactctaaaaattaacatttttgtgaggctggaaatgaatgaagtcattttgattatttagattaccaaactttggcaaaacatttctcaatggatgaataagcagctttgtgttttatttaaaacaagatagatgcatatgttaatattcctagtatttcaaatcagtccaaatcagaatatattctgagcaccttctgtgtaccattgagcactttttgtgtactcaatttaggatactaatggcaatacaagcacaaatgaaagtgtatataaaatggtcaaattcactaaagcacagttggacaaaatttttctgtaaggggacagtttgtaaattgtttatggtttgtgggctgtacagtctctgtcactaatacccagctattccttcataggacaaaagcagatgtaaaaaatttagaaatgaaccgacatggctgtgcttcaataaaactttattcataaaagaagagaagctagatttgccttcaggttaaccccctgtactgaaggattattttatgcatgctgggcactaaaaacattttgtttcctttgcattcacttcaataaaatttccagtaaatggtatttctaaagacagttgagtttgcctctgtagtcacatttttattgaactttatagttgctttatttttatagtcacttatttagttattaacagtcagatttgtattattaatgtccttggatagttcaacatgtgcaacgcaaggaaccaataaaacaaattttggaaataaacatgttctgtttgttctattcataacacagtagatggaacaaaatcgcatttcgttaaaatatatcgaaagctcattaaaaacataagctacaagttctatttccaaagacaactatagtgttttatttccaatatctgcagtgatggtacgtgtttaggttcagggtgtatacaggctttctttcaaagaaaaatagaatgttattctctgttcctttttttctttatgtagactgtcctaacaaaaaaagaataattatttaaaagcattttcaaatgatgttataatatatatgcaatgtttatgaccttttctagaacatctccttttaaaaaatatttaaaagcctaaagcattctatttgtcgttaacattttgcattgctctgcctgcatgaattactgtgacgctctgtccattgtggacatgccctcttcttctcacctctccctttgtcattatttaaggaggaacattctgtaggtcctccatgagcattgctttcagagaaaagctgacaaaacagtcacaaggggcaacagtttaaattgcttgttgagccagttgtcatctgacctgatgctggattctcataagggtcctacccatggtagctggttgtttatgaaagcacttagctttcatggcaaccacatgtgcacactgaggtcttgggtaagacaaagatgctctactagtccatttcaaataactttcacatctctttggtcttggttagaatttagcaatttgggtccattgtattaaaatggaacagaagcgttgttggtagcctcagttcaatcagacctcgcaaccttgattatgctccctgaggaaataaagataatcatgtcacagttcctctgctcactcatcagatttttcacagaatgcttttaatgggttcacacgaatgttctaaaattaaggacacactctaggatgtgtgtccacagtattttcatccttcctgccagttccgttaactcaaataaggaagacagttttggagatgagaaaaacttgtggccacccaaaacctctttttgtgtgtctcttgcaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggtcagtcctgtgtcacgagtgcctcctcccaccatcttcccctggccagacactgtctctttccataactttagtggctcttttactgaggatcagaccattctgaaaacatgaatgttgatgtggcaacggagtataagaagttaattttaaattttctaaccaggtaataaagacatataggtatctttctctacctaattaatgttagacttacttcacatgatttcttaggtctaaggtgaaaaacaaacatttttattccaacccaaaataagtcattttctttggccgaaaacaatagttcttggtaatttcacattatatcatgcatatagcacaaccaggcaggctgactggttgggcagagttcataacagatacatagggatctggttaactgtcacaagtagccattttttaaaaattctcattttaaaaattctctgtttgactgtaagattctataattcttagaaatagctctttaataaggcctgttgtattaaatggttttttaaataatgaaagtagcaaatgtcttgtgattctctcctgatgcgtttttcacaaaaatcatcaggaatctattgagatttcttagaatcaactttatgtcttgtttaatttttgctcttaggaaggaaagtagttaccaagatatgattcttctaaactctagaaactgtgctcccaaaagtgttgtattttgtaccaaagttgcaaatctctgctggatgaaattgctgggataggggcaaaaggggtgattgaaaacacctagccaaataatctatattttgaaagtgaaacatacaggattgttttagttgaaatggttcaaagctgccatttctcctacagttgatcagtttctaggtataacaaccagtctctactgagaaggaacaaaatccacctcagtggcattaataatcgtcatctcatgagtattcatcccaatgctctcagcctccagtcttgagaggcggtatgtgtttgtgtgaaatgtgtgtgcacagagcaagataagagcctgcctccacgaatatctacatgcgttcatgggcaggaatgggaatcctctgacaattctgcttttcgtctgagtcacgaaatcatgaacatctgacgtgatttctctggataggtgctaccatatggcaaatatacagtactctgaaaccccctactgaggcatccatttcataaccccttaaattctgttatccttgggcaaacatctgtcccaccagaagaaatataactcctccaaagctaaaattgtaggctcttctgaactcccatgcctgatttttttctatttcacttattcacaactatttaaaagtgtttttcccttgctagcattccctactttcacagtgtcagggtccctagtgaagactgcagaaggaactgtctcagaagcaattgtagaagtgtaatcaataaggacctggctagctctgtctgttaaaatgctctctgattaatatagtagcataagtatgtcttcgtggtgtttgaaaggatataggctaccacctttattaaagtacatttgacatcctttgatgaaaaagtagatgaagaagctagaccagtgtaggctcacgggtcccctttacacatcatctggctaagtttagggtctgggttgtgttgctggagcacagtttggtgagaccagaatgactccccatccctgtctattcacacatacagcagctcgacacttgctgctgcttctgctgctggccaggagtgaccacataataggaagcaaaaaatgatgccatttgattcagtttgtcatgcagacatctgtgacaccagaacagtcacagtcgtccatatcatgacagaaggctttagattttagtatgcaagtgtatttacattcttcatttttccaacaaagccaagatcactattcacattaaagaaatgacttcctgtgctgcttctgctatgcagcagttttatcccaggagcatttgctgaccacctgctttgtgttggggagggctaaggaggctgagagagggcagactctgccctgcagaaactcatgactgagtggaagaaatggcactcagccggtgagccccagcacaacagcctagtggcaatttagtgttatgatcatggcagtacaggaggaaaaactggtgagaaagtgactgacagctaggtgtggccaaaaaaggcttgaagagtcaggtgagattgggctaaacatagaaatgatgcaatgggaaagcatcatggagggcagcagaggccagcactcgctacccagcgttgaaaggactctagaggagtttgagatgcaccatcaatagagattagatttttaaataaaattaaagtaagtgttattattcataaaatctctgtcttccaggggcctgaaagttccacttcagatatgttgttgattctcacatgcatcgtagcccaatgagctcatgtgtagttaagtcgtgaagccaggacttgagccacatcctgactctggtttcagaccatccccaccctatcacacagagaggaaattcaaagttatgggataggagactgctaacagatctgtgcttaaaacaatacacaaccaccacctgctgacggggcaacactttcctctctgttggttccttaaatttgcttccagagataaacggagtggcatccatgtggccaacatcatttggcttttaaatgccagtggtcttctccctctcccttctttcttacttcaaattcttccctgctaggacctacggagtgtgtagctacctgggacagcattagccactcagccaagtgcaagtctcttgacctccacctttgatgttcatgtagacaactagaactgtgggtgcctttttgtgttttaaaataagactatattttaaggcatattttagataataatgttgacattgtttttccagtactcctttcttcttttgccaatgactttaagatgagttgatatttttggtttgcttctgtagctattgtttcaggaatatataaagaaaataaaacatccaagaaaataaaactcttttcctagaatactatttcctaaactagtatagcttggaaatccagcagaaggagcatgtggtaggtaaaagtaaattcatctggtcattattgaaaatcattactcttgatttttcttcctagcaggattcagacttgtttatgtgatttcagggtggggagccaaggttaagaatttaaggaattagtgtttttaaagaggtcaccttttcattttttggaaaaaaataatctatgaatgcaaattatattgctcttaaatgtccaaaagcttattagagataaatttaagtcagtaaaatctgcctaaggcttagccagaacctgacaatgtgacactattctgtctttagacaatttcatgcaggcttaataggctctgtccagtttctcaagctttcctctaggcagtggatattgtaccaatatcagtggctgtccccacttcatgccctaacgccaccccattccctaccacctccaggtcgtagactactgaaggaggcacatttacagggagcattctaaagagaggagacacttgctttgccttctctagaaaggaatggagaatcttcatgggaagctatatcatgttgacatagcaaaaatttaagcacatatgaaatgtaaaatgaaaagttaatgcccttagtcctttttcgtttgaaattcatttggggacaagaaattgaatttttaaaaagcagatctatctttgtgttcctggagtatctgtctgtcactgaggaaaaaggatagaagtggggaaaaaaaagccttaaattttgttggaggcctgagttgataaggatgatggcagctagattgtgagaggccaagcggcatggggaggtggggttgcgggggttagagctgtgggtgatcagaagggaagggcttcatttctacgctctgcctccgctacctcttccccaccacccctaatcccaggcacactaatgctcccttcttcatttcttcccctttgctagttgttccttttgctccaattctgccagattcaagcatccatttttaacaaaaaacattttaaaatatggccccaaacaaatgtggcaaaatgttggagaggcttaggatgtaagaataaatgaggttattttgttagtcttctctgttttgttttatgatgaaggagtcctccagggaaatgaatttcatatagagtgaggttcagaccttgaaatcaattcagttttgcactcattgttgtttccttgcacatcgtgtgatcaaatccatctcttaacctgtggccgctataatcatcaccttcaaccaaaaacatgtgttgagggaccatggtctgaacgctaaccagggaacattgagctggctccgctctctctggacaagctcatgttggctgaagtcactgcggtgtgttgaataaatcttcccccaaaattcttgtctacccagaacttcagaatgtgatcttatttggaaataaggtctttgcagatacaattagttcatgaagatcaggtcatactaggtaagagtgggccctaaatccaatgaatggcatcttataaaaagaggacatatgcacagagagacacacagggaagaaggccttgtgaagacaaaggcagagattggagtgttgcagccacaattcagggataactaagaattgctgcaacaccagcagctaggaagaggcagggaaggaattttcccaagagccttcagagagagcacggccctgctggcaccttgattttagatttctggcgtccagaacgtgagataataagtttcggttgttttaagccacccagtttgtggtactcggttctgacagccctgggaatctattatggtcactccagtaagaaaataagagaggggctgctaagctaggaagccaaggagccgcctgaggatgcagcactgagaagaggaggagatagacaactcagagatgctgcctgtccccaaacagtgcccacacactcaacaaacaacccagatcaaaggtgtttttctgtttttctctgtgcacaaggccattcccctctgtagcttagctacaaaaccaaacactacctgtagcaggattgagttctacaagtcaagatgtggctgtctcggccaaagaaggttcatatccaacctcttgactggatggccatgaaatgagggtctccccacacacggatctgatttctgtgtgttctgctcttatttatgagccaacctttccttttcctcccgacattgaactagcttctgaacattgcatggatttttctgacactatggacagccagaagtcatttgaggttcttacgcaggggatgtgacaccatatcagtgtcatttaaggatgtcgactctagcagctgtgtacagacctgatgctttgtggattttctgtgaaacatgactgcatttcccatttaaaatatcaccgatgcatatcctaaagatcccgctgtggctgttatcatcatttcagggtgaactatgggtagaagcttgcagagcatacttttttaccttttaatctagcagctagctcaataaaacaactgtgatctgcactcctgtatagtcgcattatatttagtcatggatacttaggactttatctccagctgaagtatgtgcataaggctggctggctaacttccacagctcatttcccggtgccgctgagtcgtttatttatttttattattctattcccacttcagtatcttgtcctaaaggacaacaatatacaaccctaattttttccatctatctttgtgtacataagaatgttattaagcccgtcaaagtatctgcactgtgcctttgcttacgattgtaattaaactcagaccctcaattagtcattttaacccataaaatggatgagtgcttggtcccacggtgcctctaattctagagtgaccttgagaaacgccccttcacaaagtaatgttaatgataatcacactctggctacaaagctccaaggacgtttattttctgtggcttactcttgcattagccacaggtaagaagaggaattattattatttttatgttaagttcagttgtctgccaatattattcatctgttaaaaagaatctttttgagaaagtgtttttaaagtgttgtatcatgagccccaaactagctcatcccagtcttggccagagatgaggggcatgtgtcagctgaattcagcaccctttttttttattcttttgagatggagtcttgctctgttgcccaggctagagtgcagtggcatgatctcggctcactgcaacctctgcctcctgggttcaagcgattctcctgcctcagcctcccgagtgcctgggactacatacataccaccacacccagctaatttttgtatttttagtagagatggggtttcaccgtgttggccaggctagtcctgaactcctgacctcaagtgatcctcccgcctcaacctcccaaagtgctgggattacaggaatgagccaatgcacccagcctgaattcagcactcttaatccaggttcttgaaaatgagaaggactctgtgtggacatgggaacagatgagacacaccactcaccccactccaccccattttcccacacctggtcctagagcagaggaagctcctggccgggcagcttagtcctgatcagtgtgtctagtaaagatgtgaagtgattttattgagtcagttctcagcagtgacagtcctcttcgatgggaggggacagagttcagtggagtgaggaggagtaaggtgatcttaggagctcctcagaaaagacagttggctgcccatctcagcagctccaccagtgacgagggctcgggtctcctgtggtgcaaccccaacatttccagatcacttcctcccacccagtcagaaggaggtgtgctttatacagtcatgcatggcataacaacaggaacgtgttctgagaaatgcatcttgagtccatttcattcttatggaaacgccgtaaacaccatagggcgcacttacacaaacctagacgttatagcttatgacacagcctaggctgtatgatatgtctattgctcctaggttacaggcctgtatagcacaacactgtcctgaatactgcagacagttgtaacacaaatggtaagtatgtgtctatctaaacgtatccatacatagaaaaggtaatactttgcacttagtggcaaatagaagaatccttggagtttgcagttgaaattactgcataatatcattaagataagacagcctgatgcatttaggtcatcattatatgccccagactggacaagctgggatatgttttccctaattaatgcctcagaagacaatattccttttttcagtatctccgtggctgatccacctctctcttactaacacattctttctttacgtataaaagctttttacttgaagctggcttaaagtttctatcttgtagcccttgagctttgtatctgttaggaattttgtatgtgccctgtcttttccattaggaaaagttcgaaaaagcttcatttttcatttctttcagatggcctttcttccccaaaaggagtatcattgtccaaagttcttcctggcatttttgttccctgaaatagtattggggataatttcttcccaaacactattttgttttcctaagctagaaaaagtgagagtataatgatttctccttgaatataaatgattaatataaaatcccccatcatgctattcccttttaaagttttcatcacttatttctgcaaactttgatctacttaattatgaaaatttgcacactccaactgagatttgttttaaattatgtatcctgtaatttggttgcaaatatgggcttcttttaaaaggacaagcaaatatttaatttatcttttcagcgtgaatgaatagtcattattcctatgaagacatgaatatttggatttttccattaatatgaacaaattactcactttaaaagaaattcaatgaaaaagtttagtgaattatcaattggtttaaaatgatgtttaatagatatttctataaaacattagtacagggtattagctccctgataaataaaaagctggttcattctttaaatccttcataacttcttgacattaaaaatgtaatttttcttcctgctgcctcccaaattacattacattgcataagaagtaacttccctggaggagaagcaaacaaatctattaaccataaattgaagaagaaagagcacaccaaacgctttcatgtactgcttacgtacccagcctctccagcactgtaacacatcgattttcatgctgtttattctttcccatttcaaagtggcattatttgaaaataaataaaactgacatttaccaaagttgggccaaacaacccgtgagttagtacagctcacagaacaagcagagtccacgtggggccatgcccctgttgatgaaccttaagtgaagatctccagcttgtagatgtgatcctgttggaggaaggaaaacatcagcaatgagaggcatgaaaggcactcagaaggcagcagttcaggctggacgcggtggctcacgcctgtcatctcagcactttgagaggccaaggcgggtggatcacctgaggtcaggagttccagaccagcctgaccaacatggtgaaaccccatctctactaaaaataaaaaattagccgggtgagctggcgggcacctgtaatcccagctactcaggagtctgaggcaggagaattgcttgaacccagaggcagaggttgcagtgagccgagatcatgctactgcactccagcctgggcgacaagagcaaaactccccgtcaaaaaaaaaaaaaaaaaaaaaaaaaaagaaggcagcagttcagaggcctcaccacctgccaccacctgatgtcagcatgcagagctggatgctatctgtgctgcactgcgcttctccacattctgctggccccacatcctctttttcttgagtctggttggtccttaattaaccaagaatatttgaaatcaaatttagtttccctctaattgaccaagactatttcaagtaagtgagtagaaaagtctccatgtgccattctatgctctctggccccctttcctaggataacgactttgtcccgtcactgtgcgggccagtagagaagtccaccggatttactcagggatgtttgacaatcactgcaggagtaggcgggggcggtggaggctcagcgggaggtctggttccctgggttcttttccattgccctgtgcagctgtgctatggaagagtgagaggtggggtctctgaacactgactcaacagtagtgtgggggtctcataggaagcagaggtgcctttggggtgagcagagagaattagcacttgccttcctgcacagccccgtggggcccctgtctgcctctctgggatgggatcttcattgtgtcacagaaagccaattgcttattctggaaacagaattgagaagcaattgaaagtaaaagtcattactccttaagtcttgtaagttcttgttctaaactgacagaagcttctagaagtacccactacaaaattttctaaagcagggaaaagctaaagggaagacagccctgtccaggtttcatgcttggtcagcatgttcttgcctccaacaggtttaaccgaagaagcaatatttagtaataatatgtgtgaatgggctgatagccttccacactggctttttaggaccctgggctcttcctctgtgtcatacactcattttcagtttttcagtctgctacataaaaggacagaccgccaggacttcagattagtcctgcgtccttcactgtctttccgtagaggtacaaatacatcatcgctccccattaacaagcagtaaactggcaaggaagatgttgtaccagtgatgcactgactggagctaatgaatcccaacagctaattacacttctcttatggtaacttattaccagaaagtagctgcgttagcacaaagattgtatgtgaggatggccgtgcccagggagaggccagctgatgaatcatcccccataattttccataatagtcctgtctggacttccgtgtccagaccattgttcttcccggggttacatgttgcctgcccttattttggaacaacaatgtaattgccaattgtggactaatttatataaacacatgagggttctgccaaaggaaagcgtcaccgtgatgggtgctgactgctcacggagctattttgcacaagttagagtcaggtggttggaggaaatgaagcttactgcaaaaaataatggtttcaggtaagcaaaagcatcgtgtccttttgaggcctgccaggaggcgtggtgtgtggcctgtcgcattgctcagaacctgatggggcttgaagggcagcgtttctccttaatgtgcacggaagcagcgctgagtttcttcctagaacacaaaggaactttactgatttctcctctgcaggcagcactggctaccacacatgattaaatgtcatttgtccttgacccctgtcactcctaagcagctgaaatagattaagagtcagatgaagcagagcatcctctgccagctcctgcggtaacaggctcacaaagaaaccaatgccagggcttcttaggatttcccagggagcattcctgtttgaggggaaatcattgaggcagaatagcctcctgtttcctcccaagcacccagccgggatccccagagctaacacagaggccttgggaaggtagagctgcctgtctgagcagcttcccactcccacggggacagaaggggacagcagcccagaaagacagcaccaaagcaccatgaggcagggacgctgctggagaaagggctcccctcacttctcacctcactggacctggaagctccctccactgtctttaaaacttactgagctatgaagactttaattcaggtgaagacaaaggccaaggagtgccatagaccaccaagcccagatgcacctgcctgcaggcagatcgaactagcagcagaaacgagcccttccacccggcaacaccttctgttatgaccagattatgaccctccacctcccaggcatttcctcccctatcctttctatccctttcattcaaactaattcagaataaatttacataacatcaaattagccatttaaaagtgaacaactcggcagcatttggtacgttcaaagtgtgttgaaaatgacatctacctagttccaaaatattttcatcaccctaaaagaaaaccccatattcattaagcagttactcccattctgccttgcccaggccctggcaattaccagtctgtgctctttctctatgaatctatctcttctgcatatttcatataaataggatcctacaatagatgacttttatgactggcttccttcacttagcatgatgtgttcaaggttcatcattgttgtagcatgttttagaacttcagtcctttatgtggctgaataatattcccctgcatggatatagcacattttgtgtatccacttatccattgatggacatgtgagctgtgttcactcttcggctattgtatttgtttacatacccatttcaattattttgggtatatacctagaagcagaattgatggattgtatggtaactctgtatcactttttgaaaaccgccaactgcttttcacagctcttccttttttttctgtatgttcacctccattacattatctgggcctattcttctctttttctcacattaccttcgtttcatgttgtcgcctcattctgaaaaagtttttttttttttttcaactgctgaattattatggccatctgtctttgtatcactcttcttgagtccttaggagaaaggctctacacagatttcaccattttattttaagcatctcagaactggtatcagcccgtctcagctgtgtggacatagctggcctgggcctgcaagtctccagcctcatgtggggcccctctgctcttcattcaccatgtttgcaatactagcctcttttccgttgttctatacgttgaggtcttttctacctcaggacctttacatgtgactaccaacacctggaggactttccacctttgtatcccaacttaaatgtctcttgttgtaagagacactccttgacacgttcattccgtatatattcggccttctctatggccttgtcaaagcattctgggcttttgatccagaacttctcacaatttggagggatattcttgcctgtgtgcttgggtatttaaggcccatcacttcacaagtgacattctcacgtacatgacgatcatgtctttgatcagtatcagttttgtctttccccaaaacaacatctggcaccttgtagatcctgaataaatagctcctacctgaatgactgagtgaatgactgaattgatgaatggcccttctttttctgctgtgccagctgcctaataactgtcctgtactaatcagcaccaagcaaggaaacttttcactctcctggttgttcataaaatcttcccagttggagagataactaacttcacatttatccttcccagtttccacatgttgagattaatttcttgggtagagccatgtaactgcttgttttccagtgtgtgtgttgctgataattctgctaaatgaaaccaccgcatcaatttgttttatcaaacagaatatattttcctttgggtggcctcactgacttgcttagtacattttgtcctcacgatgtgctcatgttgcccttggtttttatgattctgaattcctcaaccacctcatctgaaggaagccattagactgtgcttatcagcaccgttaagaaatcaataaataatatcactctagtgctttgtggacaagataactctttaatacctctaatcatcacgtaattctcaggatagcatcataaatgatatattatgtctttttttccaattttaaataagaaaaaactgaagcttagagaggtttagcagtttaccctggagcccttggtagaaagccacaaaccaaaattcgaagctgggctttctgaatctggacggaatgcttttcccatgatgctgctgccttgtggtcagcctgtcagcactgaactctgcagccagtctgccccctcccctagataattggagcagccgtagccatctcatcctctccttgttggcccagtgttaaatcaacagcttagataaaatggatcacatctcttattgcacacaaacatatcttgaatttctagtatgtgcccaggactttgctaggcaccataggaacaaagatgaggaagtgacagttgtgttttaacagaagaggaggaaatctgaactgtggtgcatcatggggatacttaatgtcattaaaacagtccatggcaaactgccagagagctcctggggatggaaccatggactccacctgaagaactctaggaacccaccccagagtctgtccgggggaagaaggagagtttgccggtgaaggcgcagagagatgctccaggccagaagatccacctgtaggaggaagatgatgcatgtctggggacagacaggtggctcagtgtggccagccagggcgcggttggtagggagggacagagaggggaaaggcctattgggagctgattgttaagactgtctgtgaaggagcgtcatttggaggaggtgtcttgattttcgtagactgagtggaaccatggaagtgtgattggaagagacacggggctcctcttgctatacaaatgcagccattcccacagggtggagagaggattagagaggtggggcagggacaaggaggagaagagggtggagctggcagaaggatgagaggacccatgatagcactggccccatttgcagatcctagactctgtcctaggtgttgctctaggaacctcagttagttgccactgtctttgagatgagtgtgatatggacaggtgtaaaatccaagctcagaggagcaggcatcctcatctgcatctgaatagaaactacaggttgtgtaatcttgggccactgaggtagcctctctgagcctcagtttctccctctgtaaagagggattggccagtcatgtagggctgggacagggggaggcaagggaggctgagctgtgcagggccagatcccacctttagtttaaatttttggtaatattttcatcctgtatttttttgctttgatttagatgaaaaaatattgcattaaaatattcttcggcacaacaatgtgaatgtacttagtcctactgaacgtttaaaaatggttaagatggtaattttatataatatatattttattataaaaatgtgtacgttgtttatcataattagtaagttatttcagcacccccttaaatgttgcaccgaggtgacagcctcacatccctcacccattcctggccctgcagtcatgcacataaattgcttggcatagggtctgaccaatcagaaacggatggctgctggctcaagaccactgtctctgctgaggcagccatcgtgcaattgtaatgaaagtctgtcttgggagctgttgggaacgataaggggagactcaggggctgagcactgggtcgtcttatgcatcttgggcatagcatcctacacacatctatttccttaggaaaatgtgtccaccaacaggagctaggaacctcactccgtaaaacaacatttgtctcctagatcatctcagcttgggtggaggcccttcctccagaaaaggggtgagacggcggtcccttgagagaaatacagcttcttcccaccaactcaaaggatacctgttgtcccctaagacctcattctctgcttccatttctgtggaccaaaaggtagacccccaaggccttgacatctcctctgctggtggtcacagtaacccttaccctgactcactcagccctttgtgccccaggagacaaggagagcatgtgacagatcctcagaggaagcacaggtgagtccaagtggggagaccaggctctggtcgggtagcctgcaggtggaccggaggcagtgggagctcaagccacttcccaaaccttcccgagctccccgaccctccgttgcctccctgatgcctccttgatgcctccttaaaatccgtattttaggactgaggggcccaataaatgcacccttttcttctcccaagtttaggactaattgaaaaataagacaatgaaaacagacaaatggaacttaaatagtctgtttactggtgacaacactgggctgacagcatgactttctaacccgccaagtggcagactaaggatctgctcatagaaacccctagctggtgcagacctggggactgcccctatggtagaaacccctagctggtgcagacctggggactgcccctatggtagaaacccctagctggtgcagacctggggacaagcccctatggtagaaacccctagctggtgtagacctggggactgcccctatggtaggaacccctagctggtgcagacctggggacaagcccctatggtagaaacccctagctggtgtagacctggcgactgcccctatggaaaacctgggatttgaaaagctgacaaacccacccaacatcactgactcccacagtccctggtcctgtattatagcttagctccaacaagtgcaaaaatctcagccaatgccagagcttcatcacccaccagtcaaatgattcactctccttattaggggctgttttgagtaaaattatacctccctccaagattcacattttgcagtcctaaccccaactactgaagaatgtgaccttatttggaaataagttcattgctgataaagttagtttagatgaagtcattaggatgggctccaatccaatgtgactgatcattacaaaaatgggaaatttggacacaaagacacacactcccagggagaacatccacgtgaagatgaaggcagagatcagggtcctgctcctacaagccaatagagcatcaaagactgccagcaaaccaccagaagctaagagagaggcccagaacgagttttttttcacaacccttggaaagaaccaaccctgcagacaccttgatcttgaactgtgaaacaatacatttctgttgcttaagccacccagcttgtggtaatgttttacagcagctctagcaaactagtacaggggtgcaagtgtataggaagggtaggggaagtcatggagagtttctaggaaaataaagctaggaaaagaggttcacctttcccagagctaatggggtattagctgaataataggatagccctctgtgcatgacattaggtgctttacacatattgttcttattttctctttgttaaatgggttcctctgccctttgctcgggcacatatgcctgagtgagcagaagtcaagggggaaggaggaaataggtctggctcctgcatgcatcacacactgcctcatctaatccttctaaaacatcagcccactttatagatgaataaactgagggtatgatgttaagtgtgttgcccaagaccagttggctaataaaagagtttaaattttgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggtgacagagcgaaactccgcctcaaacaaaaaaaaaaaaaaaaaaagagtttaaatttgacaccaaaccttttccagtaccacagcctgtcttatggaaaacaaaatacttctatttcttataagtgaactataaaaatgaggacctgccaaggtaggggtatggaagtattcctggtgtgttcctctcactgttcacacccttctccctggctcttcaagaatcccccttgcattcaacttcacactctcttgcttgaaattcctttaacatgtttgagataagaatattatctgatccgtttctaatttctctgtggaatagggctaaagaagaagcaggcactaggaagcagctctcttgctggcttttaattttatttgctttctgtggctagagtacattagtattggcatcatttagtccttctgtctccttttcatttgagcaagttatcatctatttgacaggtgtcttagtccattttatgctgctataacagaataccacagtctgggtaatttataaagaacagagatttatttcttacgtatctggaggctgggaagtacaaggtcagggggctggcatatggtgagggccttcttgctgcatcatggttgagggcagaaggtggaagggcaagagagagccagagggtgagtggaggccaggctcagttttataacaaactcactcttgcaataaggaacccactcccataaaaatattaatccattgagagccctcaggatctaatcgcctcctcaagttcccacttctcaacactgttacattgggattaagtttccaacacatgaatttggagaacaccttcaaactatagcaacaggcaaagaaatcaatcacaagcagccattcatattcatctgcagaccaaaattggccatagatgaagatgcagaaccttcaagggctgtctgctgccaacctgggctcctgagtgcagacacagctggcctaaggcatccatctgttttctcctatccctaaacagttttttctccctttgccagcttgcacggctgcctgttcttctcacagctggccttcttgcatatccaaacttaaccgttcaaaggcaatatttattagatctataactattcttagaataactaagcatccccaaaggatatttttactgaagacgccttccaaagactggagcctctaacttttagctttggctcctttattcaccaagagccatcaggagggtactctggccacatagaaaacaggtaaagccaatcactttaagcatgcaattgtcactaattactctgaccttttctattattgtgttcaccaacaatttacaaaattaaaaaaaaaaatgacggtcttatatgcatttgttttaaaaagtaatcaaacagctgggcatgatgtcccatgcctgtaatcccagcactttgggaggccaagacaaaaggattgcttgagtccaagagctcaagaccagcccaggcaacatagggagaccctgtctctacaaaaaataaaaaattagttgggttcagtgacatgcacctgtagttccagctacttggaagtctgaggtcagaggatcgcttgagcctgggaggtagaggctgcattgagccctgattatgccactgcattccagcctgggcaacagaatgagaccctgtctcaaaaaaataaaaataaaaataaaaataatttttaaagcaatcagacaatacaaaaggaataaaaatagtattagtaattgtctcttaccttccaacccagagccaaaccagttaattattctccatatatatttatataaattgtttttttaataaatctagaatataacaacttaaatacgtgtacattttctctccaatactatacacagatggcttctcctatacattggatgaacttttggtaaagactgtgttttcccagatccttctttccattgcacatcctgaatggcctcagtaactgttttgtagctgggggtgaatgggctctccttcttccctctcttcccatgtgtttgacatcacagtaggaactggtagcattggtaaatatagatacagatgtcttctcaataggtagttatagagaatcattattattagattattacaggtaagcttgaactttattagcatacatagtgtttgaaaacaactttagcccttggcttgcaaaaacaatcgtttgaatgtaatcagatagcattgcattccaattaatcaatagaagaccaataaattgaccagataatgtttttacctgtttttccttttgagataaaattattaaaagaagagcctaggagtactttgaggacagtcttgtgaatacacttcctgaacctgttcctttgccctggacaggttgaaggaggcaggagattgtcatgttttctttgggtaccaatgtatgcccaactgtaatgaaaaaatagtctgaccttcagtggtaggccagacccccaatgatgtccctgtgctaatcaccaaaaacctgtgaagaccttaaattacatggcaagggaaaattaaggttgcagatggaattaaggttgctaacacctgaccttaaaatagggcgattatgctggattatttgcgtggatccctataatctcaaggattcttacatgtgaaagagggaggcagaagagtatcagagtgataccacataagaaagtctcccctggctctgaagacagaggaagcagccatgagccaagatgtgcatgtagaagctgggaaaggcagggaaacattctcccctggagcccccagaaggaacacagccaacaccttgatttcagcctgtgggcccattgctgacttctgttctccagatgtataagaataaatcggcagtttatgcccctaagtttgtgttaatttgttacagcagcaggaggaacctagcagatgccttcaggcagctgttgcattcctgtggagcaccaggaagccacacagccaggcaggtcgcaagcactcagcactcagggagcagagctgcacgagcagctggccagcaggacacgaggtctagcagcaaacagagagaaaatgggatttgtttttctttctccctttcaacccaggctcttctatcatccaagattccataaacatcacacccatgatgatgcagtggttaccccagggaggtgagcaaagattcaagtaagacagggattcatcagctggtcccgttctaggtgtgagaaaacaaatgtgaaatgaaatccagccactgtcagcgtgctttcacacagtcctgaactctaacacgcagtatgctgggatgcagacaggcttcttgggtaacaagatgctttctccctcttttggtttccagatcaaaaatggtttctggccgggtgtggtcgctcatgcctgtaatcccagcactttgggaggccgaggtgagtggatcacttgaggccaggagtttgagaccagcctgggcaacatagcaaaacactgtctctagtaaaaatacaaaaattagcctggcatggtggtgtgcagctgtaatcccagctactcaggaggctgaagcatgggaatcacttgaatcccggaggcagaggttgcattgagccaagatcgtgccattttactccagcctcagaaaagaaaaaaaaaaaagtttccttttactctgtgactcctctgaagacagggaaagaaaactcagtgccagcttcttggggagatgattccaatgctttagttctgcatggacatgcaggaaggaacctcctcatgactaatcaatgcagcagtaccacttcattcactccccactggagatatgtatggagcagagctctcatgacctaaattataagccaagacaccaaccttggtcctgttgtgtagctcctagcaaagctaacttttctagaaaaaataattaatcagtaactacaaatagaacagaatctggaccacccattaaatctgtgtgatgtaacaaggtttagaatattgagccgaactcacaccaatcacagacccgacaaggtatcaagcttttctaataatatcagagacacaggtaaccacagggcacaggttgggcagggagaggatggcaccaccagtgccactaccaggtccttcctgctgtgtcaggacacgcactgacccagtttaacacgtgtcctcgcagaatggtgtgcatttacaacacttacaaatagggagcctgggattgacagaatagtggcccccaaagatgtctacatcctaatcccagcaacctgagactgttacctggcaaaagacactttgcagacgtgaatagggttaagaaccatgagaaggggagattgttgtgattttcccagtgggcccagtctaatcacatgagcccttaaaagcagagaatgttctctggctggagtcagggagatgcagcagaatgagagatcacggctggctttgaggatggagaaaggaggccacacgccaagaaatacacacagttgctagaagctgggaaagatcctcagctgacaaccagtcaggaaacaggacttcagtcctacaaccataacaaactaaattctgcaagtaagctgaataagcaaggaaacagattttcccctagcacctccaaaaagtaatgcagccctgctgataccttgatgttagctctggagacccatactggactttcaacctgtaataagagagaactgtaaggtaataaatttatgttactttagtctggtaaattagaggtaacttgtggcagtagcaaaaagctaatacagggtcattttggtcattaaatacctctaatttcatatccaaatggatacctaacttaaatatttcccatgagcactcctagacatcaggaatattctgaagaaaacattccataaataaggatttgcctgctagtaaacattattgttttgtttgctaggaggtctgtgttttgcatgtttgcaagaagacctggcagtcatcagtcacctgctttcttttccaaaagcattcttcctccctacacccaagttagacctgctgctagttgtcttcttcccaagttattttgtaagagcttatctacaactacatggaaatagtaaaccaaggcttagagtattaccctattaagtttatgaggattaaccttgttcttgaatataacaagcaaggaaaaaacaaggaaattcctggacacgttggggtgtatgtactatttatagtattttccaaatcataatttgctctagacgactagatacagcttcttgactaaactggcatgaaaaaaatcaaatttccggactctgaataggaaaattaataaaattcctgcctttagatcaacatgctcccaataaaattgggatgtcttatattaataaataagaaatgaactaatgaatggattaattcctcatatggcttttctgtcattcagctcctccagaccaatctggaataagtatgttatttatggaattggattagagatacaatagtatgtcttttcaattcaacaactatttattgagtgcctacttgatgccagacactgtactagctgctggtgatatatgagtgacaagaaaggcacaggccctattttcatgggctttgcaggaaggaggcagtaagcaggtaacatcagtggggtgggaattgtgaaagagagccttgaatgaacatagaaccaatgaatttagcctggtcaggggatcagggaaagccctcctaaggaaaagacttgaatgatgagtaggagttagaagaggagagagtattcaggcatgtgcctttgagttttactcagtgaaatgaccctggactggaggacttgtgcttcgatatatatttttgaagaatccctgcagctgctacatgagacttccctagaaggtagagaagatgaggacagaagcagagagaacatataagagatacatggtggccttagagaacaattctggaaatgctttgaagttagagctgacttgatatgctgcctgattgaatgtaggtgtgtgggaaagaggagagtcagagatgagtgacacacatatctattccacaagcgtagcactgctggtgcataacaacataagcattaagaaaaccctcaaaataggccccagttagcaccattgttctttttccccatttcatttttatctccttttttcattcttgcctttttcattttatcttctttcgtgtctcttgatcactgtggcaacaaatatactttataaagtcctttttcactcttattatttctattttattcatcactaatttaattcatgacctctaagatgaagaaaattcagaactaaaaaacaaacaaaaaacaagctaaaaaggctggcagtctctgttcagtctactgtaacaaaacagcttagaccaggtaattcacaaacaacagaaatgtatttctgacagttctagaggctgggaagtccaagatcaaggcatcagcggcttcaagatctgctgagggctgctttctgcttcacagataataccttcctgcatcctcagatggtggaagaggctaacagactccctcaggcatcttttataaggccactcatcctattcatgagtgtctcacttaataccatcaccttgggggttaggtttcaacatataaattttaggagggacacagatattcagatgatagcagtagccaatgctaatttagaagtggatatctccacctaccaccatgatatgaaccagatggagagcaagggcaaagttgtggctagcttgtttgcaacttcatgtaacccacagcccactgcatctcgctgcatggtaaggggccagtgcatgtaggagagtgtcagtcatgggcacactatctttgaggtgtgtccatgtggaaaataaagatgggaaaccactactcagagacttcagcgatcctaattttctttggagttggaatcacctaacactatgtatttgattttcagcatagtctgtaaaaatattccatgatgagtatttgtgattcaaattaaaataatacagtgtatgtcttagagaattttagcaaattattggattaaatgaagtcattcaatcactgaatctaccgatgtacatttgtgtgatatagaaggatcctctctctgcatgtgttttgtcaaaagttgaatccactgtttcttctgtaacttttttctttactaattgacagatctctaaaaccttttcatttcagcacatataaaatgatggataataagagtaattatattaagatgaactttagaaaaaccttgagtttctagattctgttttctagattatttctatggagtactgttgccttgacattttcccccatgaagtcattatatatagtttgtgccagagttctaagaaccattattatttacgaaaagcagtaaaacctgaatgacaaatgtgccctgggctgatggtggagggcacgagccttctcttttgttttctagttattcccagggtggccaccaagctggttaagtgcacaatttttaaatcagaccttaacacttgctcaaaagactgacacatgtactgtaaaagattaaaagtcctttgattgcagcacttagcgcagtgaagatagacaatggaactaaactcttcatggccaacttgtgacctgtttttaatgatgctctgtggctcctcaaagtgtcattgctatttgacctttctgtgcagctttataattcttggatttttgaagcattactcctttcacaactgaagcagtaaaaggaaattgtgcacccagtggtgccattatcctacactcatattgtgtgcaagccatctggtagtagtaaagcaagaaaagtcattcttaggtgctacctagagttggtgagaaactcatttagcttactgttcttcctgcaacaagagacatctaaaaatcttaatgactacatctcgtcttatcattcagagcctgtgaaatgcccccatctgaagaaacgatgtttatctaaaacttttgaaatacgttagcagaaatgttaaaatgaacatttgtgaaaattactatggtgggtttccttttgttttatcttatgtgaatatagtagttttccattgctaccataacaaattaccacaaacgtaatggctgagaacattactaattgattactgcagagtcctgcactctagaaatgcaggggtcttggctggtttctctgtttggagcctctcgagtctgaaatcaaggcattggccattgggctctttttgcacagaagagcctgtatccaggatcgttcaggttgctggctaaattcagacccatgaagtagactaagggctgcatttccttgtggggtgtcagccaggagttgttctcagattctagagggcatgatattccttggctcattgctcccttccttcatccttaaagccacctgagtagccccactacctctatctttccccctttctcctgctccctcctcagccacatctctcagtctgacccttgtgccttcctcttctgatttgaagagttcctgtgattacactgagcccagcaggataatccaggatcatttccctatcctaaggtcagctgattagcaaccttgattccacctgcaaagccccttccccagttagtatttggttgagcgaccaaagggtaggaatcttggagagatgtctttagaattctccctaccacagtgaaggggaaaagtgcaatcatgacaataatggaagcagacagactatatcggtactatggcagccttgcttttaaaatgcagaatcttcgagctgccctgttaacccattttccaacattattcctaactagtgattaagacctgtgcataaacttgcaagacctcattggtacttctctttacagaaataactcctgctttcttttaataagccttccagaaatttctttcagaaatttaagaataggccaggcgtggtggctcatgcctgtaatcccaacactttgggaggccaaggcaggtgaatcacctgaggccaggaattcggaaccagcctgaccaacatggagaaaccttatcactactaagaatacaaaattagccaggcgtggtggtgcatgcctgtaatcccagctgcttgggaggctgaggttggagaattgcttgaacccgcgaggcagaggttgcagtgagccaagatcgcatcattgcactccagcctgggcaacaagagtgaaactgcgtctcaaaaaaaagaaaaagaaaaaagaaatttaagaatatattttagtaattaagattaaattactagttactgggagaagacagtaaggtgcataataatttaaacagcaagactgtgctaatatttccctttcaggaaaaaaaaaggctaaataatcttaagttttactgttttctgtatattttttcttatatgaaatatatatgtgttcttataatctttcttatccccatctcccattacctccatatgcgatattttcattctgaaacaaggcgagtggtccttagacttcttggcagtcttaagtaaccattagccaaaaacatggtttgtctgtttttaatacagtattcacctagctagagctatacagtaatctctggccgagttaactggagtccggattttctaacatttgtcttgttctttgcctcaagtaaaaaactactaaataagttgtcaaaacttctcagtttatgagatagcagttagcagagatgggtaaatttctaagaggttataggaagggtgggttttattttcaatcacttccttccaatttaaacttatggggattaagctattttgatccaaggaatgttttgatccaagagctcttggagtctccttttctattagcatttttgccacaaattaaggagttggtttccagggaaaatatgtaagaagactgtcttagtcagtctggcctgccatagtgaaatacgagagacaagatagcttacaaacagcagaaatgtatttctcacattctgggagctggaagtctaagatcagggtgccttcacggttgggttctagtgaggactctctcctgggttgcagacagccaactcctgtgtcttcacacagcggaaagagggcaaagagtctcggagtccccttttataagggcattgatttcattcaagaaggttctcatccttatgacctaatcatctcccaaagtcctcagtaacactgtgacatgggggttagaatctcaaaatatgatttgttggaggacacaaacattcagtctataacaaagaccataaaaagcagagagggccggatacccgcaggtggtaggcctggaccccacagaataacagcggcttctgccctttcttccctactgagtgactccctcttctaagtacttagccccccagtgagcagtcagcttacagaaatactggggtgactccccacaataaaacaatattttagaggggctggagaattgcacaaaacaaagggttaagacccaagagtatgtgagagtatatgcagttctttgcctctttcagttttttgatgatggttattggtattcagtaagctatcagtcagtgatcaaagcaatcacaaaaacaagaaatagacctcaaggaaaactttaccatctagataagtgagcttttaaaaatcacatttattctcagctttaataagtctttgaagtacgatttgttaaaatatcctgcaagtaaataaattaaaagattacatgactgcatatgtggaattaggggatgaattgaaatgaaagttggaagttttttgtttttttttttgagacgcagtctcgctctatcgcccaggctggagtgcaatggtgccatctcagctcactgcaagctccgcctcccgggttcatgccattctcctgcctcagcctcccgagtagctgggactacaggcgcccgccaccacgcctggctaattttttttatttttttagtagagacgggatttcaccatgttagccaggatggtctcgatctcctgacctcgttatccgccagccttggcctcccaaagtgctgggattgcaggcgtgagccactgtgcccagccggaaaggctgttttaataatagctgttaataatccagaacataatgccagatcttgaaaatcttaacgcccacagtctgacatttaaaagccaggtagccaataatctataaacccttattagtcaagttctgttcccctacttcttagaagataggggactcaaaatgcaaggaattggatcacattggtattgctcattatttatttagtcacatggtatttattttcctggaagccaactgcttggtgaagtgaatattgcatctctcttctgcaatgtttcctagcatattcatttattatatacattttaaggcttaggttctgtgacttgtcatataaatcacacctggttgagcagaaataattttgtttaacaaagaaagaagaaaacaactagctagtattcattttttaatctaatttgtgttttgacccatgacattttcttttcgctgtgtttgtaactttgtaactggccatggctggcaaatcatttagcaagcatggtaatgcttgctgcagtggcgtgtggtgggtggacttaacagaggtcctcttgatgggaagtcaaggtgccagaattaaggttagatatgggcggctttcaatatatagtacaccctgattttctgagcctaccatgaatgtgccagagtaaaacattgtgggagttggtagaatacagggagggcgggcactgacccgggggatggaccatatggcgttactccaagcttgagacgtcgtccggtcatgaaaaaatcaatgcctagtgagtacagctcattccccaagtactgcaagttaggaaagaacaactgtgagcggcacgtgagtgtttgtggagcacaaagggccacccgcacaattaggctcacagttaatggttttagccacacagcatccacacctttcttccctctgatttccttgtaatttagcccaatgggaaactttcagcagacatttcatagagcagttaactctgtggcgaccatcagttttaattggaatcatgtagctaaaaccctaggtagtacttgacagcaagagggtgtcttttaattcaggtatttctggttccgctctgggcttctctggaacaatgttccctgatgcatggctaactccagaaggcacggatccaggcagtcttaaaacggtgcagtgtttaatcgtcatcaaaagaggggccctccgtccctttctgatggcttacgtttatgggtggatggggggggtgtggtatgaacctagcaaccaccgctttgggcacagaacaacagtggtgttcgcggccagccccaataggtagttggtctttagccactgaagcattctgtctctgcagctcagcaaagcaattaccaagccatcattgtcctgatttataaagaaattgccttccttgggagaagacagtaaggtgcatagtaattcgaacagcaagactgtgctaatctttaaaaaaaaattagggaaacttgtttttttgggaattattctgacttggctgtgataagagaccagctttcaaaacacatatggagagagagaagtcaagagcttttcaagtaaatttaaccttacattatttgcaaccaataaaagtttatggaggtgtggctaatcctaatgcgggtaatactgcctggtacttatggttggtgcttcacataatgttatgggaattcatttaaaataacgaggctgcactgcagacttcacttaagcagggctaggaagctgcctcatttctctctcttataatccagtgtactcatgtcctagacagatacagaatgccaactgtagcactattggttctctgcaagctctgaaaactccagttttcaggggacttttctggcagaagtggaagataccaaccaggcaaaagagcagtctggaccaagctgatggctgcaaatttggtggcattcttgtagctgatgagatcagagatagggcagaatatattgaagcacgtagttcagcctcagaaagtgcgtcatcccaacatcacatcagtgttgctcatgcagagggccttggcatgccctgagtcccatcgaacagtggcctggcctcacggcattgagagcaggtattttctatgccaccacctcacgcccttccacatgctccgaggaagaattttgatgcatatatatatattatatatatttatatatataatatatattatatatttttatataatatatatttatatatttatatttttatataatatataatatataatatatatttatatataatatataaatatataatatatattatatattatatataaaatatataatatataatatatgtatattttatatataatatatataaatatatattatatataatatatatattttatttatatataatatatatattttatttatatataaaatatatattttatttatatataatatatatttatattttttatttatatataatatatatttatatattatatattatatatatttatatattatatattatatatatttatatattatatataatatatatatttatgtattatatattatatatatttatatatgtaatatatatttatgtattatatatttatatattatatatattatatatattatatacttaatataatatataatatatattatatatattgtatatatataatatatatttatatattttatatataatatatatatttatatataatatatataaatatatatattatatatatggcattttggtcttgagcaaagcaatccagttgtttgattatctagaaaactcttcttgaaacttgcatgtgcccactgcaggctgagcagttttcctgggagggaatgggacatgaggcatcggagacggtgctgagaagaatccgtttaccctggagcaaaacgagctgcagcctccctgtgagtttcctcttgctgctgtaacaaattgccacaaattccatgacttaaaaaaacaaaatacattagcccacagcttctctgggccagaacttcagacactggactcactggtttaaaatcaaggtgctggtgggatcgttctccttactagcagctctggggaagaatccaagctactgcaggttgttagcagaaccttgttccttatggccatgagactgaggtctccacttgcttggtggtggccagttgagagctgccctcagctcctgcactcctaatggcctctccctcccctttgcctgtggctaccccatatgttgaagctagcagctgggagctgaacctttactcttgggatctctgccatcccttctgctgcacctctctgactccagccagggaaagcagagaataaaatagggagattttccagggacaaaatagggaaagtctccctattttaaacattgtaaccttaattccatctgcaacgtcttttttttttcttttttccatataaagtaacctgttcacagactccaagaattaagttatagacctcttggaggggctgttctctggcctaccacagtccaccctctggcctccaaagagtcacattcatgccacatactttcattccatccacagtccccaaaggtttcatcccattacagcatcatctcaaagtcttaaatctcttcagctcaaaagtccaaaatctgaatcatccaaatccgagctggatgagtaatctgttaagtacagctcctggggaagaacttctctccgtctgtgaacctgtgaaaataaggaagcaacatatctgctcccaacatgcagtgatgggacgacatagtaacaattatagacactccagttctaaaagggggaattgaaaataaaatggagttgctgctccaaagcagcctggaaacccagcccagccaatgccattgggtttccaggccagagcttatcgaacgtcagcctcagctttgccctccgggtcagatgtcagaaaaagatgacagtggaaatgcctcttgtaagggacttgaatgcatcaggctggtgggggaagaagccctgcttcagtccacttttgagtatcgtgcaaacgtcacacatttccacctgcacagaacgacaaggacagaactgcatttccacctgccgtggaactacaagaggcaggagtggtacctctggtgagggatggcccaggatttgcagcaatccacctgggctgtcctgtggccagatctcaggaagcacttagcacagagaatgtggttgagtaaaaggccattaacaagatttgcccttggtccaccatgagccagccacagttttagtagacatattgcactggctgaggatgccaggcttagtaaaaatggagaattatatgccaaaattaacatttgccacagaatgccatggctccctgccaggtcctgtccttggttggagcctgcagaccccacccctgcacggatgtgcgtggatggtatttgcacaggctgttcacctggaacttagcccaaacctgtgcctgtactttaagccttgccctttgcatctaaaagtacgcatttttaatactttccatttacattgcatgagctgcttttttgctggaaacatgtttattatgttccgtgtccttattttttaagttaccacccatgacttgctgctgtaagtgtgaaggaaaataactgatatctacatttacagaattacaacttaaggaaatattttactaaaacagatgaagagtaaaattttcatccatttcagcctatatttgttttctgttgtatatctagatgtcacttccaaagaagatgggttcccaaattcttcacactgctagttacatactgatgatatcgtggttactcacatcaaatataatgtctgtttaccttgctggacggtgaccttctaaaggtcacaagccaggtactctcatcagtttatcccaggacttagcattgcgtatggaagaaagcaggcacccagtcaaggttggctgctttgttgatttgaaattatttatctctgctattttatcttcctagaatgattcctctaaagcccatatctcctccaaaattgaaccaaacattacataatacagtaaaaaattagaaataatctggatattcattaacagggtattaatttaaaaaattatgaattgtgatctattttctttttttttgagacagagtttcactcttgttgcccaggctggagtgcaatggcgtgatctcagctcaccgcaacctccgcatcccgggttcaagcaattctcctgcctcagcctcccaagtagctgggattgcaggcatgtgccaccacgcccagctaattttgtatttttagtagagacagggattctccatgttggtcaggctggtctcgaactcccgacctcaggtgatccgcctgcctcggcctcccaaagtgctgggattataggtgtgagccactgtgcccagccgatctatttataccatgagataccaaaagtcattcaataactgtagctaccatcatgaacagagacagagataaacttttgaggggtaaaagccagttgcctgaggaattgttatggtaaaaaacagaatcttacctacatggttcattaatacgagtggaaaataatcttgaatgataaacaccaaatggtcacagtgatttccttaagggaaagcgaagagtgtggacatcacttttagttctacatttcccccactgtcttaatatttttacattagtttttgatttttaaaaaataaatgactaaaattgccaatgctactgtgaaaccttctgttctttcctctcacacatttgcgggagacacttttcctgtggggtgctggtaacccgcctggcatgtttctcccctctgggctgggaggtctctggtggagcagctgctcagctaacgtttactgagaagaaaccagcccggcgctgagcagctgccctgtgtcactgcagatcccctgtgatgtccacaccattcccagcagcacctcccggatgaggaggccaaagcaaagaaagcgccttcacagctaagtagcgcagctatgtgcaccgcagcaggtacaggagaagccacttttgtgaacattttgaataataaggaagccagccactcccttttttcaaagaagctacaaatcaaagggatgagccctcgtggaagaatgaaggggatggacagacttggagggtctcatgctgcccccctagccctgcaacctctgcacctagagagagaggctgtggctggattactgtcactccagtaaaggccaggtggagtcagcagacccagtggctgggcgaagacaccccttccttccccacccctgggcactcaacaaagaggacaatcttcctgcacggaagaaaaggatgggctttttggacaatgattttggaaaccacagacaaagtttcccaaggccttgtgggaggacacaaggcagagctgccgtttccccgaggaggcaaatacatttgattcctgaaacccagactctagatttaggagagcagcgtgctgctccaagcaggggctgctcaaaccacttattttggtgagatgtttttagacagtttaggatcccagcctcagaatatgctgaaagttctgtacctctagcacagaaaataaaaacaaaaaaccatgcataacgtgcatataaaaatatacaaaacttggaacaaaatatcaggagttcacagacaccctcctgaatcctatatctgagcttcagatgagaatctcggtcaggggttgatcgtgccagtgacccgtttctgtatggcttcaagtaagaacaggttttacattttttaaaaggttgttgaaagaaggaaaaagaggaggagagaagaaaaagtggcagaaaccctgtgtggcccgcaaagcctgaaatatttattctctgatcctttacagagagtttttaactcctgatctaggtgttcacggatagaagatctctttaaaatttaatgtttttgaagcaaaagcaagtgtgcttcgtggaatcgagaaaagtatgattggcataatttcccattctcacacttactcagatcaggtaatttatgataaattcaagccatcgaggatgtaaggatgttctccacagaaaggagctaattataggcatcaaactccaaagagccaattttttgcatttttacgtgtaattaatacttgataatcgatttggctgctaataatatggctctttgaaggggtagctattaggtctgttcagtctctgcttagcctaagcaagagagagcaggcaggagaggctgggagttctggagatcttgttactgggggtgcctgtgttgttgaattaaaagattgtcatgagttaaaaaatttccatcaatttctgagcaggtaattacatggtcaaaaaattaagatgctccatatttatgttctacttgtgagatcccccctcacaagtttagtgttatttcccatcatttgctggttgactgttagaagctgatggccattggtctaaaggccataactggtgtgtgtgggggccatggtcccatcctgttaggaagagcctggggagtgttgttcagagtctatacatcacatagcacacggcagacagccacatggcttcatggccattcaagaagtactctacctttccacattgaatttcctaccgtgggctaaggccgtggttctcacctttggaatgcgttctcatcagctggagaccagtgaaacacactgagaatggggctaatcgaagtataggggaagggcctgcgcctttgtattttaatcaagctccaaagctgattctgatgcagcagaggagcataggtttgagaagccacagggctgaacacaggttaggtgctggggaagcacacatgtagattagatcctcatggagcccagctatccagagcagacctctcagcctcgaaacagttggtgtgccttgtggtgggggcagtcctgagcattgtgggatggttagcagcagccctggctgcctctacccatgagatgcctgtaatgtccccaacactcacccagcggtgacaaccaaaaatattccctggtggcacagtcatcctagttaggaaccactggtctagaaagagtcctgaaaagaaccatatgctctttcatccagtcgatatccagtgagttcctactgtgtcctgcacagtggggagcacaaacaaccaaataagatgatgctcccccctacctcctaacgccttgtgggaccagactcaaacatcgtgtgttacaggtgctctaagagaagcttgtgcctggagctatgaaggaaggagtagcggggctgaggcaaggcttagaaggtagaaaaggcagtgcttggattgagccctggcaactgcgactgtcagagttgatggcttcaaggtggaaggaagaacattccagggggagggatcagtgggcctgggaaccccagacagcctctccttatccttggtcaagcgtccagaggccctcagctctgccctgaggggtcgcaggtatccccagggtcgggtctggtctctggtccatgccatcatctctggtgtcttctgcctccccggcctgccttgctgggttgcatcaaggctgtactaagtatgtgacttcatttttcgacgggacggtgccttgggactctctgtatcacttaaacctagttctgttctctaacaccctccagacagcccaccccactcctcaaactagtatatggtctcaggaacccaggccagatcctgcagagacccagcatctgggctctgatggttataaattggaagatgagatgtaggagctcagggagcgcctgcccagggatgtgaagggctgggccacctgatggacggtgattatagcagggctggacccagggctcaaggacatgtaagtaggctgggtatgagacaactccagtggagtccagaccctgaaggccaaggagaaggtgagggagagaggagaggaggaaacagacataggaagacaacctagccttgagccaggctgtgaaagctcttcctccaagcctgaggttgtagacgggtgagaaactgggaaatatctgactggctccaggccacaaacttgtgaacaatcataagaaagtttatatcttgaactaattttacttgcgatgctgtatgctatcttcaattgcatcttctattttttttttttttgcaagttgaaactgcctcgaataactcaagatgaggcttgtaacacaaggtacagtttaagaagccagtattcaaatgctggaacaaacatctgatatttattctgtaagcatagagcacagtcagtcacagagtaaatgtgcccctgctttcctgaattccaatccgatggaagggctgaattctcaataagagccaactatgtgtcacacactcagctgaatgctaggtataaacatgagaatgacacgctttctactctccagaaagtcccagtgcagtaataaggtcacagcctaaataataccaatacaaaataaatgatgatcagtaaaggaggttcaaagagctaagagtgtgtgaagggagaggctaattacaaatacattgattacccaatatctcattccttggttttccctgtggtttgatcttcagtatcctggccatctgaagcagagacacatctttcatggaaaatgccgtagtcatacaggtgaacatatggtctgagttccacgttgggtcctaggagagcactgagtgatggagattcaaagaaatgagatttcaagcagcacagaagacaggggaaaggaagcagtttagttgcattaaaataaaaaatagattggtcttttaatttggaagacataaaaatgaattgtttcattttttatctattagataaaaagattatagaatccacttttagcaggaacttcccaatgacatagcaactgacaattcagtcacgattgtaaaggttactaataaggatgagatattatgcacatttttgtgcttctaacaaataatctacaggtatttaatactatgtttatgcatagaatttttccatacccatttctaaccagacatagaagtcaccttcctcatgatgggcagaagatggtttaagtacaatgggagggaggaactttctagattgaacattgattaattgtcaaacactaaggaccatgattacaactaaccatttagtgagcatcgcggaaggttatcagggtgtttatttttaaacagtgaaacatcttgttaagtttcatagtaaaggtgttgagacaaaaatttgagctgtgttcaagtcgtgatgcttatagctgtatcatgtactaacaagcttatgctatttcaatcataagctgacatgacttcaccttaacatgttgatcaaaagtcttaaccaacaacaataaaaagctgaaatttgtggttgaaagagtagaacttgtgtctgtggggaagacggaggaacaggaaaccctccttaccaccaatgtgaaaatcaaatattctcttaagatatgtttcatgcactgaggcatagttgattaaaagtggaaacccaagcccagaggcctataggaaatcattgcccattgaaaagagacagtttatataaaaatgtatactgagcctcatcatgcctgcggacagtatgataacgccctcttcaagtctgtatgtatactgagcctcatcatgcctgcagacagtatgataaccacctcttgaagtctgtatgtatactgagcctcatgttgcctgcagacagtataataaccccctcttgaagtctatatgtaaactgagcctcatcacccctgcagacagcatgataaccccctcttgaagtctatgtgtatactgagcctcatcacccctgcggacagtatgataaccccctcttgaagtctatatgtatactgagcctcattacccctgcggacagcatgataaccccctcttgaagtctatatgtatactgagcctcatcacccctgcagacagtatgataaccccctcttgaagtccgtatgtatactgagcctcaccatgcctgcagacagtataataaccccctcttgaagtctatatgtatactgagcctcatcaccccttcagacagtatgataaccccctcttgaagtctatatgtatactgagcctcatcacccctgcagacagcatgataaccccctcttgaagtctatatcataggtgctgtgtgggtgtaggcgtatctcagtcactccccttctctgctgagaccttaagttattaatctttctcatttttcaatatcttacacattgtaatatagtagccaattaataactttttaaattttggaggagactggactagaatggaatagaaactagaataaagaaaaacgctaagattagtattgacaacttctgatgttaagttgttcattttgattatttcctattggttggtcctgcgcatttaatgattaccagtgaaattagggctgattattaggaagtttattggtgaattgggaggcagcctgcctccaaaaaaaggatactcgaaggaaagactgagcacattagtcaaagaagagctgcagagggtttttttcagatcagggtgtacacacgctaccctaagttgctttccagcctgaatttcattaattctatttggaaatgctaacttgccacgctaaagagcgaaacataatcacacattgccatgcaaagttcttctggccaaagaggtctgattcagaatctttgacaaacttattattttaacagcttcacagctcaacctggtgaaaatcatttcaagaaggaatgatctaaaatgctcctttaaaagggccattcttttagtttaaaataatatccaaatgcctgtcaccaccttttccctagcagaaagttagttcctctctggccaccaccacggattgtgtcagaaacaaaggttggccatcacaggatggaatttataaaattttacataaaaatgctgtcagtatttgcctagttatattatctaggaagctgagaaattttgtttatattcgaagatcagcaaatgccaaaaatactaatttgaattgtataacctttcccagtgttacacaaaaatgctgctgatagagcctatcttaacacgtctgtggaactttttaggtatcaaaaaactcttcatgttcagtagcattttaacatgaaacctgttttattttattttaattcttaaaaaatcatattctgcattcatatttgacaacaggcctgaagccctttctttcccatcttcacaggttttgttccagctcctcctcagctgaatgctaggtagagacgtaagactgacatgccttctaccctccagaaagtctcggtgcagtaatgaggtcacagccaaataattccaatacaaaatcaatggtgatcagtaaaggaggttcaaagagccaagagagtgtgaagggggaggctaattgcaaatagattgattcctcaaaatctcattccttggtcctctctgggtttgatctccagtatcttggccatctgaagcagagacacacttactgtgtggccttggacaacctctgaggctcggttttatcatctgtaaaacagaatttattacaacagcaaaagatgttgtgaatatgaaatgagactacctgggtcaattatagcgggctggagattcatttcattcaacttctccagactccgtccaggcttactgatccttgggatctgcctcatggctgccccagcactcagcaaagaacaccaccctcctcccagccagaccctccctagagagctggggtctgagttctcaacatcagcatcaccaaggatatgcaagttatctgactctaccccagacattctgagtcagagactccagcatggagccagcagtctgtactgcacacacctccagaggattccgatgctcccaaagtttgagaatcgtccttctttttctaccactgttcccaaggtccttaaattctttcaatccctttgtaccacccactaagtcatctcctgcagcctcccttttacaggttgtgttgtctgtagtaagtcattgcagaaattctctactggaaccatatgctaactgtgggtaggagaagaacaacatatgctcaggtggtagagtaactaaaagcaccccaagattttccttcggattatctctgtctcttgtaggactagaagatctctctgcttcgtagccacacatttcattacagtagaccccatctgttgccattagctcagcatgtgctagtacagaaaagagcttggagcagccccttctcataagaggtatcatgcacatcccaatgactaaattgtcacagaaacctctaactatgtccttagaatgaagtcctagaagtctacttctggctgggccaaggtaggtatcttttgtggcagacaaatttagatgtctaaaatatttcagaagttacaagttctgtctttgaaagtgtttcggacctctcaaagaggaatcctttgaatcaaaaagcttctgattgtacatggagtaaacctagaagactttctgaaggtcccccaccctccacggtcatgggactcacagatcccgtattaggagttcttcattgtctattccaggagttgcattacagacatctgtgacttacccaactctgggatgtgttttgtggaagccatcccttttcattaaagatatattcttgataagcattctgaaaaagtggggaaaaatgcatttactttcaaactatgagagcagctgggcatggaaagacattcttttggtgacaaccgtgaagatcgctgacgtgtccttttgctttgcaggaatgttagttcggccggagaggaggcccgcagaaggatgagagagtgtgatgggcttacggatgccttgctgtacgtgatccagtctgcgctggggagcagtgagatcgatagcaaggttggttgtgctggcatagattaaacatgtttgagaataaagactcccacgggactcaacaatagctaacaaccctggagagccaatgcagtatttcagactttccttctgaactctctcctggtttccttataagaatccaacacttttagactgggcttctaattctagcatggatctagatatataacctaacttctgattagctgtgagtaaatatgcagattgttctaagttactcaaaccacaggtgttccagttgagtgtataaacttgaataccacgttgctcacaagcttctagttttttttttttaatgtaatccactttcaacagaaaagacaagatgttaaaactacctgctttttttttttattttttgagacagagtctcgctctgtcacccaggctctgtcacccaggagtgcagtggtgcaatgaaggctcactgcaacctccacctcctgggatcaagtgattctcctgcttcagcctcctgagtagctaagattacaggcgtgcaccaccacacccggctatttttttgtatttttagtagagatcgggttttaccacattggccaggctggtctcaaacacctgacctcaagtgatccgcccacctcagactcccaaagtgctgggattacaggcatgagccaccacacccagatttgcgatttgaataatcccatattcttataaacttgctttttaacaactgttgattacactaagtgccattttaaaaggcctgcaagatctaaataaatgtcacaatgctaaataaatggggcttcccaacaaaataaatcagcaaagtctattcagtgtcttagttcacaagccagaatagaattgggtgggcttttccagtgtttgagctattttatttagtcttaaataagtttgattcattcatatgtttgtaatttcataatatcctgttataaacacaaactttaccaatagtcataaagtaatgcaggtaataaatgtgatttcttaataaggatttctcaagagccacccttattgacattttggggtgaattattctttgtcatgtgactgtcttgtgcattgcaggatgcttagcaacctccctggcttccgcccactggataccagtagcagcccccatccccaccccagtaacaaacaacagtgtctccagacattgccacatgtcctgcagggagcaaaattggccctggttatgaaccgtgaccttaatcctatggttttcattctgactctttattagaattgcctttggagtgttcatgtaaatacatctgcacagaccctattgcagtcctcctaacccaactgtctaactctggtcacaagtttgtgtacctttaaaagttcatcaggtaatttgatgtacatcttagattaagaacctgccatagtagatagagctttaatatgactctctaattgggaatctggtaaaatgtaatttagttacaaagttagataaagaacaaataaaagtgtttctatccatgtagtcattaattggctgtgtgtataagttagcatagcacttctcaaccctgactacatattagggttaccaagaaatttagaaaatcactgatgcctgagccttactccccagagatctgaatgcaaggtacctctgggacgtcagccctttgagtactagttcaccccaattatgagcaccacttgtcatcttttaacttctgctcagttaggttcacatccattcactgactgtgtgtttttagtttcaaagatgaacataatgtaacaaagagtaagcattcccctttcacagaaggccttaagtgaccattttagaccatttagtatcatcgacaggaaaattaaattcctaaacaagtgaccagtcaagatgtcttgaatatttacaagtgcttgttagcgtaatagacacgtgtgttttcaaagggctcctgaaggtaaatcactgaagcggcaatgctcagcatcgtcatattcagagtggtgagtgaggcactgggagactataccttttactgtgatggctacgaaaagagctttgatactagctggaccttacagctgaaaataaaataagagtcaacagcctcatgctttggctaagtgcagccaccagcaccaaagattaaggcatctttcaggagccatggttcaagaaccaacatggcacaaacatcttctttctgtcagatgaccagattcctaaaacctgggagacttggtagatcatcttttctaatgtccacattttccccaaaagaggaagttgaaataattgggagtattcagggctggagtcagaaaacccagatatccctggtggagtaagaagagccctgagctggcatcaagacagtgccagtggactgtgccatctccacctcccactggctggagcaccatatccaactgacctcaactctgtgacaaggagcataatcatagctgaatgccaaggctgttgaaaggatcagatgtgatgttactcagcaggtgcttcactggctggattgtgctattgggttttaacgtattattattgtaccatcattttccactcagccctctgcttggccgcttttgagctttcacaatgacaaattgagggtgaggggtttgaatgagtacaccttctttttaaggcctgagaagttaatacataaaagagcgtggattccatacaagcttgtgactctggtcctataattgggccagtgtgttgactggataacatatggtggagcactctacaacttccagattaaccctttctaatagaaaataaggaatcaaaatgaccctggtaaccaaaagcaactgctgaaagcactgctgacagcaatggatgtcccaagcaaagctaccggctgccaccctcctgctaggatcccaagtcttttgtcttctctttctccttatccccttagagaaaagctcttgaattaagtaactctcccaaaccaacccagactgcagaactcctggaggcttaaatgacagataaatgtggtccctgtgatcttctttcccccattcctccctccccatccgcccccatccctactttctcttcttcttctagcttcttcccaaatcatctccccagctgcagctcgattataaagcatttttcccaactgcagatttattccccaggagtcatttgttaaacagaggaacagtgatgcctccagggaagacgaacagtgggatgagaaagaagtttattctcccaagtctttgatgtaagaaaaataagtttgagctgatttaaagatcattctgacttatgccataacattttcctttcaatgagagtcgtttctctctttcatgcatcgccctgagtttacctgctttcgtgccagtccactttttgatgcagaggatgcttggaatagaaaatcaggttgactcagagcctgtgggattagcagcccatgacaccttgaaaagctgacaagaaaggtctggaatgacaaaggctccagagatatttcctgaaaactggttttcctcgtaagttttcatgccctcggtaataagtacagggcacctgctacctttcaccagattccagccagtggagggaagcagtgcaggattgtgatcccagcagcccctgcccattccagtcccaccccaggactgcagagaagcagctcagtctggtgggaggtactcacagctttagctgtcctcctttcacccatacaatggaattgtattatgtgccatcacagtggctgttacgtagcaggtgcctgaaaaaatgatagccagcttggtaagattcttcaaataaaacttggctcagtttatttttttttccatcattgtttcaccccttctaaaattggatatttttctccgctttccatggttcctgtagtcaaaaggtcagctttgtcttaaccagcaaacgttttctgcaaaaggtcagagaataaatattcccggtgttgcgggccatactgtctcagtcacagccatgtaattctgcattgtaccatgaaagcagctacagaccattcataaacaaatgggcctgggtgtcctccaggaaaacaccaattatgcacaaccggctgtgggctggatcggacccctgggcggcagtttgctcacccctcttctcaacaatcagaagttattacaactagtattttagcaaatagttttgagcagacactattcaaagagctgtatctgtgagcttattaaccctcactgtggctctgtacatgatactggtgttttttttgcttgtttttttgtttttctttttgagatggagtctcactgtgttgcccaggctggagtgcagtggcgcaatcttggctcactgcaagctccgctttccgggttcacaccattctcctgccttagcctcctgagtagctgggactacaggtgcccgccaccatgcttggctaatttttgaatttttagtagagacggggtttcaccttgttagccaggatgatctcaatctcctgacctcatgatccacccacctcggcctcccaaagtgctgggattacaggcatgagccaccgcgcccagcctgtacatgatactgttaatatgaccctccctttacaaatgaggaaatagaagtacagaaagattaagcactttgcccaaggccccacagcttgtgaaatggtaggcccaggattggaagccaagccggctagccctagatcccatcctctggagctccgcactgtgccatctcctgccactgttaatgatatgaacatttgaagagcatttactgtgccccagctttcttcccagtacttgcacgctgtgttactttcctgttgctgtcataaccaatgaccacaaacttggtggctgaacccaacacacatttatgatcttatagctctagagaccagcagtctgaagtgggtctcactgggataaaattaaaatgtggtaaggtctgaggcttaccttcttgaggctcttggggagaatttgttcccttccctattccagcatctagaccctgcccacatacctcggcttgtggccccttccaccatcttcagatccggccatggtcagccatgtccttctcacatcacatcactgtgactctcctgacttcctctttgacgtacaggccccttgtgaggacacaggcccacccgaacaatccagataacctccccatctgacaagcagctgattagcttaacaattcccacctcctgccagccacgtgacctaacatacgcgcaggttccagagattaagatgtagacctgctgggtgcggtggctcacgactgtaatcccagcactttgggaggcctaagcaagtggatcacaaagtcaggagatcgagaccatcctggctaacacagtgaaaccccatctctactaaaaatacaaaaaaaaattagctgggcgtagtggcgggtgcctgtagtcccagctacttgggaggctgaggcaggagaatggtctgaacctgggaggcggagcttgcagtgagccgagatcgcgccactgcactccagcctgggcgacaaagcgagactccgtctcaaaaaaaaaaaaaaaatgtagaccttctgggagggccattattctgcgtaccacacacatgttttagctcaactaatgcacaagaacctaagatgtgggacctgttatgaccattttacagaggggtacaccatgtcccagagatgtcaagtgcattgtccaaagtcccacagctaaatcggacacctagggttctacaggtgtccggctccacaacatgtgtccttaaccactgtttaaccttttggctaagaaaacatgagtgtcaggcatctcaaaaaaatgtagactaaaaatatttatgcaccccaggtgatcacagcccctcactttcctgggacaaccctggtttgcacctgtagcctccttgacactcggaaaatgctccggtgggcagtaaatatgccccccaccagagctgaccgaaattctaagtctttgattcctcattacccgatccccaatccccagccagggagtcagaggtggggcgctgtctgttagtggatgatatttgggatctctcgtggttgtacattcttcccttctcacaagtgaatttcaatcaacaataacagatgtttatagaagtaactattgctgataagtcatttatttgtgggggataaaaggtcctaagacctttctaagtttctccaattgttttccactgtggccatcaggggagctttcagaagctggcagctaaacacttccaaagagaaatgtgtccatggagaaagaggcctttccaggtggaagaatggagtgctgagtgctagttttactcattctttcctctgtttcccccttttctgcagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcaggtgatgcaggctgcttgcagctgcatgcaattatccccttcctaattgcaactgtaatatatcctcaatatatagagaatgagccctgcattttcatcaggaggtaaaatcactaatgcatctgcacaattttcctgtgggaatttcacagctgagacggtgggacatgaaatgatttccctcacgtctcgcagttgagccaggataggaaattacttaaaaaagaaaaaaagacacctgaggccctagcaagctctgacattccacctctgagcaggcgctgtgttaattcacacatttacttagggcattgtcggagctggatttgatgccatccaggtgacagggatgggtggaacaggagatgtggtataagaagggaaacagagagagacagagggaggccaaagatccatcatgtatttaatcgctggtttcgaagcatttagattttcagtctcacactttccattggaaatggggtaacagagaattcacagcccttccacaggatggcattagaagcttggccgtggggaacaattcaggtgaattcagaacaatgttgagctggagctggaggcctcttgagaacagaatggccctcacctgctgcagcgggaagtaggttcccctgcagcaaaacgaaggccgctaggcagcaactcacaaccctgatgcatcagaacagtctctgctcctgtcttggggagcccatgagagaccaaacccctcaccacaggccccaccaggacagggagcgatgggaggacaaagcatccccacctttgctaacactggaacagcggttaacttcagggcctggaaactgatttatctcatcaaggagcttacagagagtttcacaagtaaagtgaaaaaaagcaatataaaaacaggtgcgtacatagatataggtatagatgatacagatacaatctggccagttttgtataatatgtcatatgcaaatacaaaatgctatttgcctgtacaaaatatatgtgtttcttgaaaaagcagagtaagatccaagagaagataatgattgattccttttgtacttctgtatttataaatcttctacaatgaaaattacatttgtaatctttgcaaatggcctttaaaaaataatgttcataaaggcactaagttaatgtatgcttataaaagtgtatggtttttttcagagaaatttatacctcactgaaaggtgtaagacattatgtaaaatgaaaggttatctagtctacaacacagaccttccaggacagaggagccaaatattataacaggagtaaaagtgatacaaataataattggtttaatgatggcctctagaactttttctagtccagaaatttatgttgacccttacctttggcattggtgttcttgaccttaaaaagacactataatattctgcatgtcaaatttagctataagaaaaatctcagaaactttaaaaaaaaatccctgtagggataattctagaaaatatatgatacaaaaatatgatgcatgcatgctgttagttcaagaaatggttgctattgaaccatactagaagtatcagacttctaggccattctagtctagaagcaccagactacgagctcctgtgtgcagaagtgtttgacactctatgcatcactttctggtctaagaggtccttgcaaactcatccatttttgcatctgctgtgtgcctgttgctgagttctaaggaattgctagtttctctagtccgttttggacaaaacctcccatgaaacagtcagcatgtcatctgccaagaaggcgcgtctcccccagaaggaccctctctgccctcagcagggctttatgacagcagactgtcactgcatggttggtggagggaatccgaagattggggtccagggaaataggaggagacaaaatggattcatttactttttgcaccttttgtagcaatcagcattttttggtttgttttcaccttggtctatggccaacgatcctgtgatggtgtcctgaggtgggtactgtttcagcgtggtttggaggtgacgggacattgtcctccaccagctgctggtcaggtcagaccttcttcaaggcgctgttggtgtgagattgaccatgggcagagggccactgagaaaaacaaaaactaaataagcaggacctgatggaatccaaaacctccctttttagcttataaatcaatttaaagttatttaatttaaatgggtaaaaaatatatgtctgtctgcatgggtgaggagacaaacctatcaattcaaacaggattctgatccactatttttatctggtaggtcttctttcatgatcatctttgtttcacaactgagtgcactgtagtcaatttaacagtaaatatttttgctctttttcacctctttgttaagttgtagatgccaaatgcataaatgactggaagattcacctgtgatatacacggtgctgttttatgcataaaagcagtaggaatgggcctctgtgtaaaacttcaatgcccccttatttttcccacaatgaaagagatgtcttggaagaactttcaaggcttcttgcccgcactctttcctggcctgtcttaggatcccgcagaccagcctctacgcttctgttcatgctgttccactgcctggccctccctttccccactcactacttggagaataatcattcaagagcaaataaaacatcccctctatctttccaagacttctttcaagtaaacaattactccctaatctacttctccataattttatttaaacttctctgctagttattatcatattatgggttaagtatagcaattgatccccaaagagagcgaattttctggggcaaaggactctgtgggtcttatttcggtctgtgacttctagcccaatgcctggccccaattacactgtggcctatggtggcccctagctcttgctgtgggtttaattgtgggtggatgctcatagctgtgacttttcccagactcatctgtttctttcctggtgagactttgccccaagggctgctgtgagccaagcgtcttccgcagtcttccctccctgtgttttgagctgttccccagcctctcatgacagtgctgcatttatctcactgttagtcagtattctgaatctgcaatcaccaccaaaacaaatgcaccatctaaattactgttatcatctaagaacttaagtttatatgcaacaaaggtatatgtgtatgtgtcaaaaagtatccctggagaagcaggacttttgatcctgccagactaaacaaattctttgcactgaaggtgttatgagaaatcatgaaatcccaccacctacaaggttttcttggattttcaggatatcggtattggccaccacttcttcaagagcctcacacgttgcctgctatgtcattcggatgctcttgacccaaaagtgagactctagggctaaataaacagcatgcatatcccaaagcacaaacatgaattttattagtagttaaaatgaccacaatggagatttgaactttaacagtttcttctcatttcagacaaagtagatattaatgataaatatctaggtatacatttacatagttaacatgtaaataatatgtgagtaaaatagcactaacctccaagaagaaaataatacccacaccttcagcgtgcctccttctagagagattcatagttacaacttacatctgggcatatatcctttcagatgtttttctgttagaggccatatcagacagcaaaattcataaggtcttatagttagtaagtgtatttccactgatgtagaactccggtctcttgagtcttcagaggtgggctccttgtattttatggggctctcatcttcagggtgctgccttcctccccatggtcacgattctggctcttcacatccacagttcaggagcagaaatgggggaaagaagacaggagtatcctttcctttaggaccccacccagaagttgcacacatcactgttacatccctgtggcctagactggctcgtagtggcaccagagctgcgagggaggctggggattgtagtcttttgtgacaactatgaccctaggtgaaccttgggcattctcttaataaagaaaaaaaggcatgtagtggcccattcagggtgtgcagtgagtagggggctctccttgtgaggaggagtctcttaccagtgaaatcgtgtagcattgtctgcacatggtagtgaacaaaaacccaacttgtattcatttcattacctgtacattccctgcaaagagtgcagcctcttattacctgcccccaggtgacagcccccactgcccactttggcacaccactgatgggcgggaaggtgtaggcacaagtctgctctatgtcactttgctgaccactttatgacagcttatcatttgacacagactgacttttttccttgccagtaagcagttcttcacactggaatgaggaggagctactgtgaattccatggtagaggaataccatgacgtggcgaaccaatcccctattcctagaaaatcaggttgcttccaagtttgtactaatgtaaactgtaatgaacatctgtgtagttaaatctcacctacccccttaatcacttcttgagagtgcattcttagaagtgaaatagctagaccaaatgcatgcttttaagactctcaatacgcaaaccagaatttatcttaatcactctaaatgtcagtgacagtttctgttcgtggacttgattttttattatcacttcatgcatctgctcctcatgacatttggatgctcctaggctttcatttcctaatatcacaggttgtttttctttttcttccagacagttttcattttctcattagtaaccatactctttcttttgccgcttaatatcatttcctttctaaccatctgcttctttcagctgccgcccgttcctcttggctggttcgagtacagtctccctcggccttcacctcaccatatgctgggagcttgttgactcaaggcatgatatttcatgtcctggaagcaacatatctcatgagcctgcaaagatcacggctgtgcatttttgcgcagcaactctcgtctgccattatccatggatgaaccatattcttctacttctttctcacctctagtggaagatatagcccatcacctaaaagtgctgctattttagtttcagtgagtttatagacttaaaactctgtttcaggtgtctcgtttagttttcttaattgtattttatctctcagccttccacaccatcaatactgtcttttacaacttcaccagggcctctcggcttcggcactggtcacatgtggggcagcatacctctctgttccagggagccggcctgtgcattgcagggtatttgccagcctccctggactctacccactggatgccagtagcaccttctgccacagccatgacaaccaaaaatgtccccagacattgccgcttgtccccctgggtgttaaaattgccctggttgagaccattggactagattgtccttcgaaggacatattaccaaacatataaaccaagaccacaggattatctgaaggaggttggcacgtcagggacaaagcccctttagaaggcagtaacagggacggccatgtcccaggtttccctagatgtggatggcaaattaggagcagagagaattctagatgagcatcagtgatgccccagttggttccatcacagtgactttgggaagggacaggcaggcccagtcatatggagcagccttgacagctgtcttctgtggggcacagcacagtggccggcctcgtgatgccagtctgtggagtaggcagcatcaccagcttcactcctgagggatgtgtgctcaccgggccccgtggccccccacaggaggaggtgcatcagcaaggctattcctgaatctcttttgccctaacgctttgttcagacagcacctcatcctgcctctttaatgcgggtttctaatctctcaaatgcaaagcccctcctgtcttttgcaaggagagcctggagacaatgcagtgccacataaatacagctaattagccatcaactctatcccctctttgcacagcctcagcctcagctgcagccgaagtcttctgaacagctcctgggggattcagacacccgcactaccgttttctttgaaattcctaagaatcaacacaaagaatcatttctcgctggctttttacagttaactggagtttttgaatacccatcacctctatccttccacctttaaccccccaaaagctggaagtggccatgaaacactgtaaaggcaaattatgtaataactctgctgttcaaagcaagccaagcaagagtggcagacggtggatggacttgggtttttattgttgctttttaaagtacatagtgctggctgcagcttaattaaaccaaaccctgcttgagagaacattctctgacagtttacctacttagagccatcttctcttcctacattttgcaatgtgtgacttcccctgagaggaaagagtgggatcttaaaatcagaatgtttccctgatgctgcagatctgctacctttatcttgcagcatctctggtctgttgtttatttcactgaaatatcttaaaaaatgaaagtgagcctgcacatatgtaatgactgtgatgctccctaattagtagagaaatctaggtgatagaggtgcattccgctggtgaagccagccttttctgtttatgttctgaagatacgactcagcagtaaaaggtcttttctgcacacaaacttgattggcggagactgtatgaagcctgtgacaggtggaaagaggagctgtgtattttagcacttctcctgaaatggaaatccttctccatactccctgactgctccttgttggtgtctcctcagtacccagcccagtgcattggagatcagagactagggcagttgcaggatggctcacagagaagagtcttgtaaattgtcctgtaattcttctcattcattagggggcttttatgaatgtgataattagagtactcctgtgactctctataacttaaagaaccccatgtttacaaagtctttttttttttttaatatagtatgttgacatctttactttcaggggtttttttgttttgttttttgcttttgagacagtcttgctctgtcacacaggctggagtgcaatggcgccatcttggcccactgcaaactccacctcctggattcaagtgattctcctgcctcagtctcctgagtagctggaattacaggtgtgcgccaccacacccagctgatttttgtatttttgtagaggtggggtttcaccacgttggccaggctggtctcaaactcctgacctcaagcgatctgcctgcctcagcctcccaaagtgctcggattatgggcatgagccactgtgcccagcctactttcaggtttttatccctaagttacgtctttctcttcatataaggagcaaatggcttccactctttcattctcaaacccaactgagatagaactcttttaaatagaccgggtgcggtggctcatgcctgtaatcccagcactctgggaggccgaggtgggtggatcacttgaggtcaggagttcaagaccagccaggccaacatggcgaaaccccgtctctactaaaaatacaaaaattagctgggtgtgatggagcacacctgtaatcccagctactcaggaggctgaggcaggagaattgctccaacccaggaggcagaggttgcagtgagccaagattgtgccactgcactccagcctgggtgacagagtgagactctgtctcaaaaaaaaaaaaaaaaaaaaaaaaaaaaatcttttaaatagaatttaagccctgcatggaagcaaaagtatttaaagcaaatccaaagaaaggcttttttccttttctttctttgtaacatacacattgagcacagccccacgcatatgttatttccttcctaagcagacctttttttacaggggccattatgtatgctctgtgccgatggtgaccatatcaaaaagcatcatgtctaaatttcagcagtcccttaaccttctatcttgggaagcttgatatcctcttttttttccaaaaatttttgagcattaccttcttaatgaaagaatacatattttcaattctatacagttttagaaatggaatgacagaaactgttggctgattttttatggatattagtcatgcagttgtatatttgaagccagtaaagaaaagtgctgatacattattgggtgaagcactatttggagtggcaaaaaatcaatctattggtttgttctatgatctatgtacactcactgctttgctaccagcctgtctccaacagagctctaattctcaattactcagttttcaaacactctggttatagccaccttaatccttagctttatgaactctaaatatgtgtgtaaaattagaaatttctatgaacaagacaattcataagaggaggttcagtattacactagtgatatatcctttggtctgttttcctgttcaacagcatgtgaatgacttgcacaaagtgtaatttgaacattgaagtaatatctgtaagactcaagggatactagaacttttgcaaattttattcgttaaaatataacagatgaaaattaacatgttgcacagaattgtggaacatttatgtaactctcaaacataaggagtaaaattctgaggaggaagggatattttcattgaaaatttcccccaagctggaacaagatgaaacccagcaaaaaagcttttttaaaaccacaaatgcctctgtcttcgtgctatttctctcactttctctattctgcttaatttttaaactgcaacctgaggagtgaagatgtaaacacacacacacacacacacacacacacacacacacatatgtggtcgtcatgcagataacataataaaaagtccttttctggcattgccaccactgctgtcctggaaatactttgtcttcatgtgctctttattatatagaaaattctctctcctgacttgatgacattttacttctttatgtattctttgcatatttcaagctcttaaagagtttttggtagtaggttctcaagatatagtccaaaacgaacacagtttgcacaagatttgtaagtttagtcttgtgttcttcagggctgaatcactgtgtggtcactgcttcaattatgttacagattaagccacttgcttgccttctgataatgtcccatttttgtagatattttaggatagaagcaccttatatttaaatttgtaaatcaagtatttctactttggtgcaagagttgtatatcccatgatttttcttgaatcttcacattcgagcctcaaaagtttgcatgtgcagaattgtctcacctacatcagtctgatcctaacttcaccattgccctactaccttgttgatgttgatgagctagacaaaataatatcaagcatgttaacccaagtcttacagaatacgtccagtcatgttacagctgatggaaatctatttttaatgggcttttccccctattaacttatgatacttttctccctattaacttaataaaagtttgaataaagtacccagataaaggtctggcagatacatttactggctttgaaatagtcctttttcttcaatatcaacgtgctaaaatagccaagaatcccctttgaactccatctccagttgccatcaaagattatctgtgttcacatcagttgtccttttattccttcagattctctctgtagccattaagaaaggattgtaataaaagatatttgagagctacatagatgacatgtcagagcctgaggaaaattttctacggacttaaccatttatcctgctttattgcacagaagttagaaaaggagaacaagatgaaacccagcaaaagataacatggctactttttcctcttttttgtaacgagcatgcaaatattacttctctgtacctcttgctgttaggttagctcttacataaaaggaaaatctatccatgttgagttggaagtttcacatttttatttttctgaattttatccatttttatatgaaaataattgctttaaatttttaaggagacaagatataaaatgaaataaaagaaataatttgccatttcttgttactctagcagatagattcactaccccaagctggtctcctttgagaggccaatattgctactgctttgtcattgaaactggcaaacctacagaatgactactgtctttttctagtgcccactttctattcagtgcagcaagccaggatcaaataatgaactaggagcaatgtgacggggctagttcacttccttctttttttaatttaaaggagatgtattggttttattgataggcagttcacaggtgcaaagtcatctttgaatagttaggaagtggctttggttaaaaggacaggaagcttcccacactgagtgtccttgttataaagttaaaattgagtgacatgttcattgaaaatgacctttaatgggatgtcattcatctctgagctttacccttgacttaaactaagctgtgtcattattgaggaaaagaagacatgcagtttagcttatttcaagaaataaataatgaagtttttgaaattatttgtgacagcagccatctctgtctacttttctatttttatgttgcaaggataaaaagtaagcatgtattttcttgcagtaaaactttcagaattaaggaacttacattcagaaatatggttttgtttttcatatttatacacacacacatttatatacatgcacatatatgtatgtacataaaatatctgtaagtacatttagcatatgtcatttacactgtatttttaagtaatcattaataaacactaataagctaaataccttcatgttctcacactaaaattataaagaaattgtttattttactgtgatttttctcagaactgaatatgtgtatttttttctaaaagcatagcatctttcatttctaactttattatagtcattattttcacaaaagacaaagcctttgtgtaatcaaagatcagaatcattattttaatttttagtgttttttaaattgttaagagtaatagaacaggaagtttgaaatgtagaaaaaaaagacattgtattagtaaatttttatgataattacaggtattttatgatgcattttagttggaataatgtgcaaatcccatactactttgcatcctgctttgctcatttaacttttattgttataatttgtccaagttgctacatagtcttcataagtatcattcctaatggttgactggtattcctttgtgcgtgtaagccataatttctaaattatgggtaattaattttgaattacacattatcctattattcattagattcaattcaaagcaaacttaactatcatgattgctccaagatctagatttgcctgtagctcatgtcattgtgtctaatagactatagcagttttctctcttttatcgattctgtcatttgttagatgcaacaatagaacccaatttgtatacatgtaacaaattatataggagtttatcacattaataatgatgcataagaagtgagggcatttgttgttggtaactattatgcaacactggtagtatgcttactataaaatatgctaccttgatctttatccttcttccaaactgctcaatcaaaattaattcatctcttccccttccttcctacagcaacatgttagagtcgttcttggagagcttatccacttcttctgccagttacattctcttgcgtgcatacaccaacccaccctccaccctcgatcccaagctctcgctgggcaggaatggcttccacttttagtgatccctggactgctgatgcaatagcctccgtgcagtctatgttcagcaaatgtgatagcactctgcttttgttttcgcctgtaatgtttgaggaaggcaaagttgggaagcataaagatgttaaagatgtttgctctcttgtttttcttccgccagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaaggtatggccagttcattacaataaaaagaaatctggagttatgagcaactcctcagaaaacaatataagtccagttttgagaaatgcaactctaataaagatttctaggatgttagagaaaaaaaaattatattgaactgttttacttggaaatgtattccttttaaaaattgatcttaaaggctcaggagtccttgaagatcactacaaacagagaggactagatgtggttatagtcactgaaaatgctgtgaaatgtttttcattctattcttgtagctgagctactttgttttcagtgcagattgtgacaggttgatattttttcaaagcactatcattaactggtaagagagttaatgctcaaatacctgtgtaaaatcccatgtgaacacttaaaatgtaccgggtcccagccccaaaagaaaagaaaagaaaagaaaagaaccccttatgtttttaaagcatgggcttacagagaagaatagtattgttagttgactttggcaaacatgttaaagtaaatttatgattggagaggagattagaacagcctttttctgagtccttataaactaacactgttcctgattgattttcataacactcattttgggcaaaaagagattcaccatagtaattcattcctgagtctggtcaccaatgcgctaatttgctttgttgcataaaaaagtttgacctattagaagaatgagggcaggtggggagaataccaagagagaaagtttgcacttctgccatgcatgttccattaatctcatatcaaatcctggggtgtgggatattcatcaatcactcctttcctttacatttattttcatccaaaccatgttaacatatacacacggacatcagaagctcaaggccatagatgtcacacactcaccacaccctggcctcaacattatgtaactacaccctcccctttgcttattcctttggatgtctgccttcttgtcattctctctgtcatcctttgtttccattactacagtccaagctacagaacttccttctttctcaagtgtgccatcccagctcatgggtgccaggccctgacaattcttcctacagagctagccgctgccccatgccagacccacttcttctcctaagagtcttaggaatgggcataattagcccttttctacaccctgcccatagacagccctagagttgtacacatctcttgcttgcaaccagagattggtagagaaaagcttcaaaagcagagttgcaccaggtagacatcccaagcatagtcttacaggagcaggaaagagatactaatggaaatcacttcctggaatgaggacttacatcttatgtctctctaaatttagcgtgatctaggaagctttgactcaaatcacagttcaaaccgaggctccaccttttctgagcatggtgagcctgggcaaactacagcatatcactgtgtctcagatgtgtcatctgcagagaaaatcagggctgcctcactctacatcatgcacatcagtcacaacgctggatgcaaggatggtagcaagatgtgataggccaagacactgtatgtgcccatgaccactcacgtgctcatgagctaaaagaccctacccagctcccctgccttgcagcactaactagatgggtacaggaaaatgggctctgggcttcaggcatcagcctgactaagacacaaagatctagattgtggcaaatcaggtgtgccatcttaagatgttgtttctctctctctctctctctctgtctctctctctcttcctccctccctctgtctctctcttctttctctcttcctttatttttatcaattatcattttccttgagaaatacttatttcattatcatgtaataataacaacttaaaagtggagaaatatctttggcctctagaagattttgaatgtaagacttcaacctttcaactctatattccatatgttcaaaaagtagaaataggaaaaatatgtaaaagaacaaactcaagcttctagaattaaaatataatgcctcatttacaccatggaatactatgcatccataaaaaaggatgagttcatgtccttagcagggacatggatggagctggaaaccatcattctcagcaaactaaaacaggaacagaaaaccaaataccacatgttctcactcgtaagtgggaattgaacaatgagaacacatggaaacagggaggagaacatcacacaccggggcctggcaggggtggggggctaggagagggatagcattaggagaaatacctaatgtagataacggttgatgggtgcagcaaaccaccatggtatgtgtatacctgtgtaacaaacctgcacattctgcacgtgtatcccagaacttaaagtataataaatataatataatataatgcctgaacaaaaattatgtggaatgggattaacagcagattataagattacagaataaaagattagtgaacttgaagacagcaataggaatgatccaaaatgaaacacaaagaaaaaagaagaaaaaatgaacagtgcatcagtgagcttcaagtgacctcatatatgtgtaaacggagtccccaaatgagagaagaaagagaacagaaaaaaatattttaaaaaataatggttgaaaattttccaaatttaatgaaaactataaactcacagatctaagcagctcaaggagccccaggcacagaaaacaggaagaaaaaataccaaggtatattttaatcagattgctcaaaattagtaacaaagaaaaaaaatcctaaaagcggacagataaaaaagacatgttaaagtacaaagaactgcgccacatctaaacaccaaatttaaggatcagtggcactaatcattcattcatacaatgattccttctgagctgctaagactgtcctctagaagagaatttagtctgtacgccccttatgggcagaccaagccccatttatctttctgtcccactgactacccctgtgattggctgagcgaaaaaattcaaatgtgattatttttctcaattactatccatgtctatatgtcttccttgagggttgcagtgttttctatttattaatgtctactagtcaataagaatttggtagcacatattatgttccaggccatcctcagatggtcacattttatgatattttgattctttggttcagctggcaatatactgtcaatacaatgtaaaattgatagaaagaagttatgagagaaccattttcttttcagtgttcagactgaacaatgttttgcaggttgcagagctcagtagcaaagggccagttctgcggttcctactgtgctgagatttccgtgtaagtttgcaggttccgtatctcaggggcaaccagatcagctgcaagaactgcttagatatgtgtggatctttaggtgtgtagagtaagaaaatgacaagtttaaaaagcatttactatttttatattttaagagtctcttctactttacataatgggaattatggaagaagtatgataattattcttaatattttctggcaatagcctcttactgtttccagcacaataaatctgtgcattagttcagcacagttattccacatatccagagcgcatttctttggtaaatttctctactgctaagcgagtagagaataataggaaaatggcagaaaggtctagaatagccaaagtcagcataacagaagctgttctgttttagacaaagcttaacaatgacgaccatagatttccctgtccttatcggaaatcaacatgttaaaaaatgcaagaactggccaggtgttgtggctcacgcctgtaatcccaacactttgggaggctgaggtggatggatcatgaggtcaagagatcaagatcatcctggccctgtctctattaaaaatacaaaaattagctgggcatggtggcgtgtgcctgtagtcccagctactcaggaggctgaggcaggagaatcccttgaacctgggaggcggagattgcagtgagccaggatcacgccactgcactccagcctggtgacagagtgagactccatctcaaaaaaaaaaaaaaaaaagcaagaactcttgtaagcagacacatagaccatcataaggagggagagtagatactgtggtggcaaagagaaaagacagaggagttaggaaaactgaatataagaatgcaagaaagaaaaactgtcagagaccatttaatgtcatggctgttccatctactctgcgagtcataaagttggccctctgtcatcaagaaaatgttattactagtaattttagaagacagaaagcatttgcaaaagatttccatcccaatggttaaagtaggattttgcctcttaggatgtcagtcttgcttatgagaagcgctgcttccctaataattctagataatgggatagttctcaggcatgacgagaggctgataagtaatatttgggagtaattataaatatgtacatacatatataaacatttcttatcaaaatacaagtacacatatagggatcagtcacattatcatcatcttttgtataatatactattttgccatgtttcatgggaagagcaagtggacaattcttagggaagatttcagaagattatcatgaagccaagcaatgatgaattattataatttcaagaagacaaaggatgagttgtccagaaaccaaacagataaatccttacttttaaaaagatgatttcagaaaaaagtattgaattattaaaagattgagttaggatacacaacagcatatagtgttaccatctgaaatctagaattcaaagaatgcatttttatagcaactgttaaaatttagtggtatttctttagtgttcttaactttttatgacccaacaaaaacagaaatgtagaggtaaaatactataattttgcatggagacagctttttatagacctcatcatctaaaacaataaattctctttataggaagatcatgcacactctttttctgtgacaaattgactagcaaactagatattcataatggccctaaacactttttaaactttaaaacactcattacttggtttatgagcatcagaaaaacataatgttattatggcagaagcaaagtgataaatgtttttcattgccaacatggacttcagttacctttttctcatttatagtacagtgattttgtttgttgcagactattaaaacaattgggtatagtgctttgaagatttccaaaatgtgaacgaatgttcttttaactcccgtttatggattatttctattgtacttgagctttctgaaaacccaggatttgaactgtagaaatatatctgtacttgctatgaagtcaaacattttaaaatctttgtacactcagttttcctcctaaagtgtgactcttttcaaagcatctgttatttgccatttattttaaaaataagacagaacaaagagagacttggatgttaatctattaatatttaatgagctaacgtaatagcaacatggacttagtgaagaaggaaacagaatctctggccgtgtgccccaaatgaataaaaaatgcaagagaactgggaaattagagacttgtccttagagagagagataacagccttgagaaagactgactttagcatagcttagtaggtagtgtatcatgtaaaagtgaaccagggcagattagtggagtctatcaaacgcaagttaagaatcatggtttattgtctaagacaaagtgacttgtctttgttctagttaatggtgtgatgccaagctttagatttaaatgtaaagaaacagagttttgaaagactgtgatgaaaatacaacgcgaagcatcgtgcctcatcaattagaaactaggccagtataaacacagaggtgatcagagcaccctgtctagtcagcagtgtcctggagatggtacactcagacacaggcaatgaccagtctgttgcaggacaagaacagacccactctgtggagcaggagatgggaggagcatggccacaaccaggtcattggtcctaatcacaggactcagtgatttcttccctgcaagacccgggaagcagcacggatagcaaagaccacatctgtgttgcaaatgccacatgcatccaaatcgataaatggagaaaacccatttttaatagttttgcattaattttagtactgtcattggatgatctgatttctaaagttctaaattacagaactttaaagttgtagaaacagctgaaccagagggatttccacttccagccaagatgccaagatggaatgacaaggttcaaatttacctttcttcaaggaaaaacaacagcaacaaagaaaagacatatgtgaaacattggggttttttagtaagacactagacattagtcagcaaaggacaatgatctctgaaagacaggaaacaaaagaaggtgagtcctctgattgtctcagctcaccaccttgagagagagtttccaagccatggtatgaagattgagggaccagggggatctcggtagactcactgtgttcaggagatggatcggggaatcgggagatatcaaagtgatcagagttcataggacaaaatatcaaagaggagagagccacacatagaaccctagagatgtgcagaggactccccttaaatattcaacagagaactctcagcacatgtgtctgaggcaaatacccaaggctgggaaagaaacacctgaaattattagggagaatgaaatcggacactcatgtgggggtgcatatagtgcatgttctcaagagccagagaagaaaatctcataatccatgggccactggggagaatagtcagtagggtcttgcctcagtacagaggaataattagccctggactaaccatgctctagtctttcctatcaaatcttaaattagacccaaaaggatcaacagtttccaagtaaattaactgcatcctagaacaaagctttaagatacccgtaggaatacaaaaatattcagcacccaacaaattaaaattgagaatgtctggcatacaactaaaaactatcctgcaagtaaatagaaaatgcaatccataataaggagaaaaataaataaatgaaaactaagaactgacagatgttaaaattatcaaataagcaattattataacagtattccatgtgttcaaaacattttaaaagttacacatggaaaatgtataaaagactcaaataaaacctctagagtctgaaatgcagtgtctgaaatgaaaaatacatggggtgtgattaacagcagtttagacattgcagaggaaaagatcagtgaacttgaagacaatagaagctatccagcatgaaacacagaaagaaaaaagaaaggtacagatcatctgtgggtgtcaagtggcacccgctatatgtagacagagtaccctaatgagaggacagagaaaggaggaagagaataggaaaaaatttttgaaaaaataatgactgaaaatttcccaaatttaatgaaactcatacactcacagatcaaagcagcttaaacagcctcaagcacaaggaacatgaagaaataaaaccaaggtgcatcaaaatcaaactgctcaaagtcagcaataaaaagaaaatcttcaaagcatccagaggaagaaaagacatgttccacacaagataaggaagaccgcagatttcttatcagcaacaacgccagtgagaagacagggaggcagcatctataaagcactaaaaaaaaaaagaaaaaaaaggctgaacttactgggctcaatcatatattaaattgacttttagtttggtgtctagcagacacagcctatccctaaagcagtggtccccaacatttttggcaccaggaaccagtttcgtggaagacaatttttccgtggatccaatggggcgaggaatagttttggaatgaaactgttccacttcagatcatcaggaattaaagtctcatgaggagcatgcaacctagatccctcacatgcacagttcacaatagggtttgtgctcctatgagaatcaaatgctgctgccgatctgacaggaggcagaactcaggcggtaatgctcactcacctaccactcaactcctgctgtacggcccagttcctaacaggccacaatactggtctgcggcccgggggttggggccttctgccctaatgggaagtcctagtccaccaattgcactgagagcacttgtaaaactacctgtacatgaaacccattttcagcccagtttaagacatgggctaacctgtcacctgagcagtcaacttcacagaggaattctaacacaaaaacttagatgaaattgacacagcatgatcacagcgctatggtggctccggacatgccacctcagtattctgttcttcagtcctggagacaaacaagtattcataagccctgagtcaaaggttccagcaccacaccaggggcctcagaatgaagggatttgtttggctttagaacacactcccaaaggagcatgtaaccattttatttatctatctatctatttattttttttgagacagagtttcgttctgtcacccaggctggtgtgcagtggtgggatcttggctcactgcaacctctgcctccctggttcaagggattctcctgcctcagtctcccgaggagctggtattacaggagcctgggccaagcccagctaatttttgtatttttagtagagatggagtttcactatattggccaggctggtctcgaactcctggcctcaagtgatccgccctccttggcctccgaaagtgctcggattacaggcgtgagccactgtgcccagctgtgtaaccattttaaaccctagcagtcgttttgtggaagtggttagaattttttggccctgttagtaatttcagtggctttgatcctttttgcatagttcccctctgtgcagaatgctgttgttaaatcatcagacttgatgctgtaaatcaacctgacatcttttttcatcaattaaacagtttaaaatctccaactgtgggccaaaaaagacaagacaattgagataaatagatgaatatgactcggtctcttcccttacaatatggtaaacatgtaaacaaagtgtctacaaaatccattacagatgctgctatagcagtatgtgccggcacagggccatccatgaggttgtttttgcaatgaagtggaggaggtgaggaagcacacttccagcattgcttgttaaagccttagggctagggttccatgattgagagtttattttagtacactagcatagtatttaggagagtgctaactgctataacaaagagacccccacataggcaaatacccaagcgagataagttattttctcctgatgtcacagttaagagcaggttaaggcagaagttcccctccacgaattaattcacccaggctgatagctgttctgccatcttcaatgtgtgacttagaggactgctgttgtcatcactatccaccagcaggaagcaaaaacaacagcagcaaaaacacaagttcataacaacatatgttctcttatgaaagtcaagatcacagctctatgtcccttctcataggctgggctcagctcctagcctctagtacacagatgtcttcataaactcatcccctaccagcaatcaataataatttgcagtaaggtcatctaaatccagatccaagaaaaataagattctgtcttctgaagaatttgctaatatattagatttatactagactattagaaaataaaacacactatcttagtaaaatataattgcactgtagttaacttactacctaagacttcagcaaaaactttgccttatagttgcaagactgaaagggcttatcaatagggcccctccaaactgtgccctaaagatacatttcagatttctccctccccatatccaaaagaaagaaattgcttaatattccaaaaatggcatgttttctggttccaaaagaaaaacatgaagtccagatcacttccacccatgaggcactatgtttaaagagaaaaaaaaatatgtagatgaaaagttttctgacttagtgcctattaacttagaacaagaaacaactgaattaattttattttcctaaattggataaaaatatcaccaaatcttccatgtctgtgaatgtagtggctcagagcctgcacctctcaaccaccactcttgtttagagggtagtagtgtgagcagtttcattttggacctccactgtggtcagtttccccttctcaatggtgtattcatgcatcactgttactaaggaacacacaggggtctcagaataagatctgaggcagcctgagtctcataccatgcactgtctatcatttaacagggttgtatttagttccccagaaggcatttctagataccagttgcacacaaggatgacatctctaatatttgattacatccacagtaaaaacaaacaaaaaaccttttcatgttcagaaagtttccttttttaaagaaattttttaattgaaaattactaatccttgagatagcttgagagttggggaatgagtatgcttcttccaatctcttcagtgaatgcttcctctgggtcacttttacttgagcttgaccttctttgtttgttcttactacaaaaacacatctaaatgttttccccccaggaaattatcttgcctgtacattaatattttgagcattgcataaacatatgggctaaaattcagtctttgccctaacttgacttagatttttaaaattcagacaaagaaacaacagcaacaaaaaacactaaacatgcaatagttgccattgccttaaccaaaatttgtgcttattaaattgatttatttctttactaacagaatggaattcttcactagtcatcttgactagagataccagttttcaaaatagatttagaaattttgaaaacaaagttatgtaaatccataacataactctggatgtgaagagccaacacctgacttctatatccattgcagagtaaccccatcatttgaaggaccttgtgctaataccaccccattatttcataaatcctagagcaggaaccaagcacagttcctttccagctgggagaatctggtaattcaaataataatccattctagacagaataatctggggcatacagcaaaagccatgccgtttcctaatattttatgcattgtttttataataaactactggtaaaaataagactaactaaataagcttttcagtgcaggaggtgtttcctaccctcttgtcatgggaatgagacaccctggtattgtaaataaattcagaaacaaatttaggaatcacatgccatttgtaccaaattcattgtatgtatttttcattggaagagtttggttttaaaatttgactttaccttgttaaaagaaaaactgaggatatggctaatttgataaagaaaattaatgcacaaatgattatttaactgaaaatcatttaattgcagactatacttctaacacaagagtacttttagaatatagagaattattcaacaaattcagaattttagcactataatggattcagcctcagaagagaatatttagtacttaaaggaaaacactgtcattgtaatttagcaaattattaggatttcaatgaggaaaagctagttaaattatagtattaatctcctttcaggaacaaataggccttcacagaatcacctcagtttcagcaagggggaactttttggaaaaattatgaccatcagttgtatttatagctgggctgggatttgtaaaagtcaaatccctggaaatccacattagaatgagacagtctggccttaaagggttaaaagatactgacttctccttgttaccaaattctcaatacatacaactaggaatttcatgggacacaaacttgtgtgcaagtatctttgttaatttacttcaggttcatctctgagccctcatttgcctgatgccaacaaatagaaaggaaagaaatgtgaatctcaacatttctaggcaaacccagtcaaattcagctgtttcccagtcccgtcagtctgcaagcgtggccacattttacgttcctcaccttcatcctctcctgcccctgcagttggtgctaaacttgggggtcttacaggtatagtcccgcacagaggatgggggtgtggtgtccatttctcagtgtagaatcaactctgttctatgcagcctcttctccaggacacacatggacgtggtgattggtgattggaccatctccggtccagggtcctgtcttggcccacacctgcctccatcccttttgagctcccctgaaatccaaccacctcctctccttaatccagagaggcaccgtctgctcccaccatgtgctccactgatgtgtctcctcccttctggccaagtaacccctctgcagccctgggtccttcgtttctcctcctcagctaacctacacaccccacccattcaagaacaccctcagcagctaccccttgccacactggggctacacgaatcctcccagccctccccagcccagcaagccatgtcactgttcctgccctgtggctgccattctgggatggtacaggagacttcactgagtcttgctcagccactgcagtcatcctagaagagcagccaaactgtggagtttccattctcccatcttcaagggggatgtcatcctcagtcccccttatccatggaggggggcttgtccaggaggactccagggatcagctggcagcccccacagtgctgccgcatctcttgcttcctctccaaactgcatcctttctttccccagcatggaggctctgtattgactagggagagggcaaattattttctccctgttccaattctctttcaaatatattccatcttttacctggatctgtgccctctagccttagacaatacatgtttgctgcttctctgtcccatgctgacaacacttctttgggtcaaataatggcctgagcctctccccaggaagaggagtgcaaaagctttgtcccatcacctgcaggaagggatcctttcctgacacaagcgagaaattccaattagacatgacttcttgtattggacctactaaatctggacaaattggtctcatttactgtgataacattggaaatcttctatatacacacaaacatacacataactaacctttcaaaatgaaagctattttctatgtctcaataataaaaatatcaaatctattgtctggttatcctttctttcttagggaaaacacatcactgctcaccagtttctcgtatcaaaaatgtgtttctatatcatccacatttttggtcctaagtagccttttttgttattgttgctctcaaatcaattcccagcaaagctgaaggattcccattattctccaaataccaaatcaccttttcatccagcattggggggtgtggctagtacctggacttctaaggacaaagttatgtccatttattcttggctcatttcagatgtggccaggttctcctctgtctgtgtctggaaggatggagggaaaggctaggtcatatctgggagactgagcatggaggattaaaggagaggggatgagatgatggtagagggggtataatgtcagcagcataaaaaaagacagatatgaagtaacaggacccagagtcaagggcacaggtgtctcctgtgggcaggttattgaatatctttgtgcctaaatttccccctgtataaaataaaaatgctgacctccctggagtttcaagaattagaagagatctcaaatatataagccagtcgcatggggcctgcaaagaagtggtatggtggaagagatgaactcatcttccccagttcatctcttccccaccaggctgagggcacttgcatcagcctgcctaagttgccaggagtacccctgccatctcccagaaggtcaagaatatctccccgatgttgcaagttattgttgatgttccttttgcaatatgtcattgttgaccccacaccctgatttgcattctcttcctttttctagcttctctccttagttttagggaagatcccaggattaagtgggctgcataagctcagatttccaggcttttccaagctggggactggagactcagcagggcacaaggagtaggggaggcagatgtgtccacaggaagtcatgtttcagcatgtcggttaaatgcatcgatggaaattggcattgtaccaggagaaagggcttcctccctgggaggggatatcagttccggattcccacatcccaagaagcagtttgcaaacctcaatgttttgtcatgtctgacacttcctaaccttccacttctttgctccctgaaagtggagctgtcaaatagttcactgcagccaagagatgctttagtgagctttacctgctccctaccccctcaaggcttcctagagcttgaggtacaaagtagaggtgagacaaaagcatacagtgtgggttgatggtgataagaaactgtgtgaatgtgatttctaatgtaggacaggatgaagttgtttttttgatttcatatttcatgcagggctgggctgaggatgtggcaggcatggcatatgccctacgttcactgccagagggggctccctgcctgccacaggtgagagccagctctggggtgcctgcccccatgggggaaggggggtggaggtggcctggtggggggactgggtgggaaaggactggtccccaggaggaccctaccacagaatccacagcctcattgcgtgaatgtaattttcttaaatcaaaatgaaattgcaacaggtaaaacccttacatttgtgaatttttatattgtactctcttctccaggacactgtagaagagtatacatcatacatacaaatgtctgaaaacgtgggcctgcattctgttaagtgaatgggaatgctttatcatcctgatattgcaaggacattttaatatgacgcattacctgtgttccattaaggctgacgaccaccaacccaaaacaaatttcatgtcctactttataaagaagacattgaattatggccctgaacattatacagtttaaccttaatgttttttaaaaaacattttaccatgtgcactcttgcttttcaatgtcatatttacatttatccacccctgcctatttctgactagttgactctttattgttcagcaaacgacttattgacagcacgttcagcaactcacctgtgtgccccatctccaaattcaaagctgtcttgagaaatcactcccacacaacccattctcattttctactttttcagggttcttgttttatttctctttaatgtcactggccacatccgcttgtcccaaacctctgtatcttgaagcatcaagtatacgcatcacgcaaatggctttcaacttcaagtactgaaaacagtgtcacaaaagaaacctaatgtggttcactgattaaccctgaaatctttgtccccaagttgaaggcaaaaaatacagttaaaaagtttaaatgcatgtctaacgtattcaacccattctacaactaggtcttggtaattcaacctttttggctcctgtaagcagccgcctgaaaacgcaaatgtactatttgcatgcagggtttcttcctgtttctaacgcccttcgccttccctgtttttgcagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggtatgttctccctgattcacagtgtctcaagtgttaagtgaaaatattttctctaggggtaggtgtggttgaacccgtatgcatagcctatgcttacacagaagccgtgcatttattagcagcctcattttttctgctgtccttctgatttaaatccactgcactgagtcatcttttagaatttagaggaaaatgtgatgctcgttgacatttctaatccttgcaaattaaaaagaacctcaatgctcggcacaggataccgttgtctcaatcctctgaatctctgacaggctgtttgtttgtttcccatgcagtgaactgaggaattctgataggattacttttcttcccctctctattttaaatttattttggatgagaccactagccctttaatcctattcttttaagaaattatctctctttaatttggtattcaagaaatacagaggatcttttattaataaggcacaaaagaggtaatacattcacctgtctattcaacaaaactcatggcctgctttgttccaggcctgttctaggcccagagattaaatcaataagcaaaacagacagaaagccctgcccttgtggagtttacattcaagagaaggagatgttcaagaagcaaactaaacaaatgaatcacaaaatggagctgagtaaagggtaattagtgagattgcaaatttctttttaattgagatatccacataacataaaattgaccactttaaagtctaccattttagtggcatttagtatattcataatgttgtacaatcaccacctgtatcaagttttaaaacattttcatcaccccaaaggcaaacactgttcccattagcaatcactctccatcccccttctccagcccctggcaaccatcaatctgctctctgtctatggattttcctattctgggtatttggtataaatggaatcatagaacatatgacctttgtgtctgacttttttcacttagcataaggattgtgtttctttaatggtaaactagtaagttataatcatagacattcatgggacacaaagtgatgttatgatatacaggttgagggtccctaatccagaagtccaaaatcctgaaatgctgccgaatccgtaattttttgagtgccaacatgatgctccaatgagcatttccaattttgaatttttaaattagagatgcttaactggtatgtattctgccaatattcccaaatccgaaaacatctaaaatccgaaaacacttctggtcctaagcatttttggataaggggttctcaacctgaatgcatacaatgtgaactgattaaatcaagctgattaacatttcatctcttcaaataattatcttatctttggtgggaacatttgaaaatttactcttagcaattttgaaatataaaatacattattattaactgtagtcaccttgttgcataataaatctcaaaaaatctgttcttctcaagtgaaactttgcacccttccaccaacatctccccattcctcttaccttcagtctctcataaccaccattctaccttctgcttctacaaagcatgtttgtgtgtgtgtgtgagtgtgtgtgtgtgtgtgtgtgtgtgtgtgtgtgtgacagggtctcatgtgttgctcaggctggagtgcagtggcataatcttgacttactgcaacctccacctcccaagttcaaacagttctcctgcctcagcctctcgagtagctgggactacagacacgtgccaccatgcccaactaatttgtgtattttttagtggaggtggggcctcaccatgttggccaggatggtctcgaactcctgacctcaggtaatccacccacctcggcctcccaaagtgctggaattacaggcatgagccatcggcacccagcctatgcttctataaattcatttgttttagattctacatttaagtgagatcatgtggtatgtgtacatatgtaagtggctcatttcacttagcataatgtcctccaggttcatccatgttgttgtaaaggacaggattcccttcctttctgtggctgagtagtattcctttgtgtatatataccgtattttatttattcatttatccattgatggacacttagattgcttctatacattaactattgtgaataatgctggaatgaacatgagagttataaatggttctgtgacatactgataccagatcctctggatatatacccagaagtgggattactggatcatatagtaattctatatttagctttttgtagaacctatatacagtttttctaatcagtacagtagtggctgtactaatatacattcccgctaataaagtacaagggtttctctttctctgcatcctcaccaacactggtttttatctttttgataattactgttctgataggtgtgaggtgataacttattgtggtttgaatttgcattgcttagtgatattgaacctttcttcatatatgtgctagccatttgtatttcttcttttaagtaatgtctattcatatcctttgtccattttttaatcaggttatttgttttcttgctgttgaattgtttgaattctttatatatttttgatatcaacccataattatatttttggttactaataatattttctcccaatctgtaggttgtctcttcattccattattttttttctgtgcagaagctttttagtttgatgcaatcccatttgtctatcttttattttgttgcatgagcttttggagtcaaatccaaaaacattattgcccagaccagtgtcgtatagcttttcccctgttttctcctagaatttttatagtttaggtcttacatttaagtcttgagtccatttttagttgatttttctatgtaaaagtctagtttcattcttccatatgtggatatccagtttagggttgtgattttcaatgcgaggtcaagataggggtggttggaaaagtaacactagagactcaaaggagatgagacaggaagccatgcaggtatttggggggaaaagaatccagggaaaaggccctggagagggaactgggagcaggccagtgggctccaggccttcaagggaccttgtgtacctggcagggcgagtgttgggagccaaggtcagagaggccttctgatgcctccctctgtaggtgggaagatgccaaggccaaggctgattgatctcctggagaaagatgaatctactgaaacctctcagaggatgacacagtccccacaggccattggtctggctggtaggcatctggtgttagggatatcatttctgtagggtcactagtccaatgacagcatgaaatctggcagcctgaatgcagggaacagaagtcagtaggtagcatccagaggctcagcagaagggagctggaccaacccccgtggcaagggtgcaggtgatcttgggaactgggagaaattaggtgacaataggcaaagagctcaagattccattcctggggcaactggaagaccaagtgtgactccaaattgcagacaaaatgtttttatagttacatggttctttttcccctatccaaattacagatagtggtatattaagccttttatgacctgggaagcagccactttttctcctgccatttcacaatagccatcatatcctccaagaaaaaccataatatttgcagctcttcagccatttatttattcactgcaaggccaggctgcaaatctgtgtctaacagattcaccatacttgtaattcattatacagcgggaaataagcttgcaacttgctatttacacttagtttgcatttaatttaagggttatctgtgaattgtgtagatttggtatatctaaagtaggtcgttagctccaaaggtcaaggtactcttcccatatactcttttctttttttcgttgcacagttgtttcagacaggacagcactgggattcccaataaaatcctatcccttctctgaaaaatggagaaaaaaatcaatagctaatcagtctactgcctggatactaactacttggtattgtgtgtttgtgtgtgtgttttttttcttttggtggattaaaatataacaaaatagtgaactattgattggtttgacagctcctaggcatctcttctttctcaaaagccagttatctagtcttctctcggagacaggaatatttagaccactatactgcctgtgttcaacgaaacctttactatcaaatgtcaccagatgggaaatgaagccagtcatttgaaagtagaagggaaaatatctaagtcacaggctttatgaaatcaatatttttttcttgactgagaatagcagaatttgacaagaacaacattggattgtatttaagagagaggaaatgcgacttttgctaactattttactttaaatactgtacccaagtggtttttgtaggaaaatgctatacagaactttatacacagaagaaagctgcagtgactttgagtgaagaacaatgaaaggttaatcttggacctcctctcctctccatcacctctcacagaaggctagggtgacatcatatggtttcatggcattgaagatcatctgtattctggtgactccaaacaggtatctccagcatgaacctcagatcctgtgtccaactgtctgctctatcctctccactggatgtcttatgagtgtctcaaatatagcatgtccacaaccaaggtctctcccagacctgacccttccatagtattcccccagaaaatgaccagttattcttgcagagacctgggacagacaccttggcgtcttctttgactcgtatgcaatccacctcatacctaatctatcaacaaatctggttgtccttctgaattttcgcagactttaacacttctcttcatcttcattgctttctctctggtccaaaactctcatcatccctctcctggcttattcctgagcacccccttacctagtctccctgtgcttccttcaccctagatggtctcctattgcagtggcaaccagagttatcctgttgaaaccttagtcagagcacgtcactccttcacaccaaaccctcctcatctcagtgtaaaatcaagtctttgcagggcagatgtggaagctccctatgacctctccaaccccacctagtcctctggaaattaataaattttctgaggccactggttgactgtgattcctatattacatgctctgagatcctgcctcagggaatttgaacttgctgcttcctggagtctcttcctcttggcattcatgcagctcagtcctcacctcactcacgtctttcccagagaagcttttcaggccaccgtacttaaaatcttaccctcagctcctttccctgcttaattttctccacagccccaattaccttctaatatataatgtattacttattcatcttgttttatttccatctttccccactgtaaggtaagcctgttaagagcagagagttctcttatttccttgctggcatatcccatgtacctagaacaatgcccaatctgtagtagggacttaataaatatttgccagaaaaaaaatgactgaaccgaatatttcctgcttgtcgtcatcttaaaatgacctccaagtcagcaaaacattaaggaaattaaataaaacattaacttaaaaaaggggggttttctattaaaaaagccaagaatcaaacagccagtttcttttctctataaatttactagatgcatgcagacactcaggatttcagaaagaatccctttcttttccatcattggttctggattttcagtttaaaatagaattcttcgtagatcattcttttaatgagaggttgggggaagcagactccacaattgcagctaaggaatcattcatctttcttagactccattatcggggaaactctaaataggctattgaacaataatcaccctatcccatgaggtctaatgagaatcatacagtagcactagcagaatgaaacacgctttgcctctcccttggctttccatttgggttgtttccatagttatgtgtatgtctctgggaaacagcaataagtatgctatagatagatctttgtgttcttcctactggcatagaatagtagccgaggttaatgcacatccatacatttctttgcaaccttcaaaaaatgttaattatccttctgagtatggaaggtttaaaaaaggaatggtaataattagcatcagtgaaaagagcaaacaatattgtattgcttcaacagaaagtttagcaaaatgccacccatttcggcacatggacagttcctggtgtagatggcagacacttattttaggcaaatcccatcctctctgccaacaaaacaaactcaaaccaaacatttaaagcataacatgagcttgcatttactacctgccaccaccattcaaagcccaccttgcagtggcctttcctgataaaggctactccctgcacccagagctgaagtgggcagcacctatttgataagaaaccttctcacttgttttagatttccattgtgtaattttatcctcacattgtctcttatgttttttgtgtatgcgtatgtcttccccaaatgaaataataagcaagcatcaggtgatgtatttacttttatgtctgacagtgtctagcactttgctatgctcataacaagaactcggtatgtagttgctgaatgaattaactggtggataaataacacagcgtatttattcaaagagcagatctggaggaggtttggggaatccaaatagagagaggaaggggtagagggatgtctgtgtctgtctctttctacggtgtccagagaacagaggaaagaaataaagcttagatgctctctcaaatccagactctaatcaaactcattctgctgccactgtggaagaggcttgagattggaaaggaaatagtaatgctttctgtgtgtgattcaatcactgccaaaggttcctgttggcggggccaccgcatccctgcgggtactggcggagctcacagagcccctccactggctgccccgggtggtggcaacttgccacagtttccagcaggcgaaccagggctgggatgctgcaagcatcctcctagctccctgcaccctcctgaggctgaagagaaggacctatcctccgtgtcatgagcctggccctttcccagtttgccatcatcctttggcctcatccttctgtgctttgcaggactgtttccctacattctgctcccatttggatggctgcttcaccacattggggaggctgtgtaagaatcttcctttgactgacgcccccatatgttcctattctataatccacttttcacgctgggctttcttttcactttaccaactagctgagcttctgtccagccaatgccttctctccccattccaacctcaaaaggagcacaagatgggatctgactttctctggggtcagaatagggccatttcctagggggaatctgctgcttctcaaacacaggcatccaccaaccaagatggaagggaagggcgctacacagcgcccccctgtgtagtgagcattacacaactcatgttttcccacgtgaacaaaatcaggaacaaaataagggtggtttcttgcctgggagtttattattttttaagtagtaaaaatcattgctattcctttccccacatggatctttagatcatccttttcattcattctgggggttaaggaggtggggggtgggcagggggaattagggccatcctttcaagcttcctttacttaccacaatgttttaaatattcaaataatagatttgatctgcacattgtaaagactgtttccggacaaagattcctggtgatatttaaaggacgacataaaaatgttctgtctttgagtgaaaataaagactgaataaagaaaacggtgatgcccatagaattacaatactccttcctccatgccaggtctttacttagtgagaaatgttttttcctttggagaactggagtgaggggtggtgagaacagggaaaatcttcgttatatcaatactgtcctgaatgttacatataaagctttataatggaatctaggaattctaaacctggaaatactgctcttcatggaagctttgagatacctttttaaccaaaccctcaatgatgagagcatgaactggggaatgaacagatccctgcagctgtgtctccacttcaatgacaaatggttacaaatgatactcaggacatcattcctcaaagtccgtctaaattccacagtctaggattgaaacgcacctgagtcagtatcctctccatgctcagagtatcatattgcacccccactgtctgctggcgaaactgagaaacagagggctctaagaaacatttagagtcctatcagttaaaatagatacccatgtgttttcttatttttgcgtctcatgctaatggctggcacgtgacagaacgttctgggatatgggtgctccattctgggaaacagacctcttgagggtcactgatcacgtggcactgtaggcaccttctttacttgtgctcttggccctgacgaatcccacctccgtccagggaaagatacaaggctgtggaaagtccagtgcaacccaggaaggcaacgtgctgtttttagtactggaaatatgtaagttcactttattacgttgatctgaggaaattttagagacatatcttctctgcttttcaaaatatgtttcttcagacccagacagatgtcgtttttattagaacacttggaatttcaattagtattttaaaaagaaaccttatttcttagacaaagtgatttgttggagcactctctgctggtttgttttaataacttgatttcacaagccacattttagacagaaggcaagctctgtaccttggctggaactttgtatcttcagattaggtgcctatgttacagctcccatctcctaaaccccagaacctaatttcatgaatgctgcctcccttttcggtgaagccatgggttctttgttaattaacttgggacaccttttggggaattttggcagctgggtcgggaagataagaattccttaaaagggaagttataaataaattgaagagccaatcattattctattaaataagaattaatgatttgtcccttggaaatactccatgtggggaaaaagacaaaactgaaacatttccagttgattcaaattcaggacttctgcccaaaggcttagagacctcaaagagagagcaagagacggagagccgacctaactttatttggactgtttaggtgttcattttatgtctggccaaacagtttccgaagaaaagctttagaaaagaggatgcatgagaaatgaaatggctctcctcaaataccacagccaaatcttgagaatataaaaacagaaaatagacgtttgcaggataatgtttttacattgtattcccttctatgtgtggactgctatcttctctccttgttaaaaacaaaagtctcaatcaggtggaaagaaattattatttttactcttgaatactaaaaattaatggattagaaatgagtttaaacgtttaaagatgaattctttttaaaccatcctggctgatgtttgattatatttattatactggatctcaaaaaattacggagcaggcaaggacagctgtaattgggtttcagctaaaaggaaggctccaggctggtgccatcaatcagatgggccagtggtgctgcccttgggggcataaggcagttagaagagaaggaggcagacagcagggaggggacagccagcctagcaggaagggcaccgcaagcccccgggcatacaccaggggaccaggaaggagacagaagcctggagatgcagccccgccagtgtcccagtgtctgggcagcctgaggccggatatgggatgctggtctgtgacctggcatgagcagcaaccacagattctgctcctaaaccaattgcctgaagaagaaaaaagctcgtgttgttcatcctgccagactccagtcaaagggacattgagtgagagaatcaagcaattcccaacagctcctcatgaaaatgtcctgaaagttcattcaagaaaattagttgaaattcggacattgtttctctcataaccagaaagttcgtaacaatatactgtccatttgggaaacttggttttttaaagttaaaacaaaattttcctattcaatttcgtgtattataatgtacttaagcaatgtcaggtaaaatgaatggatttgaagcatagagtggcttatttcctaagcatataatagccttcaatcccaaagtgagtgtatgtttcttatcatttgatgtaggcaactgaacttcaggcagtatagcctgggctgatgcacatatatgttaatgtgcagtgtgttactttcaattaaggctcactaagactgcaacattaacattagaggttattcagtgctcaagagagatcaaaagatacaaatccctgtggtcctcaccttgagacttgaacagtttaatttattggtcagaaaggaaagttatagtgatgaaatggaaactggtggtattacattttaattgactattacctccacagactaatacccccagtgtctatgggagtgaccttattcctcttaaaatgttagaaactcactaggtttaattttccagtcaccatctcctttcttcctcagattcgaacataaaccccagtttttacttggccttcttttcccagtgatagaaatgaacagaaactttccttgttttcttttcttccttttctttatcccaagtgagtaaaccaagtgtgatatcttattgatactttgccaaggagtttcttgagttctctttactacccctcagcattttacttttcagtttcagcccatagcatgacaagcccaggacacacgcgcactctgtgggggttcctgccctctgccccttcttacccagtctgcactcccccctcccacatcactgctgccacgcttacctttgcaaggtactccagttacagactagtcagtgtttcctgatgtgaatgacacaaagtgaactctgctgcctcatttttttttttcgttttttgaaaaaaaaatttttgaagacagggtctcactttgtcactcaggctctgtcactcaggagtacagtggtacaatctcagctcactacaacctcagcctccgaggttcaaacgattctcatgcctcgggcacctgggtatctgggattacaggtgcagacgccaccatgcctgactaatttttgtattcatagtagagacaaggtgttgccaagctggccagactggtcttgaactcccggccttaagccatctgcccgcctcaacctcccagagtgctgggattacaggcatgagccactgtgcccagccctgatttttttcttagtaaaaatttttattgaggcccccaagagcctttgtgcttcttagtgcagtagatatgtctctcttccaaacttgctggaaccttccggcagcatttggcatattcacgtacctttgttcctaagataaaactttcctagtgttcttcctactcttttccttctccatttttctcccctctttggccttttcttctccactttacgtcactgctgtgtcctgggcctttttgtcctctccccctctcctctcctcccttcctcctccctcccctcccctacgcactcctcctcttccctctccatatacacactatatctaagacctctcctccattttatttcaggtcctcttcatttcttcctgcaataaacttgtataaatctgatataatttcccttctgcctgaagaaactcctttagcactttttatagtgcaagtctgatgaagataaattctctcagctttgtgtcattttgaaaatgtctttagttgcctccatccacaaaggatacctctccttagaattctgagaataatttttttcagcacttcaaagatattattctgttgtcttatggcttccattgcttttgatgagaagtcagttgttactgttgttccctgagtatgtatttttatactacctgctttcaagatgcttggtcattattgattattatatttcctctaccccatctcactttcctgtccttctgggaattcaattacatgtatattacactacatgatattgtcctgtaggtaggtcttagatcttcagtttaagatttttttattgttctttttcactttgtgctttagttttgataatttctagtaatctatctttaaactcactggtccttccatgtgctattttcaatcctttataaaggcattatataaatccttcctgtctgatattgtattttccaattctagaatttcaatttggttatgtcttatagtttccatttctctgctgaatttaaccaatttttttcatgcatgttgtccattatctcactagataatttaacaaatatatcacagataaagtccttatctacatattctaacatctatattattgtggatttgcctatgataactttattttctcttaattttcggtcatattgtcttacttctttgcaagtcttgtgatttgttattgtatgccggacgttttatgttgaaagatttgaatagactgaagttggtaattctttcctcctaaaaagcacctcatttcatctacggggttgctaaggtagagggctgagataatctaatgcatgctttaactatatctgggctttagttaaattcagcccagttgcagcccagttaaattcagtttaccactgagtgcaaatgtttcaagagcatgatcagtatttaatctaccattaggctcagaagttgagcacctgtagattccaaagatttctctatactccgtatactattgcccagttatcagttttctgagccatataagatctctttctctgtctctctgtctcttctctctctctctgtctctctgtctgtctgtctgtctctctctctcttttcctttgtttccctgtctgctgtgaagctcagctgccagctttttggatcattgtactacctatatttttcaggccttgtataattttacatccactgtctctatccatcctcaatatgtaccatttctgagttcacagcctcctttccagttggacactctctcctctgtccctacggataacattttcattataactcacttagatggctcatggcagccattttcctaccctgatggctctttcacctccttttctatctactcctaacccatcttccaagacaaattcaggccctaccctttttacaagcttctgtgagtgctctagatttatttttgccctatttacacttctttgtgttaatctgtataccccccgagtttggcacttaaggaatttaaggaatgctgtgtacaacaccataagttcatgatgactcaagtagagtagtgtcatctcctcctctaacctgatcactctttaggaacaagaacaatacctttctctatttttactttttgtgcttcttttgaaagccccaatatgcctagcattgtattaatgttgtgatgaagatacacgttgcgtagttactgttctgctagaatatgagctctgtgggaacacggacacggacagtgtcttccttctttgctactataacccccagaacggatctgttctgtcgtctagcagattcttatttttttgttgttgtttttatttttgagacggagtctcgctctgtcgcccaggctggagtgcagtggtgcgatctcggctcactgcaagcttcgcctcccaggttcacgccattctcctgccccagccccccacatagctgggactacaggcgcccgccaccacgcccggataatttgtttacattttttagtagagacggggtttcaccgtgttagccaggatggtctcgatctcctgacctcgtgatccgcccgcctcggcttcccaaagtgctgggattacaggcgtgagccaccgcgcctggcctagtagattcttattaagttgtgttgtaatgcataataggttgaagtcataatattgtggttttataaaccaaatttttattgtcatacatagatttcctaagtaatttaaatcagtttgccattataacctataccagagcatcttttataactgagacctacttaccctctactctctttccttaacttgaacacatcaccaccacaaacttataaaaatagaactacatgctttatttttactctgcaaaccaaagcagacaaaaagtcctttctaaagaacaccattcttaaagttggatgcacggtggaatcacctgagcctgacccagagccacctagatatgagtacttgtttcaaggctccctgagggatgctgaagtttgccaaggttgagaactactgagttgagtctgtaagatccatcataaataaaaattgcctgctaatcttttggaaaactgtgttcttccaatttggaaatattttataattattaaagtttaaacttaagagtatttttcctctgagatatcccatttctctgattagaaaagacaaaaaaatttgttccagaaattgctgatccaaactttatattatttatgtaatggatagttgcttctaatggaatagccaacttcagccaacattgccactaatgtcattgatccctagagtcaaaaccagcttaaattgttgcaaatactatatatagagagagtaggaatattatattttaatataatctttcacaacacacactttgatgaagacatcatgagcctcttcagttcagcaaaagtctctacctttccacttaataaagccccttatgtttgaagaccaatttaatcaagaggatgggtttaaagagctcattgtaaacattaaaatgcaaatataacactgacaattgtagaggggtctgggaaggctccagggagtctctcaattcttcaatgagggcagggtttcctgccccactcaaggtgtctaagtttctcaccattcaggatgcctacacgtgaccaaggtggttagaccacagggttggaggtgctgcttttcctggcagcaccttttcccagctccagtcttggctaacctctgggacctaagaacctgatccttcaggcagcatctggttattccctcttgcgctttggcccatggtttctttgaagctgtgtctctgtttaggtgtgggttgagtaaggaaagtatttcttcagcatttcagtgagcaagcaaaggagaagaaaaataaacagaaaatatgtaatttaatacttagagctataaccctgccttgaccattctccaaaaatgctagagtattaccactgcattttggtgaactacttttcttgaattaaagctacgtatcacttcttaaacactattctctgcttatactctcctctaccttataccaatacctggacgatttttaaaatgtgttctctttgatatatagaggggatgtgaggcagtgtttgctttgaattgcttttgaatcatggcaacaggatttttcataagctcttccctcttgtcccttccccaggccctgtcccttccccaggccctgactgacagcatgtgttgtgtgcagaataactctggggttggtatatggctgcatcaggcactgggaggagctaatcagtccccttgaagatcaaacctttggtcttgctttttggtcagattgctaatctgctgaactaaggaaacatagacagtgggagacccaaggagtaattctctggtctgccttgaatattcctaaattgacctgagaccacattctggcattagcattgccttcttctgtgacagcttgcttagcccatcagaacacgattgcaattgtatttcactctcactgagtctcgctgttggtcttggaggtgtcaacgaaaagagtcaaactctgcagaatatttgaagagatttattctgagccaaatatgagtgaccatggcccatgacacagccctcaggaggtcttcagaatatgtgcccaaagtggtcagggtgcacttggttttatacagtttagagaggcatgagacatcaattaaatacattggtttggtccagaaaggtggaacaactcaaagtgcagggggtggttggggatggcaggggtcagggtgggggaggagggagtgaggggggctgtaggtaaatttaaacattttctggttgacaattgattgagcttgtctaaaggcctgggatcaataggaaggaaatgctcaggttaagttaaaagattgtggaaggctgggcgcggtggcgcatgcctgtaatcccagcactttgggaggctgaagtgggtggataacgaggtcaagagattgagaccatcctggccaacatggtggaaccccatctctactaaaaatacaaaaattatctgggtatggtggcgtgcacctgtagtcccagctacttgggaggctgaggcaggagaatctcttaaacccaggagacggaggttgcagtgagctgagatcacaccactgcactccagcctggtgacagagtgagaccccatctgaaaaaaaaaaaaaaagataaaagattgtggagaccaaggttcttttgaagtcttataatggctgcccttagagacaatagatgacaaatgtttcctattcagacctttaaagggtgctagactctcagttaatctcttcaggatggggagggcctgcgataaaaagatctagttatgttagcagagattctttacagatgcaaattttccctcacaaaggacagctctgcaggaccatttcaaaatatggcaaagaaacatgttttggggtaaaatattttgactttcttctttgtcacataatgttatgccagagtcaaattggaaagtaaatcacgatatataggattaaataaacccatctgatgagaatttatggtttgtagggcatgactccccaaatcctttagataggaatttgggcatgttaaaaaaatcagagtttagtcctcagagggaagaggtaacagataaaaagagatagagtgggtgatgaatattggcaaggatgtttgttgaagaaaagggagtattttttttctaaagcatctccataggggaaaatagaggaattattcagtgagcttctttctgataggcaaaggactagcactcgctaaaagaatttgaatgacaaagtatcagggctcctggggataaatatttaaagtatacacatatgtgtgactgtgctactggatcaagcagtaaagttctgtgagcaacaaacaatactgagcattgcataactaagtacagtttccaaaagaactatcttaagtaggtgagtgacctcatacttataatcatggctgcatccacagttattaggcacccgtgggaaaggcccaggtgactgaatcaggttataaaatccttccagcttggcttaaagcaggacttctagcaaacctgcattttagcttcccagttgtctccaaaggccacctccacccctcgttaactcaaagcagagatggagtggaagatgtagaaatgtttagaataaaaatgaaatgcaggaaaactgcagcttagacaataactagcagtaacaagaacaaccacaaccacccctccaactggttaatctgtaacccaccagctcctaggtggcttgaaggaagctgagcgaccagcttgaactgggtgcagaaaaaacaaatcaccactgcctaaaatcccagttagtctaattagataaggaatcagtctagatagtaacagtgtgattgacaggtacacagactttcctataaatttgtttactttataactttcctttaagcattctgatgaacttttaggaaaaataactatatctccgttttgctttggcaagagacaaagggatgagtttagatggtagagctgacagggctgtagacccaggcatgaggtagggggtttaaacagctgtaggccaactctggtcttgtcttctgcagaatagataagcaatcccaagtgacccttactgcatgtgaagagtggggacagttaccggagaaggaggggagggagcgcatggaatgttctctatctcgaaggcacatcttctgcagactcctctcttctcatccttccactctgagccctgttcttcctcccggatggtgggaatcagcctctgattggttatgaagtctccaggttcaggacttttcacagtctatatgattgttatctagtctctgctcagttatgcggtgactagatgctagtctctgcctagttttctttctaaattccaaggcgtgtgagattccttattttaaacacagaaaagagggagctcaaatatgtgcataaaaatagcccgacaacttggctgaaacaagctggtatctttacttggagaaaagaaatggaaagaaatggaagggaacacaccttgccttcaccttgaccttcctataaatgcctaagaggactccatttcttccagccctccccacccccaagttccctgaagttctaaagtcatcttatcctgttgctggcatctcctgggtctggctgacccatgctggtaatctccttgagagaagatgccctgttctttcggaggatctctgtgcttccccagcatggcctgaccacacacaggctggaggatgcctgtgtcagcgtattgatagaattaatgattgcaaatcattaacagaatgtttaagagtaggggtatgcaatttatttttccttgttaactctctaaaagacttttggaaagctatgccccccaaccccacccccctcacatttttagatttaaattgttgccaggaatatagtttagtttcccgggtggcattttaaaaataaaactgacacatccctcttttaaatatgtctttaaaaatctggataccacagtggtttagtacccaacatcatcttcttcaacaatatgtgagcagattatttatcaatattagaaattctacgtcattccttttgctcctcaaacatataagctttctacctcccccgaaaattttaccctgattaatgtattttatgctttaaagtgtcttattgctcattctctttgcaaacaaaatttatacaaattaagatatattgtaaatatttcttatggtattaggctttaaattaaaactttcttacagattattactgtagttattagcagaataaaattgatcaaaataatatatcatttatcttgattaaagttattcaatataaaatgtaaaattgtattggaaatgcattcaccagatggatgagccttttttccctatccattcatatattcaaaaataatataacttattgcttgattgaacaaggttgtctcattttattctcttttttgttgtttttatagatttaaataccgagaaacattactcatatatataaggtaaagagaatagatggtctttccttatagtaatgctacttgattctttgaacttcttatgcattgatgtttaaatatctcattgggatccgtcatcaagttatttttaatgatctgttaactgtcaactttgttcagtcttccttcaatcttgttgaaggtaaagaactggaaactgccccgttgaagaaaacgatgaattgtccatcatcatggttgttcctccttaacccagacactggcattaagcaatacccttggcttcatctcagagaatgtttgccattgcagcagggagaaaattgacctggttttgtaaaacaagagaagggaacgtgtgaaagaacatgcaagcacgtttttcaggcagatcagttttgttcagagtgcataaggaggtcgagaatctgaaaatggattcccttaaaaccccaaaccctgtatccccctggcaagcctttacgcggtccccgacagcacacagggctccttttggagtctgccccaggggagcctgcccccagtggaactatagctatgagcttggcgttgttcccatgtagtcaagggttaacattagaagaatgtgcttgtctgatgaattagctcgggctttcccaagtcatttccacaaatgccatttttgagctgcagttccccagagggagctcacgtaaagagaaaagcagccaactgtgtggtatgaaacaccaggcaagatttaggggttgcatttgaagctaattaagactacagtgagaattttatgctagatcataatttcttatcttcatatagagtatcattattgggacaatgagtacagtatttaaaaattcccagggactaattaaatataaacaagtccagctttcaaaatagaagtgccacaattcattgttcataccatgaaagtctaatgtgattatttaatacagttggcaaaatatggtaatacatagttggatatttcaagggtttagtgtaattttatccttgtgtactaacttccaagatgtggaattaatttatctcctcattcattcatttgaccaatattttttgagtgcctactatgtaccagtcatagcacatcaaagtttctgctttgtggagcttacagcctagtggtgaaaatagtctcaaaaataagcaaacaggccctgtgcagtggctcacgcctgtaatctcagctctttgggaggccgaggcagacagatcacctgaggtcaggagttcgagagcagcctgcccaacatggtgaaaccccatctctactaaaaatataaaaattagccgggtgtggtagtgggtgcccatagtcccagctactccagaggctgaggcaggaaaatcacttgaatccaggaggaggaggctgcagtgagccgagattgcaccactgtactccagcctaggtgacaagaacaaaactttgtctaaaaaaaaaagagaaagaaaacaatatctactttccacttcagacatgagtaaaatagggtaagggtttagagagtgacaaggggaagggaatgttgaatggggtggtcaggaaagaagtctatgaagaggtaaatcctaagagatggacaggagccagaccttacaccatctgggcaagggagcagcaagagcaaaacccctggtgcaggagagaggttcgcaggtggcaaaaacaggaacaaggtcaatgttgttgtagctggaaaacgaggcagggaaaggtcagagatgctgatggtgagtgcgggatacctttcagcctggataaggaagttggatttttctctgagagttttggctcatgaaagcatgatcagatgtttattactaaaagtcctctccggctgctggttgaacactagacagtagataagatggaagagcagtgaggacttggattcaggagtctgggaaagagctcatgctgtccaggaccagagttgtagcacaggggtagaaaaagtattttgaaggtggaaccagcaaggtttgctgatggatgaaatacaaaatgccgtaagtggcaaaaaaagacagaggaggggaggggatggtagatcacaactttgattttggactgaaagtttgaaatatctgtgagacatgaaaggggacatgccacgtagaaagccgacaatattcatttagagctcaggactgagatattaatctgtgtgtcatcagtgtgaaaaagaaaaaaaaagatagttaaagtcatggtccaattatgttaatctctaagtacagaaacatctacaggaagtctcatcttaaaataaaatgcccatccacaggtagataagcatttcttggctcattaacccaagacaggtttcttacataattgtcttcatttttactttggaataaagaagacaagaggtaatgtttccttgtgtggatgatactgaaaattataagaccacacatgttcagattattttaggttgactgtaggtcatcacgtgaagccattttaagttcctcttacttgtttaagaacaaaacttaaacagatttattcatgccactactgttgaggcatcttggctgtttatccaccccaggaaaaaatatgggacatgaggaaaaggccaatcagttgagactgatcagaagtctgaatttccatccacgagtctagactctcgtgttgggtattatctgtcttacttttatttctttaggcttattattccgaatggtcacatcttactcctgaaatttttatctgtcaggtaatttgtgtgtgtgtgtgtagtcatcctttactatatggcttctgggacttgatgaatccctgtgcacaggaccacgtacctagtcattctgtcttgatcagttttccatgtggaggaaattgttttaggggcccataggtgcagtgccaagttatttatccatggaatatattataatgaaaatgaatggaaatgcttctttgctagtacctttataaatgcagtgggggtagctcccaccccttgagccgtccctgcaaatgctgtggttgtgaacttatcttccatttttcagctgtgtgcatggcttggcaggagactctgtcaaacatttagaagtgagaatagcctgcagggaggcaaatgctcccagaagttataaatctaattgatagaggaccattagacaccttgtagtcaagctctccttattttgcaggaaaaaatattttacttcttcctttttcttcaaatcctagataagcctcaacaaaattaccattttttatataaatatggtatgaatgtatatattcatgtgtatgggtatatctatatatatacacatatatttcaaaaagagtttctgtgatactttttcttataaattgaatactttttttcattcaattgaatcttggtggtaggtgaatgattttttaatcttatatgtagctctgtatgccacaggagtttttataaacaacatgatttttgtcccaagctattttcagaaatgtctgtgactgacatgaaatgggaaatcatggtgattctgccttcaaatttccaacagattcatgatgcttctgtgctcatagctaaaacccagctctgtagtacggatgatgtacaagactgtattagttcgttttcacgctgctgataaagacatacctgagactgggcaatttagaaaagaaagaggtttattggacttacagttccacatgactggggaggcctaacaatcatggtggaaggcaaggaggagcaagtcatatcttatgtggatggcagcaggcaaagagagagagtttgtgcaggggagctcctccttttaaaaccatcagatctcatgagacttattcactgttgtgagaacagaacaagaaagacctgcccccatgattcagttacctcccactaggttcttcccatgacatgtgggaattgtgggagttacaattctagatgagatttgggtgtggacacagccaaaccatatcattctgtgactggcccctcctaaatctcatatcctcacatttcaaaaccaatcatgccttcccaagagtcccccaaagtcttaactcatttcagcattaactcaaaagtccacagtccaaagtctcatctgagacaaggcaagtcccttctgcctatgagcctgtaaaatcaaaagcaagctagttacttcctagatacaatggggtagagatattgggtaaatacagccattccaaatgtgagaaattggccaaaacaaaggggctacaggacccatgcaagtctgaaatccagtgtggaagtcaaatcttgaagctccaaaatgacctgctttgattccatgtctaacatccaggtcatcctgatgtgagaggtaggtttccatagtcttgggcagcttcacccctgtggctttgcaggggatagcctccctcccagctgccttcatgggctagtattgagtgtctgtgacttttccagcttcacgatgcaagaggtcattggatctaccattctggtgtctggaggatggtagccctcttctcacagctccgctaggtggtgccccagtagggactctgtgtgtgggctcccatcccacatttcccttcgcactgcccgagcagaggttctccatgaggaccctgtcccttctgcctggacatccaggcgtttccatgcatcttctgaaatctaggcagaggttcccaaacctcagttcttgacttctgtgcacctgcagtctcaacaccacatgagagctgccaaggcttggggcttgcaccctctgaagccatggcctgaggtctccattggcccctttaagccatggctggagcagctgggatgcaggacaccaagtccctaggctgcacaaagcatgaggaccctggacccagcccaggaaatcactttttcctcctaggcctccaggcctgtggtgggaggtgctgctgtgaagacctctgacatgccctggagacattttccccattgtcttggggattaacattcagctcctcattacgtatgcaaatttctgcagctggcttgaatttctccccagaaaatagaattttattttctatcacgttgtcagactgcaagttttccaaacttttatgctctgcttcccttataaaaccaaatgcttttaacagtacccaagtcaccttttgaatgctttgctgcttagaaatttcttccaccagataccttaaatcatctctcttatgttcaaagttccacaaatctctagggcaggggcaaattcctgccagtctcttttttaaaatataacaagagttacctttgctctagttcccaagaagttcctcatttccatctgagaccacctcagcctggactttattgtccatatcactgtcattattgtgggcaaaaacattcaacaagtctctaggaagttccaaactttcccatatttttctatcttattctgagcccttcaaattgttccaacctctacttgttaccaagttccaaagccacttccacattttcaggtaacttttcagtagcaccccactctactggtaccaatgtattgtattaatccattttctcactgctgataaagacatacccaagactgggcaatttacaaaagaaagaggtttattggatttacagctccacatggctggggaggcctgacaatcatggtggaaggcaaggaggagcaagtcacatcttacgtggatggcagcaggcaaaaagagagagtttgtgcaggggaactcccatttttaaaatgatgagatctcataagacttattcactgtcgtgagaacagcacgagaaagacctgtccccatgattcaattacttcccactgggtccctccaacaacacgtgggaattgtgggagttacaattcaagatgagatttgggtggggacacagccaaaccatatcaacaacccaccccattagatgaatatactcctcattaaacttcctgttttctcttgtttcctgcttactttatcaatgaaaccattttctggttttgacaatccagaatgttggtcttgagatagctgtcctatacttggagacctgagctggaggagagattttggcaaaagcatgtgattttctatagtgcagatcaagggacaatgatagtggtagatagatggatgtcacaccaatgcagcacaagactggattccacacacaaatgattaaatgaaaggtactcagtgtgaaatcaccttcagacatgaagagtgacactggccctgaccagacctgaaggctcctgaatctgagtctctggcatgcggcctgagcttctctctatctatagaagccctccaggggattctgatacacagcccaggctgagcatcacatatctgcattgcagtgttagccctagctagttcagccatttcctcttatgaatggcactgccctttccattcatatgaagctgcttctcactgagctctaaattattacttacaaaagttcttaggaccttcaaaactcaagtcaagtgctattaagattgtgcaatgagcccatgaatttaaaatacttaagcaagctgggcacaataacacatgcctgtagtcccagctgctcgggaggctaaggcagaaggatcgcttgagcccaagagttggagaccagcctgggaaagacagtgagacccctgtttctagaaattataataacaaaataataatttttaaaataccttagcaaattggaggggcaaatatgtcattattttgaaatgagctatatgtatcacatcaggttttaatatatactaaacactaaaactttttcccagattcatttccatttgttttctacatctcatttttcaatatttccttagcagaaatccaagataatcagtcaatgaacattaacaaagtgattctatgttcaaggcatcactacgtattgtgactcaaggctaggcatttatttagattctccatttcagaaagattcactaatagtattgaaatgtgaaacatttattctcagaaacaaaagtcattgtttaaacttctaatttttattcaagcatgtacttagcaaaagcctgatggtgggagacactccgccccatctccgtgatccaggtcactgcatgttgcaactactcatgttggaattcagtactcatgggtcagtgtatctgagaacctgcactaccatgtgtgccgtgaccatgggattttgttctgcagccaggaaatcagctcaagcccaactttattgcaggttggctttctgtgtcctcagcacacagagacatcccaccgtgagccaaccctgcctgtggcttgtggcagtacctgccatccacaaggacctagggtgtaggccagtagcagctcattctctctgtctcttgctcctccctacatgagccaaagatcacctagcccagtacccccaatcacagccaacctccacagcactggctactttagatagcacatgccccagcacacccagctccagactccaggccatccctctactaacttaggtcctaactggggagatggaggtgggagactgcaaataatttgacaatagacacattaacaggagaaaagacaaggtttattcacctgtgtgtggaagtactcagtaatgagtaactcactgaacgggtatgggtagtagtttatattccagcttaataggggaagggtggatagatagggcttctgttgaaacaaatgggcttcgaggggaaataaatgggggtatggcagttctgataaagtttggtttatgccatgtctcaccccagggctaagagtcagtctctccttcttggctggagcctcctcagaggggacttatggcagctgcattctcagaaagctcagcctttagtcaatgaaggaagctcagaaaaggcttcttttaagtttaaagtaacctttatgccattctgatgggttctttaagacttccacacaacttgtttaggtagcctggttcattcagtacctacgtccttaaccctggttcattcagtacctacgtccttaactctaccttctccaaccgttattcattcctcaatcaagcctgtggtgtcaagaaaagaaatcagtcctgccacacttcaagccagcattcccatgccaggtggaaaatgggacccttggcattgctcagcttcagccagggacagagctgccagagagcccatgcattgctctcagaaaacacattaaggctctcagtcaaacattgaacagtagagaatatttaaaaagtaatgagaaataaataggcaataggagaggatggaaatgtaaaggctctttatataaacacaagcgtggaactatctaggaccacttagtgtagggcagaagctctttgtgagaatattattataatatagaaaaataaatgatgctccccaaagagtcctggagtcattcagaaaatgttaaatcaccctgactctatagcaagccttcaactttcgcagagaaaatgctcaaaaacttcagtttcagcagtgcccagcaaagggcaagtgcggtcttcaaggaggagctgggagatgatgagcgatgggaggcaagcgtggggactggcgggaaggcgggagcagctgaggggatcccagtggacccaaactacaagttggggcttgcagggagcctctgctgaaggtagtaggaaatgtgcttcttactgctcccttgtcttctctaatactcctcttagttcttttcctcttgcataccttttatttctggctaagtgttgggcattgttgtacattttctagcttgactcccttgggcaagttactttctgtctctgtgcctttgtgtcttcatgtttaagatggaaagaactgcagtgttgacctcctagggctgttgttagaagccattgaagacacagagaatacttagaataatagttggaacttggcaggccctgagttaattcactgccatcattgtcctcgtgcttcatagcagtagccgtgttgctgctcttagcctcagttctttcatgggcttctttcggttccttggaggctcccaagcaaaggtttttcagcacctctgttctgtgaaaaagagattaagcattttcagtatatttaaagttatctccagcctattgtgatgatgccttttctccaaaacccttttttattttcgttttattgtaggcacaaatctttctaatgcagatgcttaatttttcccaaaaagcaacttactcctttcaacaaggttttctatttggtcatcacatctgcattcttccaagaagcccactggtaaataatggaacaatgaagcagtgtcgccactaaagagtaatctgcaaccacacagaagctggaatcccaagtacctgtcattatattctcctacacatgtgcagagtttgataaaaagagagagccagttttattattcctttaagaggaaaaaactgccaagaactcctaagctttaattaccaaaataagcttgccttaaacaaattcaaacacatgaacacaaagtagaagatcaaatgcattttgtggccccatgcacatatatcttccatgagcttgtatcttcaaggtaacagtgctgcgtctttaatacccattagcgctgcactgtctaaatggtgcacgccagaaaagagccgtctctaggtgtctcaatgaaccatgaaaaatctcagggaaaatgtattaatatatttttcagcaaatcctttgagatgaggattctcaggaaggattttagtgcattatgcaatgtagttgaattccctcttcagtattgaatatgctttgctttattccaaagagctcaacctcttcctatagacattgaaattcatctgtttcattcatagcaccacgtaaactttttatttttgtctcaaacttctctgataagcttgcctctgcatacaaaaacatcaaagcctgtggtgaaaaattattagaaaagaaaagagaaaagcacctttagtttaagcttcaaatgagaccaaattgattagtcatctgagattaactcagcctagcagtgagcttacagcaaatcacatctgtcatccttttcttattgtaatatatctctttgaaactttcagtaaattgcctacattaagtcatatctttaagagactgattaaatctaaagctgaactagccactgccctatataagtcttatttgttctaatacaaagaaataaattgactcatggggaaaaaaaagcattatgaacacagaccaaaaataagcctcactaatgaaaatatacaaacccgaagtgttattcggtaatttttctagtgttacttaagtgttgccaactagcagctgcctcagatgcccttatctgcttgagtttctagtgaaaaagtggtcctccatggtgcccagggccgccgccctaaagatcatcaacacaacctgttgctgaaacaaagctgaatttatttcttactgtggtaagggggacagcactcaagggagctttggcagtgcctgggaggagggagatgagattttgtggagaatttgaattctggtttaaggtgaatctcccaatgctaagacttgccaccattcaggattggtagaaacaggaattcagtatgtcttagggcacaaactgtcttttgatactttccatggaagagtcagtaggtttttctacaagtttctggattgaacaatcaagttatttgcattggcaagaatctcctggaatagtaagtgacgttaatgaggacaggggtaattaagtgatggtaataaaaccatttctatctgcatgtagatttgttgtctagctgtatgtgtgtcaggggagtattgggcagaagttttaggagggtacatagttttagttctccatgaactgaaagtatatacacatctcaaaaattgctctgtttcatcatggaaaaaaaagccagatgatattgagaagaaatagaagcacaggtagtacaaaaccatcaatgatctaaaatgtatttccatctaacagccctttggctcctgagtccacacctgtacaccctcttcaattcctccaccccagcttgatatggaaagcatgatggactctctgctctcaaggaccaagccccggcccgcttgaaaccacatttacatagtcacaaacactgggattaccgtgcatgctttaagtgctgtgggaactcatagaagataaacatggcaggcagacagtgcttattaaacgcacaacgttacgtagtgaagaagcaataaacaaaaatttagtatttttaaaatcaaattttattttgaagtttattctcagttgctttgggacacaagatctgatcatgccactcttacttgccttttgattaagtccaaggccaacaaaatatcagactatcaatacatatttgtttaatgaatagttggtggatattcatgctctaatttcatagagaacaggtattacaagatctatagctttaaaaaaagaaacctaattctaaaaattagaggaaatgactcaactctcatgaaaaatcttttgcaattctgatttctcagttattagatgaattttcatatcttacatacttctttattagtctcaaacatttgtatttttctattcctcacttctttcctaagagatgtagatacaatcaagagaagttccaaatgcatgagcttgaaccagtggcttacaatgcagctaaagctcttgtcaatgaaggccagggttcttgtcagtttatctcaaatttctacaaggctactaaaattaaccagggagctgtgtctccatttttatattcttattgccccagccaaattctgatatagctaattgcttgtcccccacccaaaattctcttctattttggttaactcatatctctctgcatgatctaagcttcataggtacccatacccactagagctctggccattgggcaaatgtactgcatcctagagatggcagtatatgttaataaagagcctttttgagacccttgagaaggaaattcactagcaatttactaagaatgaatgcgcttttgttctggtagggcaggctttgtggaaataaacaaccaaaggagaaaagcaaaggctgtctattctgagcttcctatagcaagggggctggccattatcacttgtgttttggcagagacttaaaggcagaagagtggtaaatattatagtggagaaaagggaagcttcagttgtgccctaattggaagctgatagcacggagatgttatgagccaaccagaagtggagcacccctggtgattggttggggtgtatgcctggccttctctggttggtcctcagttggaagcagagacaaaaactagggaagctttcatttatgaatcacgtcctggccatctggggccaaatgttgcacaagttctgaatagagatggcaatctgtctttctgtgaaactaatagcaggcttgcttcctgagttgcttattacaggtaaggagttggtttcctgggcaggatgctcaggttgtgggtcaaagttctgtttttatgcattgtctgaccattgtccatttgcatattcagtctctccatggggacatatgtgagagttataacgtaatagagctctggttccaaattatactttattttaaattagtttttagttaattgtcatgaaactaaatatagccaggtaattttgagaaaattatctattattagtttttctccttctggtactacatctataagccatttgtagcagtagatacaaattgtaaaggaaatcattgtggaaatgtaagaagcaggcagttaaccaaagggaaacattgaacgtagcttagtatctccttggacctcttttcactgggacctgaggtggtggacacttctgggtgtgtttcttgtagggaaggtgttattgactctgggtctcaaggcctagggaccaatagacctgggtggaaaaagaacatggcttgaaagtagaaagaaatctaccagaaattggtagaaagggaagaagaaagagcatccagttaaaattccataggctaaaatatacatgcacaattgtatcctctaaaccacattaaaaacaagttttcaggaatagattattgaagtagcactttgttcaacttgctagactccttcactgaaattggttgggcactactatgagcctggcactggaaatatctccattcttatttgttaacagtagtctgtatgtagcaacatggacagaagagtatttccctccactaagacagcgaattgcttgtggcttacaaagttagtatttaaatgaaactactaactcccaggaggtataaatggtgagatatttccccttaaggaaaaagcactttttatgttgcttttgcacaagtggtatgaaacccagttatttattggacacattccatgcacaaaggggtgggtttgggtgcctggataatggatagcatttccagaaagaaagttcagaaggaatttcaagaagccttgtaatgagggatagatacactcacctacaatgcaggggagatggttggtgcacctgctgactggggtaaactcacaggcttgccagggtatccgtggggagggtgatatttccttggcactggagagttatcataacacatttggcaagccttacattttcattcattaggtttctttcattaggttgaaagttagtgtactgtctgtgccaatgcatgtttagacatttatttttctctgtgcaaatgttcctactattgcactccacagacaagtgagaggaaatttgacaagcaatttgtattatgtcagttttaccaaatcacacccttgtcctcccctctaatcacacaaaagcctccaaaagcccatgaggcatgacgttccaggagcttaggaggttattgaggcaggtgagaagtatggaatagatatcaggaggctttagcaaaaaggatcctccctttagctccttgaaatgcccatcccttgactttcagaaggtgacttaccttcccccatttccagcagtgacctcgtcttacctcggaatctctagagcaatagctttcaacatggggcaattttgtcccccaggagatatttagcaatatcagaaaacattttttgttgtcacaactggtgtggatgggagggtgctactggcacctagtgggtggaggccagagctgctgctgtctgtcctgcaggctatgggacagcctcacaacacagcatggtccagcccaaaatatcaacagtgccaagctggaggaacccggctccagatcttgtacagacgtctctcaaggagacctggaaacctggcaaattctgtctttctccaaaagaactattccttccaatctttttcagtaggcatagattatgtctacacatatgtgaaaatcacaagtctagtatgcaatccagccaaatgacactagctggatatagcactgctgtgaccctctacaaatctgtgcttgagttgccatagatgactctacctgtcagctcaacacaggggcagtgtggggcagggatgttacatggctcaactgtttaagttatgcatccatggggtggatggttgcaccattagagaatattccagaaactcttctgtggctaacgctctctgaaacatttccttctctctgcacagaccctgctgtttcccaggcaactaaatgcagtacctaaaaatatatgcatgcaagatttttatggggaaataaaacaatatcacattaaatttaggactaatatttgagatcatgtaaatctctgaaggcagctaccctcactcagggaatagcttatgcttcagtcttagaaactaccttgggatacctgactgtttgccatggtttggtttgggtggggtcctgttttatttgttcatggctaagtagatgcagagattggatgacacttcattcagggcagtgtttgtagaacatggaccttgatccaggccagttccaggttctgggagctcaggtgataaagagcctgtatttccttgcctcaaggagggtactgaagtgaatggacccttgtgctgtgctagaggaatgccaggatttggggatggtgaagcggccagcagaagcagctttgggaggagcgatttaggaaagcctccctaaatggtggaacccctgaattgagcccggagaagttgaagttaaccagacaaaggagcaaacaatgcaggaagcgaaaacaacaggacttaaacctgagagtcccatctcctggagcatatttacaaaattacaagcagggtcacctgctaggaacacagcagctccccagccctgcaggggtcctgttggccagtcccaagagctggtattttacctggtaagcaagagggagctagcgacatgacatggtcaacagaaaaaatggcactcacagtcttgtgcccccagcctacttctgctaggattgaagtatgtgatttgtatttattagggtgacgctggacctataccagagcagcaagcaatggaatacactgatctttctatgtttttattgacctgctgataaacgaaagtcacggcacatatgtatgcatgtatctgtgcatctgtgtgtatgtagacatggagccatactctttatacccctaaatatacacatatcctgtccctctctccgtcccttccctagccagcacaccccttggtggataattgtgtctctttggtttaaactcagaccccaaaacaatgccttttacgtgggaaaacaatacaaaaggcatttttgccatcgctgttggtggggaactgtatgtgatgtgattgggtccctgcgttcctgtagaaccagttgcccagtcacgcttcctgtgacatcatcctcctggacaggcagaggtgtgtactggcagctttccctgctttctgaagcagccggagtgccatgtgcaagtaatctttcatttccaagatgaagagcctgtgtgcacactcatctctctgagagaagcatggctttcacagaggcactcacggtcatgaaactcagctcattaaccctccggaaattcatgaggaggctctgctgagaagagtcactgatgacagaattttaaactttattttctgtccccaataatgttggtgattatgcccatgaaaacgcatgggctttctgtggctgtcaaggactttctagagaaattggtcttgagcttgccatttcgtcagtgctggctctgtgctttgttaactccagggagcttgaagcctgtttttttgttgttgtttgttttgttttgttttgttttgttttaacagatttggacaaaacagaatccagtggtagtgacagtgatgatggcagccaatgtgattaactgaagcatcatttttatttattttatttatttgcttttgcttatttggtcttaaataccaagttgagatatcattcaatgagatttcagacagcgttaaaagtgaaatggcaaattccgtgggattccatatgactgatgagacatgattatttgtcaaataaagcaaaatagaactgttctttgtggtctcttcttcaaagtagcagctctgaaacgtacctaaacccaaaagtcaagcagtgtgttggtttaatagggttcctataacaaagtgcccctaactgcatgggttaaatgtgctggaggcaggaagtttcagattagcgtgtcacagggtcgattgccttggaaggctgtgagggacaatctgtcctaggctgccgccctcgcttctgctgatttgctgtcaatagatggcgttccttggcttgtagaagcatcgcctcaatctctgcttcatcttcacatggtgctttccttgtgtgcatctatctctggatccaaatttcccctttctgtaaggatctctgtcatattggattaggagcccaccccactccagtatgacctcttaactaattacatcagcaatgaccctgttgctacataaggccgcattctgagggactgggggttaggatatcaacataagaattttggtgagggggtaacaattcaacccagaaccggcagcatacccgtttccaccccatcccacaccaagtagccccaacagctgctgagccagcagccaccctgccctgcagcacagacaggggaccagccacttaatatttctggttaaaaccaccaaggaggaaggtcctgagtctccaacttatcagtggaagacaggaagagaggacagagaagggaagggaacattctttaagataaaggagggatgggagaggagataaggaaagtgtagtgggtgagatggtggccccccaaaaatctgtccaagtctaagtccccagaatctgtgagtgtgaccttatttggaaaaagagtatttgcagatacaattaagttaagggtcttgagatgagatcatcctagattatccaagtgggctataaatccaaagctaagtgtccttgtaagagacacaagaggagatgacacagacgcagaggagaaggccatgtgagggtggaggcagagatgggagcgatgcagcctgatttggtttggatgtttgtcccctcaaaatctcatgctagaatgcagtccccagtgttggagatggggccttgtgggaggtatgtgggtcacagggacagatccctcagtaatggcttggtgccttaatgagtgagtatcactctgttcgatattgcaagatctgattgttataaacagagcctggcaccttccccccctccctcttgcatccttctctccccgtacgatctctgcacacactggcttcccttcaccttctgctgtgggtggaagctttctgaagcccttaccaaaagcagatgctggcaccatgctttatgtacagcctgcagaaccatgatccaaataaacttattttctttacgaattacccagtctcaggtattcttttatagcagtacaaatggactaagacacagccccaatccagtaaatgtcaggagccaccagaataaatgccaggcctcccctagagccttaggcgggagcatggccctgtctgctgataccttgatttcagacttgtgacttccagaactgtgagggatacatttctgattttttatgtcaccctgtttgtaataatccactgaagcagtcacaggaaactaatggaaaggaaaagaaagaagtaccattttcaggggccctcagggtccccagtggtggcccaagggggcactaccctgaaacccctgaagtcctacatttttctccagctctgctctggcctgactcacatgaggaatagcagaaccaccagctgatcctgtgctgtagtctccagtgacagtttcctttgagcaccaccatctttccctgtccctgtccaccactctgctcctggatctgtattcaggcacatgctcacctgaacttgaccttagcaatgtgacactggaaggaaaacagatgctgcataagctctgtttaactaatggaattttgtaaaaccaaacaaacatcactgaatcttcagacttaaaaagaagccaacaacccatttatatatatatatatatatatgtattttttttttttgcaagcatgtgttgtttctactcactttgaaaatagggtaggagggactgcttatatcggattatgaaatgtacatagaaaatatcgttctataatatgaagacctctatttttgctggatggatgtatggatttgcatggtttggtttggtttgatgaggctgaccatagtcactgtgtaataatagttaagctacttgtctaccaatgtgtaggctcctgcaatcctagcagatgatcactcacctccctgtcgtctgtcagatcatgccaaacgggcttgacagagtggcagggcagtgtgcagggcatgtttggtgtctgcatttcagaaggtgacactgctaggaagtcattcttaccaagggaaaggacctcctgtcacggtacctcattgcagaatgagagcagacaggcaggaccatcagagtcctgccgggcagaggctgctaccccgctgtacaacctgctggaagatgcagggcctgtgcctgtgggccagttactctcagccaagtgtgaatgacagcctctatcccctgcctgggctccctagtgagggagacaaatagatacttaaacttttccaaaaattgcaatttcagaagagaaaactcaaacactgaacactttcctgaggtttgagccaagtgatttacagaagctctgtgtctagtattttcctgcttttttaatcttccatgcaatctcttttactcatcaaatctttctcctttgctacaagtgaaatcccatctcaataaagaaattgccacagcactgcagcttcttttcttttcctgaaattttaccatattaatattgcttgtaaaaagtgggtcatcacttggctcagatataacaataagtcattttaattgagtgaaattagttaaaataaactttggtccatttttggtcttctaagctcattttttgcttctgtttttatatctacttggtctctttttattcatttcatcataccttatgttttttctacctatctacttgtgaacagttcatacaattacaacatacagttactgattttttttagtatagcgcaaatacaactaccaaagttttaaactcatcacatgtaaatcctgtatgttttatgcatacgacataagcctacaatatgaatgctggaatcctgggtagagtaataataatgctaacagtttcattaaaaatgtctactgtggttaactaacaaacatacagtcaatattatatagcctgagacattcttacagttcataggaatagtgttttcactagctaggacacttggagaaatatctaaagcacaaaccaattttactaaaatacatttaagtatctttgggttctcatgttatttctcttgaaatagaaattctgtgtactataaaaatacaaaagaggcccaattcctttatcctaaaaaaaaaaaaataagctctgacctagatataaaaaattttataagctaacactattaaagaccaatctcgaagtgaagacaagtgattggaagtattttttgagaaaggatactatctcttttgttggtaagaaccatctaaactatcttgcatctaagaaagaagattacctcctaaacataagggggacaaggcttttgtaagatctggaaaagttcaggcacctggcatgaaattagggccccattatatgtgttaggaaaagagatgaagtgatggtccaaccaccccaagccacaccaggcttgctgccttcttgggtctatttcagctctggaggaaatcctagatgtacaggttttttataagccaaatcagaccctggtgaaccagtgacctaaagccaccaaagacttcccggtatccaaagctcaattctataatttacattagaagtagaattgccatgtggaaaccagcacttggcttggctggtaagtcccaggacaaaaattgacttgggcaacaaaattacatgagtttcgtacagtgaacttcctctgtttgagaaccatcttggaattcatccataaacatctcattggttaataaggaagatgaaattttaagcaaataattacatatccttctttaatgccacatatctctctagtttacgaagtcctctgtgaacaaggtgtgcgtgtataacataagaacaagacagatgcatttaggaataaagtgtattggggtgagctgctcctatcagccaacactaaaaacagactaacatacgtcttctctgaccatccctttttcatagtaagagtttttcttttagttctagttttcatcaacattaatttaagttgtgaaattacagcttctgtggtgtaaagatctgtgtgcacttggtgacatgaaaacttaatcaaaggaacaagaacagtagcagcagggccccagactgagtcctcagacccccacttctctggaaatggaatggatgccatgcccaagactgctttctctattctgataagtttctctattctcataagtttctctattctgataagtttggcaaaacctgtgcttaaacaaagttgaacagttggcttcattgtgtctgttggtctgctcagagcctttactttgctaattcaaagtaaatttgctaatacattataaatctctgagatgagtatcaagtacagtatttcctgcatttatgttgcagtgaaaccctatttataacatagcaccttttaaaactagtattccccagacctgcatagaagtaaataacaactgcaacaggataaatatgaatgcaattttcagtgatcaaagtgctgttgtaccttcttaccttgtgtggtcaaaagcctcatgcaatttgtttattatcagtagacataggtttgttagctatcatcctatcctcagtttatatgatagaaggataaattatatacatcagcaaactagatgcaacttcaatgaatgtttttggaatgactggctgaataaatgcatgacagggaaggtgtcacacaggtggtaaaggcagtctatccctgtgaaaagagctcagaggaaggagtcaggagggttaggctggagaaaagagcttctgcctaagagacttatggtcaccaaagctcaggagacagctctgtgacctttcccataccatttaacttctatttgtcttctagataaattggaaattatacctgccatttttatatccctagggtaatgtaagacacaaatggaaataatgaatatgaatgttcttaaaaaagttagaacactacataatgtcatctatgagtaacagcatatgaagaaaaccaacagatgattccctctctccatatccttaattgggtctgatttttattttggcagaggtgtaaatcaatttggaaaagcaagaatgagggaatgtgattgtataattaatcattaagccattgcagtaatcaatgaattactgctattccaatgtcgctcaggttggaggactaatttcagactctattcctgaaaacaaacttttcttcagagaaacactgatctcatctgtctcagacagacaattgtcttctgaaattttcatcttaggagagttcttgggtctttgctagatagcaatcttgacctaaaaataaaacacccttcataggtttctctcctgaagctagaatcagtaagtttaaattttcatcattcctttctgctaaaattagtcaatgaattgagataattatttttatggttatcatgcttaatagttaatcaaattatttaaatcctgttaaaatgtatcatattagttgcttgcctcattttcagtatttctcaaaaatcaatttatttctagttcaaaaaggaacttcagcaaatctcttgttaattaactgccatttttatttttagaaccattcttatactagttaaatatgcatatctcagccaccttcttgcccacagttctactcattttcttagttcttcacacttcaacagtgtgagaatttctcagaatctaattcagtgaattcccctggatgagacaaggtgctgaaacatacaattccttttgtcttccaaacagatggaataggttatttatttgagtataacaactcttgaaagaaatgcataccgtatgccataaacctgtaagattctgcctcattcaatgttatttcttttcagaggattgagttactctttgaatcattttctcagactaactgcttaccaattcgggcatgtgaaataggatcttatatgtgctacaggtctgtgctttttgtttttgtttttgtttttttgagactgagtcttaccctgtcacccaggctagagtgcaatggcgtgatctcagctcactgcaacctccacctcccgggttcaaacaattctcctgcctcagcctcctgagtagctgggattacaggcacccgccaccatgcccagctaattttttcggagttttttttgtttgtttgcttttttgagacagagttcactctgttaacccaggctggagtgcagtggtgtgatctcagctcattgcaacctctgcctcccaggtccaactgattcttctgcctcagcctcccaagtagctgggactacaggcacgtgtcaccatgcctggctaatttttgcatttttagtagagatggggtttcgtcatgttggccaagctggtctcgaactcctgacctcatgcaatctaccagcctcggcctcccaaagtgctgggattacaggtgtgagctactgtgcctggcctgtacttgttttttaaaataatggttattagaaaaaaacataaggaactttagtgtaccttctagaatttgtcttatcctctgcccattgcaactatttgatcccctggctccagctggtctcttcttaatattccttctctctctctttttctatttgaataaatctctaatcaattaaaacaacaggcagattataaaagaagattcattttttaaaaaaatcaaggcatctcttgaaatatttatttgaatctagcaagagcaaaggggcagatgtggagatgaacaggtccctttctgggaaaaggggactggtatgatcaatccagagggttggtgttgccacagccatcgtccactgtgtgaaaggaagacagaaagaaaaagcatcaagatgagaaaggggttttcttatggattgttgcaggggagccagaattaagaccagccgtctacatttaaaactaagtacaaaattaccttggtttgtaaggttacatttagtcaggtcatgctgggcaaacagcagttttctcacaaggtaatcacattgtcacagattggtattgccaatgtcagagatgatgttgattggggagtctgcaactgttaggaaatgggtcaaagattcattatttgggactacagtagaaaggcgattgtgtgttttgtttgtttgtttgcttgcttgcttgcttgcttgctttgggattgtttccctgagcttggctttgtcctgtttccctgaatgaggactgtgacaagcacatgatgtgcacgctgccatgacaggtgcagagctgggtactggtttgcctttacagttataatgctgacgttctgcccctaaaatagatttaaccacaggtgtttggttagcagttttcctatttgtgatcattaatttgatatgttgtcttattgaaccagctgtatagacataggtatagcaagcagtgttgattcattcacaaagaccccttagcatggttataaaaatgagagctatatgatgttaaatcttgagggttaacttttgttttgtggtcacttttatatctgtggcagaaatatttgattctggattgctgaaatcagtaatccagaactttcagattcaaagttcacctcttccaggtttcacatccactacctaggtctcaaagattattccatctctctgagctccaagttttcagtgctcctggccatactgcctgtagggttgggattccctaagccaacgttccccaacctttgtggcagcagggaccagtttcatggaagaccatttttccatggactgaggtcggtggggaagatggtttcaggatgaaagtgtccacctcagatcatctggcattaattagattctcataaggcgtgtgcaacctagctccttcacatgcattgttcacaatagggctcacactcctgtaagaatctaatgacaccactgatctgacagaaggcgaagctcaggctgtaattctcgctcacctgctgctcacctcctgctgtgtggcctggttcctaacaggccatggaccagtattgttccatggcccagggcttggggacccctgccctaagctacacaacatgaaccaagccagtgtcctgggaggatggtgtaggcattaaccccacatatgaaatgcactcattttaaatgagcttgtcatgtctaattacattatatttccctttaaatgtaacatctctggcatggtcattatcacagatttgatttactcaattacattctggtaggaaggaggacagattctaggtaaatatgaaggcctatggctaaagaaaaacacccagattagtaataataatagttaaataataatgtaactattgctttcagttgttgtatagtttcagaccaatcaatatatgtcatgatatttgcaggactattataattattagcttttcctgataatttattatcatcatctgttttaaaatttttaaaggattttaaaaatgagttttgaaggattaattagaagataccatttaaggaatgttttattctagtctttataagcataacctgttagatcaagcactggagacagaggaaatagacagaaggcttctataacatgcccgattcaaatcagaacagtaatcacagcgaaatttgtatcattttgttgaggtaattaatccttgttttgttgatcttggattagtaggcactccactttctcaaagttttctgcctccagtgcaaacaagttctggaactcctgactcagtcccttggtagtcttcatatgtggtggtgatatcagctgatatagggatgcgtgtaactaagatccaattttctattctatgaagtgtcgaaagaacttgttagagtcctttaatcgagctgttgtgatgtttcttccagcagccatcaatactgacgcatggttttggcaggggtatttaggatcgtgtgacaaaaaatcagaaaccacctgttggtgctaaggctgaataggtctggttgtttactcattataaccactaatatccaaattgaggccagtttagtttcataaagaattagtcagtgacggccatgagagtggtgagggcacagaacaatctccatggccttttaatttattccatccaatgtgtgtttggattaccaccaactgaaaaggctattttaaatgtggaaatgggatcttcttttaaaaaattgttgaccattattgtgccattctttaacatgaaggagagtgtgcctctctccacaatgaaaaggtcatcactgctgaagcataatcataatgctcatattttactcatcataattaagtggtggttgagcttttcattttttcatgtcttggcaggtctttttgtattggattcttgatgaacaggacagctctcaacatagtattaaaccaaataaaaatctacgaaatgctgaacatagccaattatttctaggatcccttttctcataaagtgaagaagaaaaatctttagtgtcaccggaagttttctgagaaaccgcaaagatggtttagatgtagaagatacttctaaaagttgtattagtttgaggccaggcgcagtggctcatgcctgtagtcccagcactttgggaggccgaggtgtgtggccaacgtggtgaaatcccatttctaccaaaaaatacaaaaaattagccaggcttggtggtgggcacctgtaatcccagctacttgggaggatgaggcaggagaattgtttgaacgcaggaggcagaggttgcagcgagccaagatcgtgccattgcactccagcctgggtaacaagagtgaaactctgtccaaaaaaaaaaagttgtattagtttgactgtgggggtgcagatttgtggaaggcaatttcaaaaagagttatctgggatgcaagatatgagtgtaaatctggagtggctgaagacaagacgtaacttcagcttggctcagaatgataatatttataataaaacggttaaagaagttattaggaactctagcattttcataagcaaggatcttttgctaaatattaatttaaaagattgaactctagcatttccacaagtgaggaaattttgctaaaagtgactcgagagtaacaaaagcgcaaaaaaaaaattaacacgatatcaagtaggaggattttagtgacaaaagaagctcttgttctttgggcacagactattcttcacaatttcttactgaaaacagagtatatactcaaatataatcagagagaaaacccaacactaacttcattatttttgtaccctactcatgtaacatttgcagtagaaagttcacaggccttttctctatcttgtaagtaaactcatcaaaattacacaaactttataaaagactgtgacacctttcattgttttttttttttcaagttcattatttccaggcattataaaccaagacaaataaggttcacttcttctcaacctttccataacttattgcacatcctcaaatatgtcttaattttacatattaacacacagccagattttttaaccttagacacactttcttcctcgataaacaaaaatgcattccattatcttacagacacattcatattattttacaactattgtacctagtacagtgtagtaggcagaataatgtcctcccaaagatgtccagagcctattcccccagacctgtggctgtgccaccttacgtggccaaggggaattaaggtttataatcagctaaccttgagataggaagaagaccctggattatcccagtgggcccaatgtaatcacaaaggtccttaaaagtggaaaagggagcagctggaggcaaatgaaagggtcagagcgatgtgacacaagaaaggcccattgttgctagttttaaaggtagaaacagagggttacatgccaaggaaatcaggtggcctctaggaactggaaaaggcaagaaaatgattctctcctagagctcccagaatgcagtccttcccacaccgtaatctacccacaccctaattgaagcctagtaagaccagtgttgtacttctaacctgcagaactgtgaaataataaatgtatctagttttaaagcactgaacctgtggtgatttgttacagcagcattagaaaaccaaacaccgcatattctcactcataggtgggaattgaacaatgagaacacatggacacaggaaggggaacatcacactctggggactgctgtggggtggggggaggggggagggatagcattgggagatatacctaatgctagatgacgagttagtgggtgcagcgcaccagcatggcacatgtatacatatgtaactaacctgcacactgtgcacatgtaccctaaaacttaaagtataataataataaatttaaaaaagaggcaaaaaaaagatcaacagaccactagtagttagcttaacaaaaaaaacaagatcccaataaacacaataaaaaatgacagagatcacattaaaaaaaaaagaagaaaactaacacatgcagcatctacttttcatgagttataactttgaaaccatgtaactgagttgtttcctcacagacatagagaaggctaggagacagttgcctgtgtgcacttgagatcagctgagattccagaaagctgcctgtgactcctcacaatgtccttcctccaacagtctgatatattgtttttgtatttcatgaattagcaacatgaacaagtccaggacatttgtacatttgcagatatttgaagcgcatatatgtgtgtgcctatgtgtttagtggacagtgttttttcaaaaagaggacactaagaattttactcagaggaatttggtggagtaactcagtaacagattgttgtggaattccctaaggtgaagaagagcgactccttcatgaaacagcagttattacaattcaatctagctgaacactcgttaacctttttaaatgtttaaataataatattagcttatctgtttaataaacctagaattggaaatcttaaaaattcgtattattaaaaattgaggaaacaaacctaatcttttataaaacagatcatgctaacaaaagatttatgaaatgataaaaccaggggaaagacatctctgtttttcccctaatattatcaaatcagtctgattttgcaaggatttcctttacctgaaaatactgcatcaactctttttaccttagatactaaatattgaaacctcttcaaatatccttaaaggtcctgaagtgtcttagtactattttttaccttgtctttgctaacctggtatcaacttttatttctttgctttaaattttttaacctagctaccaaggctgttaatttaattcattgtgaaatttctttgtgtttttccttgaaataagcttttgtgaaagatgttgttgttgttgctgttgttgttgagacagtcgtactctgttgcctgggctggagtacagtggcatgatctcagctcactgcaacctctgcctcccaggttcaagcgattctcctgcctcaacctcccgagtaactgggattacaggctcccgccactgcacccagctaattttttttatttttagtagagacagggtttcaccatgttggccaagctggtctcgaactcctgacctcatgattcgcccaccttggcctcccaaagtgctgggattataggcatgagccaccaagcctggccagatttttattttttttcttaaaggaccagcaacttaaagcattctgagagtattttcattggcaattttttagttttcttgttgtaattacatatacaaggacttacttgtttacataagccaatcaaattgggagctccatttatcagtctcatccagagaatagaaaagttataccaatttctagacacagaaaatgtttatacacatacaacagaagaatccccagcaaactcttgggtaagctggaggattcaggaacttctgactggatgtcttcttatctcatatgtgctatttttttgtaatccttgtcaagtccattgtggattgaaccaggggatacattttaagatttattaacacctttttgtcagcacatgtttattggcatatttctatatttctgtgtgacttttctaatttttaactttaaaaaaattatggattcacaggaaattgcaaagatagtaaggaggggtcctatgcatccctcagccagtttccagcaatggctatatcttatgtaactataacacaataaatcaggaaattaacattgcagtatatgtgtacagtgtcatcacatgtgtggatttgtgtaaccatcaaggctatcaaaatacagaattattccctcaacccaatgatatttgttgtaccatcttgtcatagtcacagtcttcctaagtatcctaaactcctagcaatcattaatttgttctccatctctataattttgttatttcaagaatgttatataagtggtatcttacaatatagaaccttttgagactggcttttttcacttagcataataccattcaaatcttttcacgttgtagcacatagtgttccttttgattgctaagtagtattccatgtattttgttttaggggaaaaaaaaataagcactcagaaccttccagatgtttccagaggtcagagatctccggacaatccagaagagacttttcccacattaacaagcattcagacattttcagtaactaagcaataccattttgaatgcttcaccaatttggtctgtaagccacactaaccagttttaaaatatatattttttgcatatatttttcccctttgatgatagactgtgtttaaattagatatatttatagtgtgcaaatgacagatttctataaattaagctccaaatacttcccaaaagagaaatgagagacaaaacattccagcattgtaaacatcaaacaaccttttatatacaaaaggaaaaaaaccctttaatccttttcacactaacttacagacatccaatcacatggaaatcagctcctcacttttatatcatcaattattgatgaaaagtaaattcagagacgggagaggattctaggctgatggagaagtaggaagcaccaggaatttgtctcaccacctggacacaatcacattggcagaatctgtctattagtcaggattctccagagggacagaactaataggatatatgtatatatgaaaggaagtttattaaggagaattggcttacatgatcacaaggtgaagccccatgataggccatctgcaagatgatgaagaaagaagccatcagtggctcagtctgacaccaaaagtctcaaaagtagggaaggacaacagtgcagccttcagtctgtggccgaaggcccaaaagcccctgtcaaaccagtggtgtaagtccaagagtccagatgccaaagaactggagtctgacgttcaagggcaagaagcatccagcatgggagaaaggtgaaagccagaaggttcagcaagccatcttatcacacctttttccacctgcttttgttctagccatgctggcagccgactggatggtgcccacccaccttgagggtgggtctgtctctcccaatccactgactcaaatgttaatctcccctggcaacaccctcacagacacaccagaaacactactttaccagcccaccgaggcatccttcaatccaattaagctgacacctaatattaaccatcacactgatataactattttgaaactctggagtctattgaagacttaaaaatttcagaaggcttggacagtaaagtacagtatatttggtcaatctcagcttagctcacagtagctacccatcccccacccctcagccctgtagcaggcagctgtgcacatgttcctagagcagcttacttgcagctggcagaaaccagggttgacacaaaagaccccgtcctctaaatatcgtggatctgttctttctgctgattgctgcttctcactacagtgacacaaacacagaggcaagcagccattgttgcacatacccataccatgattgcaagcccctctatctttggctgaagttattttcagaggatttaaagagctgacaccgtcaccctcctcatccactttatgtttttcttttccctttttgggagccagtcattaaagactagcatattcaaaagcaactgcatatacaagagaaataagagagccagtatgcatgcccagggaaactctcatgctcagaaaacatctgtgaagatcttaaggctaattctcaacacagagacagcctaaaacagtcaaaaacaaaacaaaaacaaaaaattacaaaccctggaaaagaggaagaatctgatttccagataacccattattacattcaaattttcagtttcaacaacaataaaaaaccacaaggcatacaatgaaacagggaagtatgaccagttcaaggaaaaacaacaaacaaactaaaaaaaaaaaaaaaaaaaaacagaaaccatagctgaaaaatggcacaaaggtagatctactagacaaagactttaaaacaactgttttaaagatgttcaaagaattaaaggaagatatgaagagagtcaagaacatgatgtgtgaacaaaatggaaacataaataaaggcatagaaaacctaaaaacaaaccaaaaaatttagagctgaaaagtacaataattgaaatgaaaaattcactaaagaaatgaaaaggcagatttgagcaggcagaagaaagaatcagcaaagttgaagacaggaaaatttaaattattgactttggagaacagaaagaaaaaagatcgaagaaaaggagcagagcttaagggttctgtggacatcatcaagaagatcaaatacacactacaaaagactcaggagaaaaaaagtgggaaagggatagagagattattagaggaaataatggctgaaaacttaccaaatttaacaaaaggcataaatataaacattcaagactcaatgagattcaaataggataagctcaaagatacctagactgaaacacattacaatcaaattgttgaaagacatagataaagaatcttgaaagcagagagaagtgactcatcacacacaagaaatccaaaataaggttatcagctgattttttaatcaaaattttgaagaccagaggtagtaggttgatatagtcatggtgctgaaagaaaaaaaaactgtcagccaagaatcctatgtccagcagaagtgagggaaaacttaagacattccctgataaacagaaactaagagagttcactaccactagacctgctctgtaagaaatcctaaagggagtcctgcatgttgaaatgcaagaacactaaacagtaattcaaaggtataagaagaaataaagatcttagtagagataaatacatgggcaattataaagctcatattgttttaacaatggtttataatgctacttttgttttctacataattcagtacatttaagaaaaagcaattactagtttaaaggctagcattattgtgactttgtttcctaactccacatttttttctacataattaaagagaaattttctacataattcgtttttaaaaaccaattatttatgtttttggacacacaatgtttaaagatgtaattgtgtgacatcaataactgaaaagtgtgagatggaactgtaaatgaacaaagtgtttgtatgttattgaagttaacctggtataaattcaaattataatggtataatgttaaatgtaatccctgtggtaaccacaaagaaaatcattaaactatatagacgaaagaaaataaggaaattaaaacatttcactacagaaaacaatcaacacaaaggagatagtggtgcaggaaattagggacaaacaaaaaagctacaaggcatatagaaaacagaaaaacgctagaaataagaccctttttatgagtaattactttaaatatacatggataaactctccaatcaaagacagagattgacagagtgcattaaaaaaatatgatgcaattatatgttgcctacaaaaaacttactttagattcaaagacagaaatagattgaaagtaaaaggatatttgtacatccgtgttcacaccattattctcaagagtgaaaatgaagtatcaacccaatttttcgtcaacagaagaatagcaaaatatgatatatacatgcaatggaatattattcagtcttgaaaagaaagttctgtctgggtgcagtggctcacgcctgtactgccagcactttggaaggccaaggtgggcagatcacttgaggccaggagttcaaaccagcctggccaacatagtgacaccctgtatctactaaacatacaaaaaattagctgggtggggtgtcacatacctgtaatctcagctactcaggaggctgaggaatgagaattgcttgaacccaggaggcagaggttgcagtcagctgaaattgcaccagtgcactacaccctggatgacagaatgagaccctgcttggaaaaaaagaaaaaaagagtgtacattctgacatatgctacaacatggatgaaccttaagaacattatgctaagtgaaataatccaatcacaaaaagacaaatcctttatgatgccatttatatgaggtacctggttgtcaaattcaaagagacagaaagtagaatgggggtttccagggactgaagggaagggttggggagttgtttaaatgcttttaaagtttcaattttgcaagatgaaaagagttttggagatatatgattgtagaatgatatgagtctacataatatcaatgaactatatacttaaaatggataaaatggtaaattttataagtattttactgcaataaagaagttttttagaaaaaataaactcagagcacctcagcaaaaacccacagatcagttttagcagctgcagaaacaggagggccatagaactacttaaacctcgaagacaaaggagttgtgatgtttctcatccggggttgctctccagtccagctgaccttctggaaaaatatattttctctaatcagtttgagacatttaagtttataatggtgcacaacaaagaccatctacacataggactccatcagtgatcagaagagatctatagtaagtgtaggaaggaactcaagtgacttccctgttgtctgctgccttagagaatgcaggtctttagaccataagaccaccactcaacattcctgccaccaatgcgaaaaccaaatggtagtatgcacatcagtaacaaatacaggcttagttcagaaatagaaacagaaagtcacaaacacaacatggaaaccgaagcagtcaacgagagcaaggctgttacctcatcatgaaatccccaccagctcctttctgcacaagcggtctgcaaggagtgcctttcttgggcaacatggtttgttaggtctcctgagtgagtcccttggggtaccttggtgtgcccaacaatgcttaacagaagagttcgagaatgaagcactgtaaagagaaaataatctttacttgcagtttttcaagaaaatctggatttagaaaactggttcaccaaatacaaaatacaggtatttgaaggaaacacacacacacacacatacacacagtggaaagggtagcaaagttacaaggtttcagttagtccatcattgatgaaaatacagtcctttttctgcacaattatgttatcaccaatggtagtctcttaccagtattgcaaaaatcagacatatagtcattgttactagagactaagtaacttaaaagaaatggcccaaggattcatttctattgggaactgtagcaagaaagagtgactttgtttgtggtagtggtggtggtacagtcttgttttgtattgttttgatctgacaaagaacaagcttttctttttaaaaaaacaaaagatggaacgcctcacaaatttatgtattatctttgcacaggggccatgctaatctttctctgtatcattccaattttagtatatgtgctgccgaagcgagcaccatgatttccctttttcagatgtgagtccatgatagtggatcgttggtagcacatttattcaaaatagaagcaaggcaaggtatccactttgctttcataaatccaggtattctttgaacctgatgacctgcttgtctctctgacgggattttggtacgtgattctctcatataagtaatataactaattttgcatgtttttctttgtgtggaaaaataacattcaatttatccattaatattaagctttaaaattcacttggtttttactaccctctgtgttattcccgcgtgaaatctctgaatcctgtttccctgcattacctcaacatttccctgggctccaagccctgtcagttgcttcttaagaatttccataatggctgctctcatgtccttgatcctcccatgaccacctttttgtagtcacaggttcttgtttgttcctgaaatattatagtttcctgccaaatgaatgaatcactctattattttcagtctgtgtcatatcttttaatcaaattaaatctagaaggtagagtcagctgtgcatggtggcttacacctgtaatcccagcactttgggaggcagaggcaggcagatcacttgaggtcaggagtttgagaccagcctggctaacatggtgaaaccccatctatactaaaattcaaaaggtagccaggtgtggtggcatgtgcctgtagtcccagctactcgggaggctgaggcagaagaatcgcttgaacccaggagatggaggttgcattgagatgagatcataccactgcactccagcctggacaacagagtgagactgtcttaaaaaaaaaaaaaaaaaaaaagaagaagaaggtggagtagtcagctggagcagtcatctatttgcagtggttactggtgcctgctccttttgagggcctaagcaggtcattccaagacaggcacttcttctgccccatgccaggctcaaacacaggaggaagcttatgctctgcatccacagagaatctcagtgcaccacaggaccacagctgggctctaggtgccctttctgtccctgggactgtgaagaactgcccacaacctccacctggtgatccagcctctttcttccccagtcctaaaagaaccctacctccatccatttctctctctaaaaagaaaaggaaacaatttgaccaccttgatggtgtgaaactataaaaaaagtttgaaccacccactttgcagtttcctgttgccaatgtgatacaaaaaaagggaattaacttcttttaccctctgaagaaatctcagacctcaaagacccaaaagtctgcctgaaacagtagaaggagaggaatcaagattcctcctactgggcagcaagaatagctttttagctctttcaagtgtttagaaacttaggttaaaaagaaaatacaggatatggaacagttatagaagcacactaccttgagttgtagtgcttataatttcactagaagtctagaagaagagaacattattgtcaagaaaaagactatgtttcttccaccctcagttttactattctgaaaccttccttcttaatgcaccagaattctttttgtaaaatatcaagttgttcttgttgcccccttgacatacaagaaaaaatcctaaatgtacacctcctgaatcaagccttccataataactccagtcctatctaacttgtctcttccctgaactactgttataaacatacaacacaaggtcacttgcatctgtaattattctatgtcccacattttattatttccctaatcagcttcaaagtttctaaacactagaaagagctaaaaatctttttttgctacccaaatttcttgtgaagataggatttaaatttcactgtaaaaagacagcatttttcaacacataatcaaaggctaaaaaagaattgtaaacttttaaaataattaacaaactgccccgaggttttcttctccgtggaataatattacctgatttgtttctttacttggatggtcaaaaatttggactaaaatatattcctccagatagactgataaatagtagactgataaatagacttaatgaaaaatctccaattgcctagtaaaatgtcagtaacctatattggaaatactagaaataagataaatccaatgagtttcctcgacagtaaagttggggtaagttaaatataacagtgactcctggtcttttccataccatggggcacatggaaaatgatagtacttgaatggcacattggggtgagtggaagaggctgctctgcaggggttgggtaccctgccatctacttattatctataaataaactaacattacagggagacccgcatcttaatcaggactcaaggattggaaagccatggaggatgagactacatcttcatatttatctgacataattttcaaaatgataataccaacaaaactaaaaaatgctacagccaaattcttaaccctctcttcatttttggttttaaccttgacagtgtccaaggtcatgaaaccagtcctccatacacagtcaagggtgtaaatgtccccgtatatacaatgactggagtattttttcagttattttgcccttccttcatcactttccttataagaaaaaggaaaaaggaacacattgatcatttcatgtctgtggagctcaaatttgtcttctaatggtttgtgggggttaatgaactggtagaatctccagcatgctgagccctacgaaagtaaactcttaaccagagttaaggctgatttaatgataaatagataaactattttaggtgctgtcattagaaaataaatatgctacatttgggggtttgcaggcaaaccatttttgtcagacacttcctcagctatcatcaagtgaatgaacacacttttctatttcagtaatttaagtatcagcattttctctctaagctaaaataagccacctaaacataggataagagcagataccaaaattacaagggcctgtgttttatgtatcactgcctggaattaagatatcatcgcctactcccacaaggttcccttcctgctgccaggcaccatacaccagagaattaaatagcagaagaagactattatttatagatatgtacatggaggtgaaatatttcaaacagcctttaggagctagctaaatgtgcctaattgggggatgggagacaagaaagggatctaactttaggcacttgccaattccatctgaaaaatgtgagaacagccagctttgctacaggcactcatttacttacttccagaagtcaattaaaggagcagaaatggaagctgcaggtgggataaattaattgtcttgcagggctattggtaatgcctaaagtgctttgtaaactaaaagtactccataaatatgtcattataagtacctttgtcattgggaatagtaagattaataatgttaaagtgaattaaggaagcagaattggattgtattatatttttcacacaaaaacacaccaaattagtaagtgttacctggtagaactacacaataaaatcccatcagagagacaaacagcatcaggttactatagttcagaggacacatagttatagattgtcaagtacctctctcctgctttcagtgtttctccttgctttaaatgaatcaaagctcagtactcacatatgtgatcatgttccccacacatttttgctttgactctttttaaaaaatacaggccgcaacatagctttcattaaggtatttttgagggttatgttagaattcccatacatttttcttgacttctataaacatcaagcaagaacataataatagctaatacctatggagtcctgtgtccttgttcatttccatacattcactcatttatgctttacagcaaccttgtatggcaggtaccattattgtcttcctttagagattgaaaaaactgaggcttcagaggcatgaaataacttggccagtgatttgatcccaggtcaatctagcagcagagtggatgcactgccatgaggaatgactgtttttctctgtagatgtgtgtaaaactacccaatagggaacattcagtgatgggaaacaaacaattttgcataaacgtggcctctcgtattctcttctcccccatacccacctctgccactatctctgccttcaccttgacctcctttcaactcttctctttattttcttttccaggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataagtaagttacctggtgacgccatatctctgtcctggtaaaattggttctgaatgtgcctttcaactcctgatgacgggtagtactatgactgtcactggaaagcatttgtctctgagaatcaagagaaggaaaatggcaaatggtttccagtcttctctcttactgttggtaaaatggacttgacgatccagcacacccatgtgctccttccacatggcagcgacacgagttcaacctggatacatgaaggtattttgttgttgttcctctgtggtgggaagtccgtgtgttgatgatgtctctacatccctctgctctgtgcctcttcagctctgcaaccaagtcaggtccaccttaccaacatcacagtagccaccaagtcatagcaagtcaccatgcaggaaggatgggggaggagacagggcatgatggagtcagagaactcagttctcatctagtaccctcccttacaagctgtgagatgtggggcaaatatttaatttaacaagtcactatgcctatactttccaatctaaacctaagggagaggctgtcacaatatgctagctggaagagttgataatcaaatcttaaagaatgagtagaaatttcccaggcagtgcagatagtggtgagaaaggagggccttcgtgcagatagaacaaaaagagatgagacttggtgtcaaagcaactgcacctccttgaataagaatgcctcctagtttttaagaaccaacagtatcttactatatacagctggaaaatagcttcacaagccagcgcatcggtatatcagcaaggtgtcaattttacagaaaccttcactaaccttaattaaattttgcctcttggaagtccctcgatgtaattaaataagattaaaagggtaaacattttgttatcaagagtctatttcttgacttttcattccctgccaagccacccccaccccccattcttttacatgtaaatgctaaatagtttgttgttattaaacactttgagggacgcactttgaaactttctggaaattctgtctcattatttcacttaattcaggatagtaccaatgtattatagaagatttggagtttctgtttaagcacccagagacctccaaataggctcaatcaacaattttgcatttggatttgaatgttttctcatattaagtagaaaagccccactggactcatataataattgcgcagtggagactgttggcttgagctatatcttatgatattgtacttacaataaagtgctatcctacgtaggcaggaaaccatatggttttcttctttatttagcttcaatagacctttggaatctctaattgaagtgcttacctgttttgagcattaagatcttaatatggtaatgctttcttgagcatacacacccacacacacaataaaaccgtagtctgcaaaacaatctgatatattcttgtctatattcatgagacattcaaagattaaagtattttctctgaattatacagttagagagctttgaggagtggtttggcatatattaattctctccaactttatgagcattcctactgcaataagcatcactaaatgggcctaaagagaaaaaaaagttttattgagtcctatggtcaaataaaattatttggtgaaactaatttacaaatcactcgaagaaaccatctatgaaatgatattacaaatcacttgaagaaaccatctataaaataatacagatccatgttgctaaggtcctgataagccaggtccaatcttgattattgttaatgggaagatttttttcactaaagatgatctcataaatgccctttaatttggctgaaaatttacttatagaataggcgctcattctgtcttgttgttcctttatctctttttccaatgccaacagcctggatttacgagtttaataagaagtgttaaattggattgaatcaagcatcttcctggttacagttctcctgcttagtcagtctcattcactgtttcatgtagcttatctctttttttatatatatactgactaatttggagatcaaaacaaggtttttataactgcatttatcctcgtctcctacctacacttcagttttattattgcttttcactgctcttaaaacaaaatgaattcaggagaattgctccaaatttgagcatgaaactcaccatttctgactcaattctattataatagtaggtatggagattcccatggacttctagacaaattttaaggaaatagaatttatttattgaaaatcaaatttttggaactgaggataatttaataattgggaacggtaggtatacaaatacaccatagcttatttataaaatgattgctaatttgcccaccctaaattattccttaaaaacttatttctagaaataagttcagttcaaacctgatttttatttgtgatagtatgggaaaacacagatggaagaaacgtgccttgctatgatgctctagtttatgtatttatacatgttctttatatatacatatatatatatacaagcttaaatgtgcagtgatgttaatgagtcagattggcgagttgccaatcacagtctatcagaactgcacaactcacagcgtctggcggacacaaccaagggggctagtgttctgtgatcccaccgctggcacagctgtgttgacagccacaatgaactgcaccaactgaagtcctcaccacccctgatgtgacagctctagtgaagatcaaactccaattgtgtaattgttattaactcttatagtagtcttatactcgccattttgaaatcttaattatttattcttttcacatcattttaaacatacattatggacattctatcatgttcatctgtctcaagaatacatttggttttttttccccaattttaacagttatatgggaagtagtgttgaatgtgtcactatattttgtcataagacggaaaagctattaacagtcttaactgttactgtcagtaaagaactgtgtattgtggcttgggttataatcacttgtcacattagaaacacacaattgtccaagcccttcaatcaatatttagaagagtttttcaggtagaaatttccatggcatccatctagtgaatgcatcaaaattaaagtctaaaaagaaagcaaagtttctttaaccttcacatgttagtataacactgtgatgtattggcattttaattgagaggttaaaacctgctgttcgttacacattcacagtctcttttggttttgtaactatgcaaaagatagaaacaaaaactacacttttgtttctactcagaagcatttttgcacactaattgtatttcaactacactatcacgacctgaatattaatatatgtttttctagagttgcttggctattgtcatgaacaaatatttagctaaatgataaaatacaacaaaacatcacatttaatctttgttcagcattgattatatgagaatgaaatgcagcttcatctggattcatgaaaggatctaaaattctctgtctttaagtcaaaggaattacaggcataccttagagatattgtagttttggttccacactactgcaataaagcaaatatctcaataaagcaaatcacacaaatatttttgtttatgttgtagaaatatcttctttccttaaaagtcattaatcaacttctgctagctttaaacttttctcctgtagcttttttacctcaccaagccatcatataattaagagagttggctgggcacggtggatcacgtctgtaatcccagcactttggtaggctgaggcgggtggatcacgaggtcaggagttcgagaccagcctgaccaacatggtgaaaccccatctctactaaaaatacaaaatagctgggcatggtggcacacgcctgtaatcccagctactcaggaggctgaggaaggagaatcgcttgaacccgcgaggcagaggttgcagtgagccaagatctcgccactgcactccagcctaggcaacagagcaagactcagtctcaaaaaaaaaaaaaaaaaaaaagagtcagggccttgctgtggattgggttttagctgaagggaatgttgtggttgatatgatcttttatccaaaccactcaaactttctccatatcagcaataagcctgttttactttcttattattcgtgtgttcactggggtagcacttttaattttcttcaagaacttttcctttgcattcacaacttggctcactgtttggcacaagaggcccagcttttggcccgtcttgggttgtggcgtgccttcctcgctaagcttaatcatctcttgcttttgatttaaagtaagaggtgtgcaaccctttctttcacttgaacacttgggagccattgtagggttattaattggcctaatttctacattgttttgtcttatggaagagggaggcctgaggagagagaggaggaagggccagtctgtggagcagtcggaacacacaatatttcttgattacggttgctgtcttaggtgggtgcagttcgtggtgctccaaaacaattacagtagtaatatcagggagcactgatcatagatcaccataatagatataataataatgaagaggtttgaaatactacaagaattacagaaatgtgacacagctgtcccactcacatcttgcctttcctgtcttttcttcatcagacactctccaaaagtggtcaaggctgcatctcaggtcctcaacagcatgtggcagtaccgagatctgaggagtctctacaaaaaggtaaggctggcttcacctgggccctgagtccaaacactcaacacgggaccctgagaggcgtcacagacgtggagggcactttcccacagcctcagtcattgaaacacaactgaaacgagaatcagtgaagaagccagaaaagaggcaatgtgtcccctgagtagctcctaagatccatgaactttctggactggacagacctgtgctcacagggtcttaccctaagtcatcttacagaaaagaaaataagctcattttcctgagcttcagtattctacagtagactaacaagtaatgacagagggattttggggaaaaaaaaatcaacaaatgttaacaagtaattttggaaatatatatatatatatggaaagatatatatatatatggaaagatatatatatatatatgtatatatatctttatatatggaaagagagaaacagagcacgtaattcaggaaatcaagaaccactgcaaactaggaacactgaataggagactcaactgtctggcccacgtcactaagcccctgagaacctcacagtgttactggccagaaggaaaaagacagtgctcccagtgacaaacgtggatcaccaagatgctcggcatttgttcctctcacaaggcaggcaggaattcatatcgcatacctccaaagagtcttcacccccaacatggctcaaaaatcccttaagagaaaaaagtcacatctagaaagttttattcaaggcctcatttccaaaatctgctcaataaggggtgcctaacttttcctttttggttaggaggggagaatttttttttttttaacatttcccagaagttgttgttttattgtgacaaggccagcaagcatgggagtttaaattcgagttaacaaataggggtagaaggccatgtgcagtggctcacacctgtaatcccagcatgttgggaggctgaggtaggcagatcacctgaggtcaggagtttgagaccagcctggccaacatggtgaaaccgtctctactaataattcaaaaaaaaataaaaagctcggcgtggtagcggcgcctgtaatcccagctactcaggaggctgaggcaggagaatcacttgaacctgggaggcagaggttgaggtgagctgagatcgcactactggactgtagcctgggcaacagagcgagactccatctcaaaaaaaaaaatatataggggatagaggacatcaccaataagcggggagaatggcataggcattggtttccatgcagggattcaggaagcacaaacaggactacagaagggtgcctgggcttccatcagcaactgcccacagcacccacctgcagccccctggccacttgcagggagtgggaaagccaagatcattgctgcctccatccccatctatagcccccatcccccaggtcaccggccactcactggccagggacgtgggaccacagtaaggggctcacatcatagggaatgagacccatcttgccagagggaaaatttgtatttttctaagcaatgggggaaaaaaatatttaatagctgtctcaactaagttagagtctatttctagatttcccccaaggcctttctaacttcccttaactattcattactttgcacttgaagttttataaagtgtagcctatatatttctctttcaaaattttcctgttccctaagaggaagtgtgtttaagttgaaacagaatgcaaaattaagtggaagttctagatcaatgagagtcatccctcagtatacacaggggattggttccaggactgcggcagatagcaaaatccgtgaatattcaaggccctatggaaattagtcagccctccttatacatgggttttgcatctcgcaaatactgtattttttatctgcatttggttgaaaaaaatctgcatattagtggacccacagtgttaaacccatatggctcaagggacaactgttaagtccttcacaaagcatttcatataatgggttagcataagccttttatctacaatgttttgggttccattctattttgtttgaaattcctatcccagcctccttagttaattccttcttgaattcctccaggaggcaaatgaagtctcgcccaggaaagagtccttcagctaaataggcagccagaaatgaggaacatggtataaattagaaaggaactggccattctgaatcagtggctccagaagctcaatgaaatattactgcctgaaataaaaccctctttcctttagatcctgaacgtttcctgtttgctgaaataaaccttctgatacttctgtgcattgaagggaagcagcttttagacactctccaggctctttcttgaatagtcatatgagtcttccatcttaatgtttttcattgttgttagtagagttcaaaaagcataattgtctgtctatttccatgaaaaaaagaatgtgttgacaggaatttaatggagctaaaactcaagagttgaagatgcttaaaatatgtttcatttgaagagattcaagaaggatggactggacaaatgaatggtgatgttttcagtggacccatgatttaaaaatatcgagaaagagctgttcttaataattaccaaattatgcagttgtgaaatgaaaggaagatctttgtgcccagtgtcataagtgctgctaatagcaaagctcaaaattcaaaaaagctttccttttgaaaagctcctttgtgagaaaaccaaattcattcatctttatgaattgtttttaatcagtggggaaatagatttctattttgttcttcactgacaatttgcatatcattgaaaaaatgtctgatccatatcttttaattatccatgcttcgaatctatttattaaacatctattctaggcttagcaaaggaagcgttccaaaggaaaacataagatatgggaaggaggtactaggggtaaagatgaaatatgaaactataatgggcaacttcattcagttctgaattacatactacaaattttaaagcatgaattaagggaaagaaacttatagaccaaatctggagaggcatttatggagtttgcataattaggaggtaagagataaggacattatggataaaagggaaagtgtgaggggagagatgggaattggattgagagttacatgtccgtggaacagaattcggcgccatctgtcatgctcattttcttgtcgaacccaggtacagaggccagaatgtcatttcattagctcacctactttatgttatctagggagacacattctgattcaaatcagaatattcttccagctgggtgtattgattaatataaaactatgtttgattcatgctgcatttggaaccaaagcatatttgtatcatcggaacctttgacttttgtgaagcttggccttctgggttattttgccctaatggaacatcaacagatgtaggagaatgtgatcacttgcaggctaaagaatgcatcacccttttaaagccagtctttaagtttagataaccgcaaatagaacttagatgttttgtgtcattgcagaggatattttctaaaggaaaagacgatgtgccatgggaagagactggatgtcggggtacaagagaagtaggagatggaaagttcttgactttttagaaccttgggacttaaaaagaaatggagtgactgaaataatagggtgcttatgtttgactatggttggggaactgtcaggatggctggttttgaaggaaagaagatgggtgagggggaggtcatagaattaaaagattatagaaatcatcatgtataaattcttagatgataccttaataatctgcacaacatctccaagaagtagttgcattggttgggacccaaaactataggagctgagactacacagggatccctttccctctcatggagctgtacgtgctcaggcaggtggcccaaggccagcaggtgaccttgatgcctgtcacattgctctgccttgcaaaagaaacatcattcctgcctgtgtaagcaaagcaccctggctctgcccacttctcattccagcccatagggtgagagaggggagaggggagggcaagtggcacagaagttgccagtctcgggctcacaccccggggtgagagctcagtcccatcgccacagccccctgccagggaggatggggacagggggctgcataacccctgcaaaaggtttgtggcaggagaagaaaggcagtaccgttccagcagtcattttcttcccaaatggctttaatgtcagctgtaatcacaacctaatgaggcatgttatcccattttggggtaactgtaatcatccaaaacttcttacttatattaagcaaaaatctcattatttgcaacttctgtcctctaaaagctgtactggaaaagtctaatctgtcttctctgcaatagccttcctggatttgaagctagccatctttatctacaaggtcatttcttttctaggtctaaaatgtgtaggggaggaaaagaaatatcctccctcacccatcactaggttcatggctgaagcccctataatgaaagacaaattatagtaacaagagaaaagcatacaaaattatctatataattagaaaattacatgagataattgcatgccaattaattatatgagaacctctgtaaggaaataaaggcccaaagaaacaggtaaacttgtgtatttttatgcttaagtttgatggagagtggacacccatggagaagtctgattggaggacaaaagggtatgatctaatgttgataaacaaggagatcttacggattcctctgtgggcccctgtgagttcagagataaggctgttcctttgctccagtataaggaggcacctctcgaatgagggttttatgacctgcttaagggaagaagcgtgaggggaaggtgagagagatctttctgcctctgttgttttcccaaatgccaaggtgccatatttggggttagcatgaatcccatcacatgctgaattctaatatgtcagcctttccacagccttcaccatgctatccttttttgccaaatgcatgtaagtttgttggtatccctttggtaatatagcaccccaaaatgaacgtattcctccaagcttgtttgaagcagaggagaatagacagagactatgctttcctgatgagggacactcaacttctactcataaaactggagatcacattggtgtctgaaaggctcatcctacaatttggtgaaatacaaagagtgcatggccaggggtccacagcacagccctgccacttaccagcagcatgaccttgggcaggtgacttgagaccccttgtccatcagtgtaagaactgacttccggcagccctctggccacctctgctgaggggtggaacaccatgagtagccctccgattcaccaggtttcagatgcgctagggttgcttggcagccggttatctgtacctgataagcagccattcctgatgaagagccaccaggaaagtaaacgacctcttaaaatggtctctggctattcttagacctggcagcatgttctctggaagcagcgggacaagccctcagatctttggaggtttggaagcctgggtcaccatgatgccttccttccactttatgtatccaagtctgtatctttccttgacctttgtgttaaagaaccttcatggcctttcatgaagtctgtgggcatctctccctcaatcccaccccctcccttggttttcccatccatgatgggaaagccataacacttgcctcagtggattgctgatgtctcaaatggaacagcagtcatcacagtgctttgtaaaatggaaagtaatatatccatgggagttgctgccattaattcaacaacacttttccaagctgtttgattggcaagtgccgtctctgccatcctgtccacaggcagctgaaggtttggatccgaggatttcattttatcatcatcatcatcatcatcactagtcacctctgcctacatttttacagctcctctccccctggtctctctactctgtctcctctagtcccactgtctttctgctttcccacggtctttctcctttctcccatgcagctctgcctgctagcgatattcctataggaaacagagtcccatgtttacaacagagagtgctaggtgctgaaagctggtgatcagaatggaggggatgctacctgcatgcttccgtgcccttgcctctccgtggactgcttgcctggaagacaagccaggccattcaaacagaccctgtaaagttactatggaaagggtcagggcagtccctgttgttaaagtggtagatgatttttccaatgttcagcttatggtcctgaagctcattttgctctaagaatctcaaagtgcttcagagagaacagcgtccactcagtatctctccgaatgaattaaaatccatagttcaggcggggcatggtggctcatgcctgtaatcccagcactttgggaggctgagataggcagatcacttgaggtcaggagttcaacaccagcctggccaacatggtaaaaccccatctctactaaaaatacaaaaattagccgggtgtggcagtgcaatccgcctgtaatcccagctactcgggaggcagaggtgggagaatcgcttgaacccaagaggtggaggctgcattgagcagagatcacaccactgcactccagcctgggtgacagagtgaggccctgtctcaaaaaataaaaataaaaaataaataaaatccatagttcctaagcgtatggatcaaatcacaggtagatcagacgtcagacccaacctcttgttgacaagcaatggggttagaaaccagatgcattatccctcctaatgttagtggtctggtgtttttatggttgtgcccccctccactccaccccacacacaatgttgttatcttgcacagtgagctcatgtcttgaagaatgccagactgcctgtgcttgaaacagagtaagatcatatttctctgaatagagacactgtattcactcttgccttcgtgatgagagaaagaaaacgtaaaactaatctttcaatgtccttccttttattgtcagagaagatagactcttgggttgcacagcaagtgaagaatgagctttgatgggagtggagtcatgcccttcatggcctgtctcacaccaggctctctttccttactgctcttggattcatttcattggctcttgcggccattgcactcacaaaacaagaaatcaataagtaattatagatgggtaagggaatgcctgtagatttcctcacatgtccaaatcagagtggatgaaggagtgaatacagccttttgtcatctttcgcagcttgcttgtgggagactgaccactctacatagatgagccagtagccatggccctgcaaactgaagtcatgttctcatgtttaacattactccatcaccctcatctgctggacatttgaaaaacaataccagattccagtgagaattagaaagatactttgaaatattgtcgaggaaaaacacaatatagtcaaaattcataattttatttaagctttgcagtatgaagggtgaggaatactgaagggctttaatatgtcttccaatatgttgccattttgagaattaatagattctactttctgggtatctaagatagggatgaaaaagcagtaaatcctctatagaaataaactaccaaatgtagagctgtcattttatcaaggaaattgcttaatgggaatttattaatcttcctactgtgctggaaaattcttcaacaacagattattggaagaacataaggactttcagccagattttaaaacaacccaaggctagtgtccacaaggtttgcaattgtagctcctcaagttctttcttttctaaatcacttgatgtcaagtaagggtagaaaacaaaaaggctaaggttaaactcagctaccatactgtctccttcataaatctggacgtttacttgttgatgtttggtattgacaaagaaggtctttcttcacgaggtctcctgacctctctgagacaactctcagacactcatcatatgatatctgtccaaaagcaaaggcacaaatgggaaaagaagcaaaaatcaattgtgcaaaagtggaaatcaatgcacatggcagttgctaaacaagaagtcactaagttacagctgttgctgggatagatccccaagtcaggggaaatcccatatagcagtacccaaactaaacacttcctctataattccaccatttcacaaggcttcgctcgtaacatttttgaatcaaaccctacaaaaataccccagagacaaaaggcagaatcaaaggaccagatcaggagctagtaaactcagtaagtttaatgtaagtctacatccattcttctcacttactttggggcaattaactcaaacttactccctcgttttctggtggatccagtagattgggtgatatcacatctatgagaactcggtgtgcttgagagacagcgtgatcagtttcttctctcttcccagctccatctcttctccctccccttctcataagctgtggcttcccctgtctcaatgcctcccaatgaggttgagctaagtgggaaaggagactcaaggagaggagagcagaacctgaccatcttggttatatcctggctctggtacactctgcccatgggagatgtctgctggctagctccatctctcatgagggcagtggggtgggttgctcagaagtaccaccctgcaaccaaggacctcccaactggggatgcctgacctccacagccatccgcctcagaattctcaatcagcctcagactacacacagaccagggaagatacaaattttgtgcccctgtagcttttgtcattttggaagtcctatttaagaagaagagtacactttatgaatataaaattaggtacagaccctggaaggggcccatgcgatgggcgggcatgaaagttcatggctccatggtcagttcacctctggcactgaatctctgtattgccccgctaatgccactgaagacaccaggcctgccacccccaaacttcagggagctcatggtgaaggtctttacatagtccactccctgggcttctggagagggaggctgaggaatccccaaccaattgattacttccaaggaagttctcaccaccagccgcttccaccctcagcctaatcttatataatctggagttgagtcatatgctaatactgcagaaccctattttgtccaccatttttgcaactccgagtggaaggtctaagacttcgagaaagtggggcaagggggcatctattattctttgccttgcttgggaccttagccagaacagagacgataagaaaattacattaacatcctggcatactaccttatcatcagtatttaattatctacaagttttctagagaatctgtttccttgccttttccagcttctaaaggctgcctgcattccttggctggtggcctccttctccaccatcagaggcagcagtaccgcatctttgaaatttctttgcttatgttgtcgtactgcctgctctgtgaccccccgagtctctcttataaggaacaacccttgagatgacattgggcctactgggatattcagaatgatctctccctttcaaggtctttaacttcatcacatctgcaaagttcctttggccatttaaggtagcatattcaccggttctgggaattaggatggtgacatcttctatgggggaggcagtattattcagtctcccactccctctcacataaaagcctgagtgtaatgatcaaagtctgatataacgcctgccagagccaggggtttggctcctcctaactccatgctcaccacctctggagtgttgccctcatctgtattatccacattggctatcagtttgcccacattccaaacaactggaatggaaaagagccagggagggcatgcctttttcttttagagacaagaatgtaaatacttccagttcttaatcaagtggccacccacatctccctgtctaggggcttaactgaaaagccgagtttcattacacggtgcgaaagtgaagaaaggctacggagatgttcattccctggacatccacgctatgtgtgcaacagcaccaatgctccttttgagtatctgtgcccagtttttataaaagccacattcttgggagatcccacagtgctgtcatttcgttggaaatacttccacagtaattaccaattggcttcaaccttgaaaacggccccaagtccatgactcctttgccctatgcagggaggccagccagttcgatggaaagagaactgtacgttttcagactccgttttgtagctggaacaatataagaacattagcaacaaccaagggaagaagtgaggtcacagaatgtggaactgtctcagatgtttcttgttgttgccacgtgtcctgtcataaccacgtgcccgtgacaggctgccagcagttcccgaggttaaagctgagtgaactcacagttcccatgaactgctctgagagagctgttcatgccgtcctcaccgccagtgctccatttaaccagatgacagattggccgctggtaaggtatgtagcataaaataaaagtatacagcaattgggtttttctctatgccagtctatgcgatagtacccccattttcttattctccttaataccatgtgattcctcttagagcagtcctgtcaatcctactagcaaatggccactcctagtagcttacattcattcgtaccttcaatgcatatttactgagtacctgctggatcatctgctcccttctaggttctggaaattctgaagtggatacatccacattgggttacctttccccagttacacagtggcatgcgttttagcaattttttcttgattgtttcactttgtgcttacttttattgggttctattttaaaatagaaatatatatttattccctatttatggtccaggcctcttgttaagtcgttttctcctgacattgtccattttcctcctcctgtttcttcatcctctccctctggtcattcttcccctagagatacatatgctcttcgtgcttctatcttacgatgtttgagaaatgtcctctccccatccttctccatcttctgccttctcactttctgctctcccatggtccagccttcacaatgaggtttctaggaaggttggagttcattcatggtgcctttcttacattctgttgtgctcatcaacccctagcagtcagtcctcatgcctccacggaaagggctcctaactggagcatccaacgagtctcattgcctgtgtgacttagggagggctccccactgtaacacgcagacctaaacatctaatgatccaactacacgaaagtttattttcttgctcctgtagtcatcctggacaggtgttcaagtagatgggtcagctcttctccatgtgggcactcgggacccagactcctccttccatctgtggctctggcacgccgtaagggccgcagctatacctggcaacacacatgcccgctgcctcacctccattggctagatctccatcacgtgggtgtgaaaggctgccacaaggagaggctgggacatgtggtctagatgggcatccaggaagaaaagggcatggactggggaggccctgacacatctttctctgttaaacagcctcctccctggctgctttgtcactattcttatttttctctatgtgggaaagcgccccttctcagtcttttttgccaataccctggtcctggtcttccctgcaacatccttgtttgggaccctatacctgctaatgtagatgatctcatctgctcccatggtttttttgttgttgttttttttaatagaacctgtctcatgagaacttcacagcatataggcaagatcccttcacaaaccactaccatcttaagacaattgttttttaattatactttgagttctgggatacatgtgcagaacatgcaggtttgttacataggtatacagatgccatggtggtttgctgcaccctgctcccatggtttttaaatgcatttgaagactagtttgtatccacatttatttctctatctggtcttcactgtttaacactaaacccatccatacaactacccacatgacatctgcacttagatggctcatcagctgtaactgtccatacatccagtgcttagctctcagtatattccctaaatctattcttcttccgtggttgcccatctcagtaaatagcacccaacccaccttgttgttcttttcagaaatctgagagttatccaactaatacttccttctttcttatctccactctatttttcacaaaccctgatgatatatttcctaaatatctcccatacccaactatgtctcccatccttacttccatcatcatctgtccctggtcctggtacaatattactgcctaattggttttctggaatcaacgttaccatcttcagtctattttccattaagcattcagaatatacttttaaaaatcccgatctgacctggccattctcctgattaaaactcttcagtaccttccattttctcacaaagtcctgctcacctccctgcgctgacttccgtccaccctgcctgcgatcgctttgcctcagccacgctgttcttgcttccccttgctcttcctctgcaggtacaaagcagtttccacctcagagccttggcattgcctgggcacaggtcaattcctcccccaggaatgcctccccttctctgcctccaatcctggttattgctgccccagtgtaactataacaccctccagaaaaacttcctgactttccccagctctctaaggctaatagcagtccttcccaataacctgtacttttccttcatggctcttacagcctggctattgatgtgatcatgtctgaacacctgtttctccttcatcttcccctcaacaaccatgccagtctctcttttcttgccctgtgctcagcatggtgctagctacttactaatttttattgaataaaagcaccagtgtagctaccccagagtgtaagcctagcagagggcatgttcaatgactctgcttccattcacattgtcattagcatttttcttttttttttttttttttttgtgagaaggagtttcactcttgttgcccaggctggagtgtaatggcatgatctcagcttactgcaacctctgcaaaaacgaaacagttcaagcaattctcctgcctcagcctcccaagtagctgagattataggcacgtgccaccatgcccagctaattttgtacttttagtagagacagggtttctccatgttgctgaggctgatctcaaactcccgatctcaggtgatccacccacctcggcctctcaaagtgctgggattccaggcattagccactgcgcccggcctgtcagaagcattttgaaggagactggaatatagagaacttgaagttgagacccagcgtaaacatcgaatttgttccccagtgatgagtgtatatgtaaaatagctgactgttcaaatgctcaaatgacatattagaagctagacatttgtattcctaaatctgaagactggactgttcagttttatcctgaacttaactttgcagtactaattgaaacacagaggacattgttaaagctcatccaagtcagatctttgttttaaggcctcaaaagcaaagccagggaggtaagaggactgatatggtcttatttcaatttcccaggtgttttcgtttctttgtttgttttggttttttgcattccattggtacctattaactcctagcggttaacaatggtatactttcttctactaaatcatatacattttttccaacttttcaaatcttcttggttacactggttctttagaattagcccagtagcagtaaattgaattcctaaaacagatttacacagtatttgcttttaaaagatggtgttgcacaagatccttatgcttatacgtactgtacctttaagtatccaaatcaatttaattaaatttcattagaagcaacagagctgaaacaaactaatgacagcaactggtatgtcaggtggtatttatttgtacattaaactgcaaatactcccttttggcccttaaaatttagtttaaatatttaactctaatagctcttggaattgttgatggaattagttttaatgaatctttaacaaacagtttaccttaaaaatagatgggagcttgttttattacagcagagaggagcagaaggttttgtagttaagcaaaatctggcttggtctttagtcacacagactgtgcatcagaatattctaccttcagtttattgtatttaataccttttcttgaaataagaaggaagtgtatgtgtaaatgccactaatttgaaatattttcattctctgcttaatgtgattacattaataggtttcttccactcaaaaatgactggaaaactggtacaattttgaacaatcaggcttctgatacgtgagcattaatgtcttagctggttacctaaggcaatgatttctgttttgactttcatctgaaaaataggtccccagcgaagtagtcttgcttgtgaatgtaagtactaagccctgagtgttacaggctggtgcatgggtgagcttgggttactaaaagcccaacagatttttgccacacttttctttatatctcaagtcacttaaaaaaaaaattagacttgacaagctttgtgggctgtagagccttcaaggacagctaaggtgaaaagcttgtgtttgtgacttcagtaccaaatagtctgtgtatggccactgaggaatcctcgcttagaggccaaatcttgctacattaaaaaacttccagaactttttaaaaaacaggtagaaaaaggccatacataggccaacagtgtcctagtcattattttgggttccaattaatatccccagtagaaataaacaagcattgttcattttcaaagttaattatttcttgaagctcctgggtcagagaagtctcttataagaaaatagttgatgaatctaacttctaaggatagaagacaaagtttccaaaactctctttggaaacaaaattatcaatagaaacatcaacattgaccatatcatcacagctgtggctattcactgggtcaccctccaccccatcagggtcaagtttctaaaagttgtcttccaggagcagggtcagaagccaccatgcacgtaactcaaaattccattttctgctaaatctcatctgttgaaacaccttaatgaggatttggtatttagcctgttttctctccccataatcaccaaatccactcaaccttcatttgagcagcccttgaaatattcactctcccctcccaccttctctctaaactctattacatggaatgagccaacttctctccctaatcccctttcctcctcctccatcaaggagtatccttctccatcctttctgtgattcagcagaagtagggtgctctcacctgctcaactcaaaatggcaggatgtcccttcatagagggaggcgggagcctcagaacacatgggtcattctcattccaccacatctaaattctctccactctcttattgacatgctctgcatgttttctggagcaccactggtcatcactgttccctacccagtaatattcccacaaggtgacccatccagaaaccaaccccttcagtttagtaggcacattctggaagcaggtgtggactgctgtacccagccctaaaaggaattggggcatagctaatgagaaaggtaatatactctccccttttatcctgtttcctgattcccctatggatctgtgtttgtggggaactgaatgcatttgccatgggcaggtacctatatcttcttctgagctccatggggcaagaagcactggaggtggagggacaagctgtgtgctccaactgagtcagcacccacccaggggccagaggtggcagagataatgatgcttcaaaattattttccagaccggttaaagaggaggcaattgtatgtactcacactgaaacatggtcagtggagaggaattaccatttaaaatagagcaggcaagccaaaggccacttttcttgtgattgttgttaggtactattttacctaagctaacactacctttagcacagttgcgagtatgtcataaaagacagatctaccaacagcagaagatgattctgatgaggttactctgagctacaattaaaagaaaaaggttctaaggctctgaatgtatttatttcttatagaatagagtgtaagaaccgtggatgctagctataaaacctgtgaaattgattatcatttcattttacaataattaatactgtcatcttaaatcattgactccagctagcattgattaggcacctctgtgttccaggtactatgctagataccacggcttcagaaataaatgaggcacccttgctgcctcacagctagggagacagcctgcattgctaaagtctgtattgtgatgtaaaagcattttattactatcatggaaagaaaactggttgcattactgaaaactccccccaaaccagggtggcataatttatttggcaatagtaattgaatgaacatgcattacctgcctcctgtttgcctaatacagaaccaagcaggataagatttaacaggtagaaaaagacaaggtgccctgctatgtcatagagctgcctgatcaaaggtggggatgtttgaaattgagtctcataagcagtgcatgctgggtgatcaggtgtgattggggctcagtgtgtgtggcacctctctggcctgagattttgacctgttttgttactatagaagtcaaccttgggaatggagactgaagggcctcctgggatttagcactttaaaaaatgtgccccaacttgtcactgacacctatgcaaagaaaccccaagccaatggttcacagccctggctgttcattagcatccatttgggggaggagtggagcttttgaaaataaggatacccaggccctacccggaataacctaaagagaacctcagggctggggcccaggcattactatttttaaaactccccagcctgatgagtcacattgcccttaatgtgtggaaaagaagctgagatggagcttaccagtaattgtgagagaagggccaactcctgacagctctctaattccacctctctatctgctgagacacccagggttagcaagccaagtagtgaaaagatattcatgagaatagttttgagccttgccagacagttctagctcatcccctgcatacaaagctaacaaactcctgtgctcatctgaactgaatgtcgtgcacatttttttctttcttgagacagagtttcattctttcacccaggctggagtgcagtggcacaatctcggctcactgcaacctctgccttacggtttcaagcgattctcctgcctcagcctcccgagtagctgggattacaggcacccaccacgacgcccagctaatttttgtgtttttagtagagacggggtttcaccctgttggtcaggctggtctcaaactcctgacctcatgatctgcccgcctcggcctcccaaagtgctgggattacaggcgtgagccactgcgctcagccacacaatttctagaataagaagctgtggctcaagtgtgtgttgtcctaacctcctgtagaccagtccgaatgaaagctacttagtcccctcattcaaactgttagtagaagtctctctagtaatacattcttcttggcgatgtttacaggatgttcagaaatataaaatggagagtgttatagattcagggccgtcgaaatccataaaaagaagacctgtatcaactaaacagactgaccacgtcctagaaataccgtgaagaccgatggtagtggggctgtggggatgaacatcgcccgattgtcgtgcacattggaaatgcccgtgtggacgattgtagctttggggaataataaagtttcataagaaacacattgaaaacttgagcacagaggctgaaagtggtggagggacagctaaagggtgtaagataaagaacatcagattgttcctggtggcaatttaaagttcagtgactttgaactcatcttcttttttggatttctatctctatatacttggaacaatttaacaacctccagttttaagtgtaatgtgttaaaaataaaaaccaatttgaggcacagatatcatatcacatttttgacagcttagctgcgtcttcagctgaagggcacaacttgtgggtcagtctgttgaaggtgaacgacagatagtaaaagagttctttatcatcaataggaaggattcatggcccttccccggttaccgtggtgattcttcactctccctgcttcttccctgggctttcttatctaacccctatgagctgtacaggtggtgcaaagaagagctaaggtaaaatgcccaatataacagaattcacaaaagaagtctctggcctacaataagttgatattttaacaagaaaatacagtgattaaagaggcaaataatgattgaaatgatatgtgcccgagttgtatatatttatgtgaaccacctccaagccattctgagtgacagtgggaagtaaatgaataatagattgattgctagctggctagataacaaaaatatacatggctagtggaatagaaggaatgtcagcttagcaataactttcccttcttatttaaaaagtgaaacattattttaattgaatgactaaagattttatacaataaaagatgaggaaggccatgagatttgtgctcaaggtgtttgtaatgagtggtgattgatctatgccatgggccagctgcaccctagcctctagcatctagtgttccatgagtttccatgacatttggcagctgctcctctatatctgtgggaaattggttacaggacttcccaaggataccagaatttgtagatgctcaagtcccggctgtattaataaaatggtgcagtatttgcatataacctacgcacattttcctgtaaactttaaatcatttctagattaattataatatgtaatgttaatacaatgtgctatgaaaataattgcattgtttagggaaggatgacaagaaaaaacaacatgtacatgttcagtacagacaatatgttttggaatattttccaccctaggttggtgaaatccatggatgtggaacccacagatacagagggccaactgtatgtggcatcggaactaaagttttaaagtcctttctgggcattgttgagcatagcagtgttgaagttgtgcagtttagtcactgtagccttcactctgcatcgatgaatgagagaggggagatggagaagatcacctcttctcacagcacacaaattttatgtttgtctcattgcagtgtagaaggtattctgttcctcctggggcttctgagctgtgggtcaggaaacagctctaacgaagatatttattgggtgtttactctgccccattccttaagctcccttctcccctccattcaaagtgcctatacccacaggcatgcagtccctggccatcctcagagggtctgagtcagggattgcttctccgtttctcccaccacactccgctgtcatcaccctcagttgtatactaacccaatcacatacagacaagttacctgcgggaccacacttctgccaggcatttgcattttccatatttgattttatgaaggatttgaaaattttttgagtgcatccatataggagttcctttgtaagcaattttgttattacactcagttttctgacatttccagaaatgttaatacttaaatggttgcagtatagtctaaacatcatgaaatctgagttgctgagcaacacatatctccaatcacctgcataagagagcaatgctaacaaacctactgatgtctcaccaagtgaaaccagtcctacagctgtgccacatttaggtctagtgtgtccttaggtcttagaacataataaatatttagccaatattcacattgtaaagtaccttgttcacctttaataccacacagaatatcatcacattcatagccaaagaagccaaggttttgactaaacgactgtcccgagccactacttggaatcccaaagcacaccttctacattgcaatgagacaaacataaaatgatctgtccccattcagtcatatttaggacttctgccctctacaaagcatttccttcaaaagacagggatttaaattttttttttttttttttaagatggagtctagctctgttgccaggctggagtgcagtggtgtgatctcagctcactgcaatctccgcctcccagcttcaagtgattctcctgcctcagcctcccgagtagctaggattacaggcacgcactgccacgcccagctaatttttgtatttttggtaaagacggggtttcaccatgttggccagaatggtcttgatctcttgacctcgtgatctgcccgcctcggcctcccaaagtgctgggattacaggcgtgagccaccgctcctggcctaaaaaaaatgtttttaatcgttcccatacataagtaatggacacatacattgttgaaatatcttccatcctgaacgtgtttttggtaagactgctcctcctctgtgtttgcctccaccctccggaggatttcagagaaccccacagaactccagtggagacattttctcctgccgtgatacctacctaccacccccacccttccctaaggaggcatttatttgtaacttacacccttcatctctcatcacctcagctgtcacaatcacccaagcctcctgggacgaccatcattacctggacccctcgatcaaaggctctgagcagccagttatcccccatatattccacctgtcttctgtccacctcccatttcttttccctctttaacctgtggttaaaaatcagcaaaattggccgggcacagtggctcacacctgtaatcccaacactttgggaggctgaggcaggcggatcaagaggtcaggagatcaagaccatcctggccaacatggtgaaactccgtctctactaaaaatataaaaattagctgggtgtggtggtgcatgcctgtaatcccagatattcgggaggctgaggcacgagaattgcttgaacccaggaggtggagtttgcagcgagccaagatcacgccattgcactccagcctggtgacagagcgagactccgtctcaaaagaaaaataaataaataaatcagcaaaatcccctgtgtccgtttcgcaaacctcttctgctcatctcctgtcggccctgaggacacagccccccgagccccctcctcgagggctgtttaatttcccacccaccctccctcccttgtgtcccaccctggaggtggaacagacgtccttcttggagcagtcgtctttcttgccccctcctcattgctcttttgagaaggatctccgctcccctccctcaagaaaacccccagcacctgtgaagtatcctcccaacagcctgtggccctcataagcccaccagtaccctgatcaatatacactctccatatcgtctctagcacctacattttcctccctactgggcttagcttccgtgacgttcccttgtctctctccaagttgcctgatgacccatcaactctacccactccacacctgccctagggcagctgactgtggctggagagaggcacacacggatgctgaccagtcagctcctttttggttcattgccacagcctccagccctgtccggcaccccggccacttgccctggccagtcagctcgctccccacccaactcaaggaccactccacatccccgtccccttccttcctcccttccctttctctcttctctctgttctctaagctccaacccttccttattctcagcagatgacctcacttcttctcattttccataagaaaatgcaaaaaacaaaaaaatcaagagtgaatatccttatcttcctgtcaccccatctaccagtctcttccccatgtccatggccacagtctgtttctgtgggcagtgaccccattgctcacttaatcttatccacctttcctgtcttgagaatgttcttcctgccatttttccctttctctcctatgtccccaggtttttccttctctgcattcagtcattcccatcagcacacgaaatactgcaatatcttctaggtgatctatgaaaacatctctccagccctcactctcttcaagcccatttctccatttccgtttaaaataaaactttgccaaaggcttgtctgtactcactgtctccccttcaccaattctcattatcttttgggaccgctggagttagacatttaccaacctgaccaaagaaagcacttttgtccccgtcacgaggacttccttcctcccagaccaccaggcagctcttggtcctcctcggtattcggttggtctccttctcctcctcacgcattgctcctttggtcttgcctgatgccacagtcacaccctcctgatgcttcctgtagttcactgggttccttcttggtctcctttgaagcttcccctactctttgcacccctctcaatattggaatgtcctcaggctgactcagcctctgccttctgcttttctttatttgcattcgcttacaggtttgcatccattctctttgctttaaataatatctatatgctgacgtccaaaattctgcctccagccctgagatcccagtttgcagatcctgcttccttctctgtccctcttcggtaaccatatacgtccccatgaggcagtcctagttccactccctaaagctgcttccctccctcccattgttcctggctcagtgaaggggacctcaggcccctgtggttcacaccagaagcactgcggtaaggcttgattcctctttcccacaccaatagccatgccaccagcaaaccctccagtgtggataccagatctgcacgcttcccaccaccagcacccttcaagcctgggccatctctcctctgtccaggggagtgacctcccaagcagctttgctgtggctactcctccccaaactgtcctggacacccagagctttcctgtcttcctggccccctgctcacgcctattcagtcccaggagcctgttctcacaccagcgaagccgttcccacccagggccttcacatctgttcttctgtgggctgggaagccaagatctgtgtcaccagggtctggttcaattgtcatctgcaggtccttctgcaacgttaaggctcccgacagcacctccctgaccccactccacaaaatagagatgccagcatcctcacccctacttttctatacccaccccgcccctccttccccgccccccttcctccttcccggcccccgctcctctttccccacccctttcctccttccccgccccgttcctcgttccccgcccccctcctccttccccggccccttcctccttccccgcccccctcctccttccccggcccccgctcctccatccccgcccccttcctccgtccccgcccccgctcctccatccccgtcccagctcctccatctccccccaccccgctcctctatccccgcccctgctcgtctatcccctaatccggcttggtttttccttccaagcacttgttagaatgccacgttagtattaatatgttttttgtaacttgtgtattgtttgactttgggtggcctatttactttcgaaggctcaaattcttcctgtagaatgcagataatggtatccattagtttggttttatttccattagagtaatatgtccaatattactgacattatagcaaaggaaagcaggcactgtcccagcccctgttcccactttacattggcacttgttttcaattctttagcttttttttctgataatatttagacttttaaggggctcaaaactctatcaaaaatcattgaaaacataaatagatgaattaataaagaacaaaatgcatactcatttccatgttcctaattcttattagatacaccaagactaatctttgtgtatctaattctcgttattcctgttctacttgactgataggataaagccagaatgagaggtgcatgattttaaaagatattacccagcttacttactaggtgctaactgtgtggcaagattctctgaacaatcccaagagaacaaagcattgagccccttaaaagtctaaatgttgtcaggggaaaaaaataaaaaatctaaaagaattgaaagcaatggcctctgtaaaggaggatttgggggtggagcaggtgactgcttttctttgctataatgttagtactatttaacatgttactttgataaaaataaaatctatttaaaaaagaaaaaaagactggaaggaaataccatgacaggttaacaggagttctctcaggtggagagggtggaattaccacctatttttattttcttctttatgctttgtaaattcacaaaataatctgtgatatatttatgcggtttttataaggaaaaatagtatagatgctttctgtatattaactagatgtcagaagcctaacggaggcttggtaggatgcattttgaatatgctctatattgaaaaatatcattcctggagcagaccagcttggagacaggcgagggtgggcatttggggctggaaaggacacaggcaggtaaacgggaagggaggacgctgccctggattctggttgccaacagataggtcctgggagcaaaggggtaaacccttgtggaaaatcttgaggcagcggaagagggagccaggcagagctggaaccaggtcggcaaaaaatagacagtttccgggtcccctaacattctgagcatcgtattttcatcgaagtcgaagcttctgaccagagcgggtttgtaaagggaccatttattcaacattcatgaaggaaagcaggccctacccgccaggctctctggagggaaggaggtgtgtcttcattcacatttggctctgttcacctccatgagagcgcagaacttcaagaacctcttctgacacaccatagaaatattatgcaaatccagatacttggaacttaaaaatgtccggaggtgaaaaatcactctgtcttgcccatctaacaggagcgtgctgtgttttgcaggatggatggtcacaataccactttgtagcctcgtcttcaaccatcgagagggaccggcaaaggccctactcctcctcccgcacgccctccatctcccctgtgcgcgtgtctcccaacaaccgctcaggtaagaggctgccgtggctagccagccaggctttatttctcgttgagcaaagacggtccttcccagtccgtgagccaacccgtactcagaggagagccttccattcagaccttcgctagaagtaggaaatgaatctgttctttgtactgtggtggccactctgtgttttgtatacacagactcagagcaaatctccttctctaacaggttcttatgcatgacatgcacgtaatgaacctgaattcaggaggaacgagtataaagaaaactgtcatgtgtctgcaaatccggggtttccgtggacaatttttccaacttaaaatagtttgagttggcctggcgaggtggctcatgcctgtaatcccagcatgttaagaggctgaggcaggcggattgcctgagctcgggagttcgaaaccatcctgggcaacatggtgaaaccccgtctctagtaaaaatacaaaaattagccgggcttgttggcacacgcctgtaatcccagctactcgggaggctgaggcaggagaatcacttgaacccgggaggccgagatttcagtgagcagagatcgcgccactgcaccccagcctgggtgacagagtgagactccgtctcaataaataaataaataaataaaataaaaatagtttgagttgcattttgtcataattgggataaaaagttgaggagaccaaatgtgctttcttccttcagtgtgatatacatttgacacatagcactgatgctttcataactgttccacatctaattggcttttcattattaatgataaaccggcagatgccactgataaattattatcgtagccaactataacttccatgtcattccatttaatttttttctaattttgtcacattcctattgcttaaattttgaacttcttgtattcgtaaaaatacttgatttttataccctttttaattcacattaagaaatgccaaaaatcagaggaaagatgaaaggcaaatgtgaacacaccatttagtaatataaatggcataaatttgctgttttcctcacagtttagtttttaaaacttttattttgatttctgcattttgattttgttctgagagtgaaagatggataacaagttatatgcacccacacagatgacagctatgtaggctcttatttatgaaagctttcttcctactcttctctgccctctccctgctgaggaaatcctattctctgaaatgacacctgggaggacctggtagagagcattgcccagcaaagtggtctccctacccgcgagaatgatggttgcagaactccacgccagactttactgtcaacatgatgagaaatgaatggccaatatctgactgaaataaatggcccgctcccagctctgtgaaagctgatccttctagtgtactgtcattgcttatcacatttagtccaaccctgggtgacgatcaggaaccccctgtacctgtggaaacgtccacccatctcagaagcatggaggtggcctcttaggcctcttatttctgtaattccagcaggcttaaaaagataaagcgcatggagtgtggaaagcatatggatggtgtcttttggaaagcagtgattattaagaattacagtgagccaatcagtgttatgagaatgaaacgacatgatggatcggcaagggctggaagagagaagcagccttttctcgcgagcaggcagggctgtgttcaaccagccatgcagacagtgcgctgcctcaggacttcctaggcgaggcacatccagacacctaataaacacttgtttgcgtgatttgatttttcccagaacttaatcctgatttaccagagacttggagcaccgctgtgtgtgaggtctcaggagataattacacacttgatgtggtttaataaacaccaccatctgggcaatattggattctaattttaaaagctgtggtcaacaggttttaaaatattgtcccttcatgattatgtggcagtaactcataaaaggctaacctttattagggaagacccagaggcaaaagggcaaaggcaggaagagagactttcctggaagagaaagatggtgaaccaaagagaagggggcagcaggtggaagaggttagcgaggaaccagcgagcagacaggaactggatgcagagcccagttgagtgacagggcacagagcttgctaaggactcagttgttcttgcagaggttccctctccaagcaacagaaccccaatcttcatacgacacagtggctgcccctcacatctccccagattcacattcgggacagagatggcccaagtcccagcctttgtcctctcccctggaacctctcttccctcacagcagagcctgggcattctctccacctacacagggtcactgtggatcagggaggttcagtccttgatcaagtcattgcagctccaggcttgtcctacaagtgatgaaggtgctgcagctgtctgagctgcatggttttcttccctgtctgccattgcatttgtacccaggacttctggccagctggcattgggtggggttcaagcctcagtattttttttaaaggattccaggtaatgaattctaataggcatccaggatccaaaacccgtgatggcttcaagagctgagcattgaggcgtgattttattttgataggtttgagagggtggcaacaacccatgtttatcttcccagcacttggctgtaacgtctgttgggcacttctgcctctcattctactttatttggacatccatttccttactcgattgagagctgcacaagttcaggaagagccacgtgatctgcatgtctgccttgcacagtggctagcacaggaatttgtacatagaagatataagggtgacaaactgaatcacatgactcagtgacatgagaggtgccttgggggaccacagacccaaggagcaaagagaccctacagagggtgtgaatgataagctcgaaggtaaactgaagtttggctggggaggagctttgacactagcaaaggaaagagagatttatcctaaaaatcagagtgctctagggattcctagccttaatagtcaccaagtatgctcagtaaatatggattctgaagcccgtcactgaaaattcagactcaaaaggtccaggatgggctctgggcatccataaattctcaagtgagtgttgagggtaaacaaggctctgaagcactgccctgggctatgggagctggggagagcttcctgacagaaggacacggcacctgagctcctgcggagctggacacagctgcaggtgcccacagggtggggtgcgcgaccagctgccccctcacccagacgcatggctcctgccaacctctcccagtgcccctctgcactggcaggaaggttgagttgctgccaatccattcagtcactcatgaaaattcaacctccttttactgacttccttgcctctgagttcagcttttcctctcttctagtaccagttttttaaggactcctggaatttcccaggaggatcctccaattacaacccagcactttagaaatgggtgtaagaggaacggcagggctcagcctcccagccagacaggcagtgagtggctgaggtgtaaggagggcctcagagattattggggtgtttatgcaaaaagctggagcaagaatgccctagcaggaactagagctgcctccatgcccctccccagcccaccccagccacagacaaagaaggtctttgtgggcttggttatttttgccccacaaatcatcctgtgtagagagctgtttcctctgacttttttaaaggcagtttctaggtgactcagtgtttaagtaaaactgcatttattttaatcaaggattagtcaatatcagtaatagatcttctgaaacacatctaattaaggaagggagcacgggaaggaaagggaaggaaaagagaagagaaaggaagaaaccaaaagcagtctcattcctaaactgccccacacaccttgggcaggtcacgtcccctccatgatctctctctgaggaagatggccccaggatgtggtccccagttgccagcctccaaatcacatgccctctaactataaagcatcagttgtcacaggtgagggaatggggcagggacaagagccaaaactgccaaaaaataaaaattaaaaagaaaacccatcaggtcctcacgtaggcattgagatgcgggaccatgcatagtgaggaccctgactgtgtggaaggcacacacgctgtgggatgagatgcagaaaatcccccttttgatttctttatgtagcaagtgccccagcttcacctcgggaaatgatcagcctcaaagaaaggaaaacagactacgagtgcaccggcagcaacgccacctaccacggagctaaaggcgaacacacttccaggaaagatgccatgacaggtgagcgcccctcgcgcgccccctcctggaacttggtggcttgacccgcgacaaggcagagatatgggacatcaggcttcacggggctggctgcgcttggctgctgagcaggacttagcagctgtccagtcacttgagagcttgataatgatgatttccaagaattgggactaagaatagaggcataactaagataaaatgttttctacccatgttttatcggtcctttcctcttgtttgcccagctcataatattctttcaaattagagagaatattcccacatatttcttcctcattgacatcacccactggggaggggactcgatggaggcagtgtagttaggccctgtgcattaggaatggagggaactgaaaagaaggtggaaggggaggggaggggaggggaggtggggaggggaatagagtggggaggggaggagaggggagtggggaggggagggacggggaatggaaagaggagggcaggaggaggatttaaggggaactgcatgaaactgctgttgagatattttcccctcttgccatgatacaacctcttacgtgacatatcccaaagaagcttccttagagctgatgactgcagattccctggggaggcattcatctttcacgctcgtcatccctcacgatctcagtcacagccattgccttcctttctcatcagccaagactctatggaggccagaattggtacagtgggtatctgtctctgccccctccactgtgccatgcccagcccatctgataacagggcttacccttaagtcactgtatagtctgtacgtcttgtacactctgtatatgcttctgttgaggcactcacagccccctccaagctctccatacctcaccctctccctggatggccctcctccaagaagcaggatgtgggctctggctgtagagggagttataccttaaaagcaaagctgccggagccctgaggacctttcaacggggaccccacatcctctttaccacatgggcatggagatgggtccctgctgaaaataggctatgaggaagagcctttaatagaacaaggccatgttagagcattcataaagctggggcgcaaagggcgccgtgcagacactgagaccctcttaggagaggaatctgaagagcaggaggcagttctccagtagtatttaggtgtagactggcagggaagcagagcagacaaattggatgatttattaaaatgccttccaaaccaggacagcgaagataaatttttctaatagcaaatgcatttaccccagcggcagtgttttccgtgttaactctgctcagctgcgtaaagaaaactataataaacggatgtttcttatccctgcccccaggagcacattctgcctccatgtgcagaccctacaagggaacacctcagcgctgctcctgagacgtttcctgaacgggagaacctaactcattacatggactctaggttactattcacattcactgtttccccttacatgttgccgcgtagatgaacaggaacaaagaaagctgtgaatctgaattctgagtccctggagtctagacattcggcagaggatcccatttgtactgattatgctgagctagtcatgacaccaaattcaactgaccctttcaatgtgcagttatcattgccctgggtagccacatcaccagctgtctgggatgatacactgagattaaggaacagttgtgagatcgactgcattattattcagtttcatgtttctctttaactctcttgcccaagagaatcattcaaaaggccttcaggtgtgggtgtgcgtgtttatgtcaaaacagttccaatggcacataattgtgccctggactcaaaataaaataaaacataaaatttactatgtttctgatatttaatcttcttagaaaatggcagggatcttgacaatttcagtgtatgtaattcttcaaacttatttagaggcttaaacagctttgctctaacttacttaaaaatgcaattcaggagtacactctcaatcatgtagcaagccagaaagaacattgagatctttattgaatattatgtgtatatagggaagttcctctaaagccaatgggtgctatgtaaacgccgattgttattatcacaacaatgatggtggtggtggtggtagtgagggtgatggaggtgatggtgggatagcagaagtgaggatagtggtggtttgccactttcagtagtggtatgaataagtccccagccaagccaggtggaagccagtctttcacatattgatggggatattgagtttacaacccccaccttgcaggatgttagcaaatgcccatcattccagggtttacttgcaaaatcagatttcttgtggccccaacatcaaaagcaatgctttttcttgttcaagaacaaatctacggaacatttaaagttcagtgcattgaaagataacctgaaaaactgccatcttccttgtttcattccctgccaagaaaacattccctctgatatgaaaaccacaagggaagcttcatccccaaaatgcagcctatgagggctggaagtgcaaacatctctttgatggagctgtcatctcttctgctgagctcttagaagttcagatccatctaggtgtttattccaggcttcccccaccctccttttctggattcattttctagcttggatgaagcctcataaaattcttctctcctaagtgtttctctgccactggagagccctgagaaatccagttggctattcattcaggcatgccggcttccatagcgagttcttgcagccctgcatgcctgggaacctcacgtgttcagttcacctcaagaaagggctgcagcatcccagcagctccactgcctgagttttaaattcacctggaggttttcccttcccatctgaacttcccacataccctttcatccaatggtctgtttgttttttgtcagtgtctttcttatgccatttatttatgtatttatttatttatttatttatttatttatttttgagacggagtttcactgtgtcgcccaggctggagtgcagtggcgcaatctcagctcactgtaacctccacctcccgggttcaagcaattctcctgcctcagcgtttcgagtagctgggattacaggcacctgccaccatgcccggctaatttttatatttttagtagagacagggtttaaccatgttggccaggctggtcttgaactcctgacatcaagtgatcttcccgcctcatcctctcaaactgctgggattacaggcatgagccaccacacccggcctcttatgcctttgaaagtcgttctagtcttcaatgtgttgattcagttgggaattgggtatttgggggctgttagaaaaatagaaaggcattcttctgtgagtccactattagctcggtcatatgagggcagagcctctgtgaattcctctgcctcacgtgtctgtaaaggtaattcagtctcagctatggtctcgtttaaacgagtgaggggaaagaacttccagtattaacatcctaggctcagaagccacaaactgtgcctcgtgcttttaagattcctctggtgagagcgtctcagtgtctgtttatgatttcacaacagggagggaggccaagactgcaatagtgcaaacgttctaaaaaatatatgcatttaattctgagcaacagaaaaaacaaaatttcaccttattcctcaagtgacattttctatcagcaaattatagctctgaaggcagatctatctaaggtttacccatttattcattcagcaaatggggcacttactctatgggtgtccactgaggccaggtgctgtgccaggttctgaggatacatacggaggtagcagcaggacagactgtttctctctcaagggccttctgctctggaagaggaaggcagacagtacataaggtaaacagtataacaagttcccagcaagatgatactgcactgtgtttagtaggaagaagaaactgatcagggtaatgagatgggggtgcaggcggaaggggttacttcacttgacgtgggaggaggagacatttgaagtctgagggaagcgagttccagggagaaagatcagcaaagacaacctcaccgaagctaaacaagtttggcccgctctgaggaaggagggtcggcaaagctgggactcctttaacaggaggagaggagggagaaatgtgttaggattttaggcaggaaacaaaccttgcagggcctcatggccatagtggagagccgtctcagggtgaagggcattggagcattacaagcagagaaagagacagaacccaacttgtgttacaaagacagcattctaactgttggtaacagggtggatggaggaatcaggctgggcagagtggaagttgggccttcgaggaggatttggtagcaatggtccagagagagatggtggtttgcaccataatacagagacaggagtgacatgcattcaaccagagaggataacagaatggtctttaaaatggaaaaatggactttcggctctcactttctaagctgaattctccaggaggaattttattgcacagctgtagtgaactcttaggtaaaaaatcatgggtggagtgaacttagaccttgagaggttatactgacctttctcttgtggcctataggtagagtgatcctacttcattatcccctaaatactggaagcaaacaatgagcccttcctagttttagagtgttttataccccactgacacaagacagcattttccaaagcttttttaaaaaaaaatttatgaatacataatagttgtacttacttatggggtccatgtgattttttgatacaagtatacagtgtataacaatcaaataagggtaatgagataccatcaccttaaacatttattatttatgttaggaacatcccaattccattattctagttgttctgaaatatacaataaattactgtgaattatggttgccctatggtgctatgaaacactagatcttttctcttctaactgtatttttctacccattaaccatcccctcttattcctctctcccaactccacttctcagtctctgataaccatcattctactgtccatcttcatagatcaattttttttagcttccgcatattccacatgtgcgtgagaacataccatatttgtctttctgtgcctggcttgtttcacttaacataaatcacctccagttccaccacgttgctgcaagtgacaggatttcattctttttatggccaaacagtactctattgtgtacatataccacattttctttaaccattcatctgttggtggacacttgggttgattccacatctaggctattgtcaacagcactgcaataaacatgggaatgcagatatcttttgatacactgatttcctttctttctaatatacacccagcagtgggattgctaggtgatatggtcattctaccaaagatttcttgaaccatgacccttcagcagctgtgaagggagtggtggcctgtgcccttcctctgagtgggtggcttgagcttcaagggtttcccataaggaagtgggctaataggccccctctctgggccttcagaagctgctggcaactagaggagaccttcatctctttcgtctagacgacaggcaagccagacaacagagtgggatcctccctctgcatctagtttgattccaaagccgcaggcttccagatacatgggggacatgcaggcgatgccccctgcccgtcctttgggtctgtaagaaatgaactgtctgaaagatgatcaagcacttctgtgagctcaaattagaaattttattcttgtcactctccggctaaaagctaagctgctgatacagactcctgcatgcttcagtgcaggtgacaagcctttattacctgccagttttcaccagaaaagaaggccataaaacttacaaaatgaccatctgtttgcagcatctgccctgaccctgtctgtgatgtgaacattattgcaagcggctgacatgctgtggggattttctagaataactgttctccttttttaatatctgtatgtaaaatgaagtgttcagggccaaagaatgtcttctacttggaatggtccccaagaaaacaagctttgttagggcaagaacttgcttcaataacaactattccttatttgtaatgttgttttctttgctaaacttttgttttccttttgcttttagctcaaaacactggaatttcaactttgtataggaattcttatggtgcgcccgctgaagacatcaaacacaaccaggtaaagtaaatgcaacacgtttgtatttccttttcagtgtgactcatgtgaaataacctggaattttaaacataaactttcatccaacatacataaagaactgaaaaagaaggcaacgtcccctgaggccctctcctcacgcctgttgcagcgtgtgtgtgtctgtgtgtgtgtgtgtgtgtgtgtgtgtgtgtgttggactcggcagaacagcctcaaatgtgcaaacggcctttgaacctcatgcttgatctggtgcagaaggcaagtattctgctatggtgcaaaactaaaagaaacccccaaatagacaactgtaagatgtcactaaacaggaattgtctaattactggacagagatggagtagctcctgtaaccctgcaaatgcattaggaaggaagcattcattatacatgatcactaccaataaaggagacacagcaagttcaatagagaacttgtaaaagaacacataaataagttctattattctgcaatacatgaaatgcattgtagtgtcttgctactcaaagtctagttggggaaccagcagcatcaatgttacccagaatcttgttagaaacacaggagagattcttctctggctcctaaccctaacccgtccaagattttctgcagcacagttgcattctaattagatgcgcttgtgtgcacattcaggtttgaggagaactgaacagtagattctttttattattattattattttatttttattattatactttaagttctggggtacatgtgcagaatgtgcagttttggtacataggtatacacgtgccacggtggttttctgcacccatcaacccgacatccaaattaggtatttctcctaatgttatccctcccctagcccctgacccccagcaggccccagtgtgtgatgttcccctatgtccatgtgttctcattgttcaactcccacttatgagtgagaacatgcagtgtttggttttctgttcttgtgatagtttcctgagaatgatgtttccagcttcatccatgtccctgcaaaggacatgaactcatcctttttttatggctgcatagtattccatggtatatatgtgccacattttctttatccagtctatcattgatggacatttgggttggttccaagtgcttgctattgtgaatagagtgccacaataaatgtacgtgtacatgtgtctttatagtagaatgatttataaccctttgggtatatacccagtaatgggatcactgggtcaaatggtatttctggttctaaatccttgaggaatcgccacactgtcttccacaatggttgaactaatttacactcccaccaacagtgtaaaagcgttcctatttctccacatcctctccagcatctcgtttcctgactttttaatgatcgccattctgactggtgtgagatggtatctcattgtggttttgatttgcatttctctgatggccagtgatgaagagcattttttcatatgtctgttggctgcataaaagtcttcttttgagaagtgtctgttcatatcctttgctcactttttgatgggttttttttttcttgtaaatttgtttaagttctttatagattctggatattagcccttcgtcagatggatagattgcaaaaaatttctcccattctatagttgcctgttcactctgatgatagtttcttttgccgtgcaggagctcttaatttaattagatcccatttgtcgattttgacttttgttgccattgcttttggagttttggacatgaagtctttgcccatgcctacatcctgaatggtattgcccaggttttcttctatgattcctatggtcctgggtcgtatgtttaagtctttgatacatcttgagttgatttttgtataaggtgtaaggaaggggtccagtttcagttttctgcatatggctagctagttttcccaacaacatttattaaatagggaatcttttccccattgcttgtttgtgtcaggtttgtcaaagatcagatggttgtagatgtgtggtgttatttctaaggcctctgttctattcctttagtctatatatctgaacagtagattcttaaggaaccaatctgagagagagagagagagtatatgtgtgtgttactctgcaaacatttattgaaggctcattttctctggctctgcaggaactataaaagccaaaagacacagttgttccccctcgttgatcagaaacttcatacatctctccttcccatggtgggcatcagcccactccatgtgcagcactctggaaaacatatggtgttgtctgtgaccccctggtgaatggcttggcccccatggcctatttgatgtgttgctaacatctaatcagcctcccctcagttctagtatttgctaaaagcaaagaagccaatgactaaataaatagggtcatgagctgtagacaccaggtcaccagggaggccccaactattcacttgccaacctgcctccataaaggcaaacagaaacaaaatgtattagaaatgccaacttcatttatggaaatcaatcatgcttcttgcagcaaatattatgaaattctggatgtacagtaagcagattattgccaattattacagattcttgtcaggttgtaataggaccatgattttgccgccaagagtgtgagattcatcttgagtcccctcaggtagagagaagctcctcattggaaccagctccctctgcaccagccttccttccccgggagttggcattgaagaaacgccctgacatggccaggggtctctggcatctcacagagtggctgcagtaggttccaaaagactgcttgccatctagatttagaggacagtctataatggctctaaggggcaccttctttttacgtaagcagatcccgagcatttaagcaaatgagaattaatgtgctaagatggcatccttgccatgagtgtgaacaccacctagccatagcctttctcccagaggtctccagaatgtgcttgactcagtctcagagtgaaacaccaaggccactgggcctcaggcaaatgttgctaaaatccaccctggatggagagcaagctccgcatctctcgtcaggaccgaggcattgcaggcaagcccccggcagagctgagtcctatcttcatagctcaggaccaccatcattccctgtaagggaccagccaagggaagtggataattggatcattctatcttagcctaacatccatttttaaacgtccaccaaagagagggttcccccccctccccaaaaagtatttccaaggagatcataatgacactccattgaacttggagaggaaggaaagaaagcattttacttcttttagactatgttataggaataaaccttgtcttcacttgcagttttctctttggggactcaataaagtgcaaccatcctaacccttcaaaagacatgttttcactctcttccggttgggagtcctagagaggactcataaacagtatccctgacttggattctctggccatagaggtgtaaccaaccattctaggtggaatgctttcatgttgggagcttccctgggccaaaagttaccccagaactttgcgcctggaacagtttcaccaggagggatcctccagggtttggtcagtttcagcatcgaagcttgtcctctgctgagcgctcctgtctcccgggtggctcagtcaccagccaggtctcacaggcttcacactgggtagtgactgagcttatggggaagcaattcatggagggaaatcagtttcaagtggatctccaagataaggcaaaagacagtgagagctgagaaagagacgcctgcaccagacacatggccacacgtgggtgctgctcctgtgacctgggactcaggcacattttcagtgaactctgagcttaaagcctcctagaagaaacaatcagtagtataaaacacagttcgtgatctttggtttgaatgtctgaggtcaacgggttacagacatcactttaagacttaactgactaggtgcagtggctaatgcctgtaatcctagcattttgggaggccgaggcaggcagatcgcttgagctcaggagttcaagaccagcttgggcaacatagcaaaactgtgtgtctacaaaaaatacaaaaattagctgggcatggtggtgtgtgcctgtagtcccagctagctgggatgctgaggcaggaggaaggcttgaacctggaaggtggaggctacagtgagccataattgcactactgcactccagcctgagtgacaaagcgagaccctgtctcaaaaaaaaaaaaagacttaactatgcatactttccaaacatccttttgagcttctaccagtccaccccataattacaaagagaaatatcatgttgaacggtatctatctagctgacaacaggatttttgttcaggaactagaaacaaagagctttgctgttttgatgaccaatatttaaatgataacaaaaccggaatcttgagttccttcctggtgtccttagttccactgtcacgtgagcaggccagttgtaattgtctgcagaaatgaggaagatgagatcccaggaggatacgtgtttccttcagtcccccagccaggaagaggcaaatactcatcttggttcttctgtcttcctgtcccattttttttacctctgtgccaatggttctcaaattggagcatgagccagaattccccaaagggctgttaaagcacagattgctggggcccatcgccagaggccctgattcagtaggtctggagtgggacccagtaatctgcatttctaacaagttcccaggtgatgctgatgctgctggtcttgggattatgctttgaagaccactgatacttcatatctggcctccttcattttctgtgaacactctgagtctttctatgaacactctgagacatggaaaagttggaagagctatactgggctactatttcccttgtgttcaaaataaatccagtttcctggcaaattcattaaggaataaacccaaagaagtcttttgtcattatgctaacagagttggaaggtgtcatgacactatccttcataatttagagtgaatattctactgttgaggaaaaagttcagcaaagatgacttggtagaaacagaagccatggaacagagcgcagagagcgtgagcatattgaccctggagtgagctgctggtcaccacccctttccaaaacaagatgcagcgttaaggcaaagaaggcaaaagcttcgggcttgcgtattcctgggcttctctagaccgtaacagacacccagattcagaaatcccctctgctctattggggcatcattctacatccctcatccaaatctggctgatgcaaactgtgcaatttttaatgcatttatttttagctcttatgtgaggagggctttgggaggggtcatttcatcagccagattttcaactgtcagatattcccttaaagtttaaaatgcagccaatattcctccactgtggatgtgtttcaccagcaaacgtccataccacaagagcaaataccacaagacgtccataccacaagagcaaataccacaagataccacaagagcaaataccacagaaatgtccataccacaagagcaaataccacagtgagcaaattctgtctctccgggtgcagcagtgacacgtgtcacctgtgacagttcatttgtacacacttttgggactggggcaccaaacctcagaagtgattggtgtgggattttatgaacagtacagatgaatgaagaagttaattctctggggtaagaggctgaaaaagctgatacccagctcccaaatgttcaccaaccagagagaacatgacaacagtcaaagcaatttgaacgaggttgtgcaaaagaaccaaaaaaatgaaagcagaagccactttggaggagagctataacccttgtgagtgactcctcctgaagatgtccctgtcccctgcactgccttccctggcccccaaaaatccataagaaaacacaccgcttcttggtctcttttgtccaccgactttcttatcttagagcctagagtcagctccttgaggcctgtcctccaaggtttggccaccttggctctgatgggactggactacgttggtagaacacctgggttttagagtcagccagccgtatgttccagttccagttcacaacaccactagctatgacgttttggagaagtttcttaacttctctgtgcttcagttttctcatctataaggtgggagtttgcttgagggatggatggatggatggattggtgggtggataggaagacagacagatgatagattatagatattgatgtagacagacacaaacacacataaatatttatgactactggagtattaaagaatttgctaaatgttgaatagggtgccctgctgaacaagaaacacagcaaatctagttccctccctgtataatttttccaaacttctagattctgagcctttgcatgtcttgcacttggaaaacagccctgtgttggagtggagttcagcagcacacaagcagagctcttcaaagaatagcaaagggcaccccaacctagcaacgcagtccagtagacctggacttagcagtatttaattgcagatgttgcacattcattccaaatgttcctctcatcctttgttagctctcaggctaacaaaggtttatcctctatggacttttggacttctgtaggtagacagaaacctcattcattcagctaccactaactagacacgtgggacatcctagacagctgctgtgatgaagttcaccacttctttgaagatcaggttgattactagtataaatcaatgacatatataagagggagtttcacttacttgagagaagaattatgtgtaagcctttaaaagcattcatttacacacaacgtgctaattacaaatcattatctattaactaagaccaatttctagagaacgtttccgtgctgaactttagttaaattaatagggagtcactgagtccacccaaaagtgatcaaacagtatttctttaagagtgtttaataattcacaccagatctcctccccaattactgcacattagcagagctttgtgcatcccggtatgcacttgctgtagggttaacctcaccctataccttgggaggttctgctcatttcaggggcaggtgcttgaaaagggaccccagggactagaacagatacaaatgcaccaatgtttattgcaacattatttacagcagctaaaaggtaaaaataacccaagcgtccatcaatggatgaatggataaataaaatgtggtctatgcataccatggactattttattcttatatatatacaatcatgggggtgcaagtgcagttttgctacattgaggtaaagtcatggccttcagtgcattcatcagtggagcaatgcacatcatacagtggaatattattcagccacaaaaacggatcaaggtctgccatgtgcaacaccatggatggaccatgcaaactttatgctaagtgaaagaagccagtcacacaaggacaaacactctctgcagtgcctatattaggcagatttctagagacagaaagtagaatggtgcttgccatgggctgagagagaggggatgaggaattacatttaatgggcacagagtttctgtttgggatgatttaaaaagtggtggaaacggatggtggtgatggttgcacaacactgtgaatgttcttaatgccacctaattaatcttacacttcaacatttcttaaagcaagctgttttatgttatgtatattttgccatgataaagattatgtagaatgatagcacgtggacctaggatccaattttcaaaaggaaagccaatgacagttggcagttttggagaagcagggccacagtggtgaatgcctggatatacacagcctattctttgaaggagagttgggtgccggggcaagaggcaggctgagtcaagggaaaccaagtaacccagtgtggctcttctttcccgtttaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtgagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaagaaattggctgccatcgtcctttaaaactggcttcccttcacgctacatagtttaattcagctccaagtctcaagtaaatggttctttctccaaatttaacaacaatcaaatgatgatagtcaattcacgcatagttttggaaatgaaaagttaactttcagaatagagcagtagacagaaatgtatgtgtgaattatgtactagttggacatacaggactccacatttctggattccctcacaggaatgcttcagaccctctagagagagagaaacatggcacattgaagacagggtttccacttcatctgtatcatacaatgcaacagtaaagagaatgtgatatggacatgacttccctataacataagggctggcttaacctttccagaagaaagcaataggactcattctctggttggagttgtgccacagaattaatgtgctatggaattcctcctcctagtagaaaccgtatattttctttatgatttttgagtcttaatgcatgccctacatttgcgactcatgaagaccaaggatgtctttgcatcccataattctttgagagcacattgtgccaggctgtgattagctgactcagctaggagcctccagcatcagaaggagagatagtgggaaaaatttaaaagtgtttgtaattattcaagccaatccatttttcctttttaggcacatatacaaatagattgaggatagatatagacagagagagagagagagagatgacagataatacatagctatagatagatgatagatggtggatggataggtagatggaggtaggtaagtcaatagatggggtcttacttgaactatgaaatagcctaaagcccccacaggttcccttggcaaagaaggttggtcagccagtgatttattgtttgtaacatgggatgtattggataaaagccccaagtgacaagaagcctttgttttggctttgattgtcctgaaagtaagtaagaccccctcccacaagtggctgtgtcttgcatctacaagagcctccagaccctgaattttcctacagaaatgggaatggtgtttttcagaggaaagaggggaagcgaggaaatttctttttctgttcagtccctatggtagaccataaaaacccaatgcacttaataagatgtacaacacagacccccttttttttttgttcttgagggtattggtcaccagggactgattaagaaacagtccctataccattataccattatggataatagtagcatttaacaataagatctttttattatcacacattaatgttatgatcctcattaagagttgtgcattagacaataaaatatcaggtttagaagaatcagggtgacataagatgtcacattgtatttggagctaacctaagtgaaggttaaccaatgatgacccatttcatattaatgagactcgtgcattatggaaagctgctgtttaaaaaagcagtgtttaaactcagtaggaaaaacaaacaaaaaacctcagtgtatttggtatgtcttgtttctcttcagctcctttttaatgtctgatactgtccccttcgtctctgagaaccgtgcccccgagaagtgaggtctgactgtctgaagatacagtattctcactcacacggcaacagggaaatgaacatggctcttgtctgacaaaatgctgtttacaaaagtattcatccaggctgttggggtctcttacctaccaaatagaacactccaggcgcctcagctcacctccacctcagacggcaggagaagaaaggctgcggccagtcggttcacagaaacctgacctttatctcaagaccaaaggaacctctgtgtgacaaagagaaaaaaataagccagcaatcaggggagcccatggagtgctttagagatctgcacatcacaggctggaggctgctgacatgccggagactgctgacatgttgcaggattttccatggcaacgtttcctgtaaggccccatggctccactccccatctgacatttcatttctacactgtggtcgaaatgagattataatagaaactcatgccgggtaaccatctcatcaagaccaaactgaccttcctatcagcagccttgtatccctgggtctctctaaaatccccaaatctccaaaaccaaaaaaacactctgtaatgcacttggtagcaaaagctcacctgaacaaactccaagctatgaatggtctttgtttctccgacctcatgagactcctccgatgtttctcacacatggtgcatttgactaccaggtcctgcccagactctgctgagcttgttatggactttgtggtgcacacccaaattaccttctaaaatcagaaaatttcttagttcagtttgccccaagggattcacacagatgagcttgtacccaagtgcttaataagagaactggacttatgagttaccaaagcctggttcggctctcagaaccagttcccttcctgtggtgcatttcagatcagaatctacattaaagtgtgctggtctccatcctgcggagaggtccctgtgggcaagagagcctcgtgcacaccacctcatcgcaaggcaacataccgctttgtaacctgtaggtacataggaatgagacttctgggtgtcctcgacaatgcttggctgtacaaagcaaagagaccaagatctccagttgcttgcaaacaacaactagaatacacccaagcaggggacccattaatgttttttccagacagaaggtttctaatacagcccctgtcgcaatacccagttccaaactagcaaatcaggcacttgaccctccgtctcttcatcagttccatcataagtaacttgtctgcccctaaagctcatcagccacgaaggatagagaagaaataagacccacccccaactccctaagcacactaggtaattaataacgaaagtggagttttaactcaagtttgggcctgtaagacaatggaattctccacataaacttcaacaataaccacataaaaatcacacatttttaaactttacaatatttgattgctcagtttctcaataaaatgaagacattatgaagcacctggttctctgtactggaacttgcatgcatgacaaagacataaccccagggtggtgaggacaacaatctcagagaaaatacaagataaacatactgctctactgcagggcttctcggccagtgcattactgatttttgggctgaataattgtctgggggtggtgtgaaatgctttcctatgcattctaggatatttatcaacatccttggcctctacccacttgatgcttacagcaccaccatctgcagctgtgacaatcaaaaccatctccaggtataagcaaatgtccccagggggcaaaatcggccccagttgagaaccactactctagtgtgatgcacgatacgctaaccactactgagttaaaggaagggaaaagatgcactcctagctgagtgatctgaggaatacgagacagcagagatggtgtttggcaagaacgtaaggagtggagaggcttccaatgagcaatgatgagggtgcttcaggaaaaagaaacaagtgaaggagaagatggaggaaggatagggaatgaacagagaacaatttgcaatacatttcactccaaaattaggagtaggaggaggatggagcgagagagaaacccactagggacaaagtttgaggcccttgaaagctctattgtgacaggtgtggtagcgtgtgcctgtagtcccagctactggggaggctgaggtgagagaatcacttgagtcctggaggtggagattagcctaagcaacatagtgagatcctgtctctaaataaataaataaataaataaacaaacagacaaaaagaagaaagccatattgcagaaacactacaaaaaaattttacaacattgttgcaaagattctggggtgtgggtgtgtgtgatggttgtaaaggtaagatctagataagtgagtctcagacttcagcatccattagaatcacctggagtacatcacctggatggcttattcagagagtttctgattgggtaggactggaactggctaagaatttgcatttccaagatgtttccaagcgatgttaatgttgcttgtctgggggccatatgttgagaaccactggtttagggagaatcacttctgaggctgttgtaataattaacctagaacctcgttactcaaagtgtagtccggggattagcagcatcagcatcggctggtagctcactagaaatgcagactattgggtcccacaccagaatctgcattatcaaaaggtgattttttggaacattaaagtttgacagccatgatccaaaaaacacataagcgtctgagctaaaagaatgacagtcaagagaaataaaactaatgtgaaatactgtagaaataaaattagtagaccttggctactgctcagtgaaggatggaggtacccaaagatccctctgaggtgtgagcctaggtaaccagaagtccagcacatattataaccacataaaaatgtgtgatttttatgtagttattgttgaagtttatgtcaagaattccattgtcttactaaggcccaaacttgacttaaaactccactttctttattacctagtgtgcttagggagttgggggtgggtcttatttcttccttatccttcgtggctgatgaggctttaggtgtagacaagttacttatgatggaactgatgaagagacggaaggtcaagtgcctgctttgctagttgagtttctactcatccatgacaaggaggaaaaacttttccagcgaggaaaatccacttggttttggacatgtgaagttgcccatgctgatggcaattacagagggcggtgggatgtgcaaatggtactttgaactagagatgtggaattgggtgtctctttgaggttaaaagctggaaagtgggtgtggacagagcatccatgaaaaagaagatttggagaaaagagagtcccagcatgatgagaacccctggggaagcagcgtgaggcagaagaggactgaggagaaagccaggtggggtggaggcgggaagaatgagaccagtgtactttatccaaaccagggaaggacagcatttcacgtgcagagagcagcaaatgccactggtgggcacagaggatgacaagaagaaaaatggccgaaaacaaacctttgcacattgcaatgtgcagactgcgcaggactttcgggagtagctccggaagcaggtgagggtgagtgaacgggaggtaggaggctgaggcagtgaaaagtttgggaatgggctagcaattgagctgagaccctgggctgggacaatcacataaggaatgaagaactattttaggacagcaaaataaacttttaaaccaaggcaaaggtaattcatgcttgtgcaaatggtttagaaacaaccccttctatttgtatggtattgtattgccttcattgtattttaacatttgttctccttgtcctgctcactactagtatcctcagccttgctttcttttagcaaaggggaataagggccaggcacggtggctcacacctgtaaccccagcactttgggaggccgaggcaggcagatcacctgaggtcgggagtttgagaccagcctgaccaacatggagaaaccccatctctactaaaaatacaaaattagtggggcgtggtggcgcatgcctgtaatcccagctactcgggaggctgaggcaggagaatcacttgaacccaggaggcggagtttgcggtgagccaagattgtgccattgcactccagcctggcaacaagagcaaaattttgtctcaaaaaaaaatggggggaaggggaagatgctgtgatatcatgcagctgaatataaaattttgcagctggatattcaactggggcttttctgctcaagagatgattacgagtgtgccaagcaaaggggacataaagaggaaaaagtctaattcagtctaatttttcagggtccaccctttactcagcaccatgacatccacacagggcaacatggaataagtctgatccttagctctgtgagtttgggtgtctattgctgttcaccatgcagccgacaccaccagtacctgccacatcaattactgatctctcttctagactttcatccttactaccccattacaaccccatctgctccaggctacttatcctcacttctcatatgatcagtctaccagaagcctggcccttgatggaaccgacactatgtttttgttcagagttctcatcacagcttccattactcgctcgctcagcagagaagccaggtgcctatttcctaatggctgcaaggattcttcatgcctcataattgcaagcagacatctgtgagataaccacacagttaagtcatggagcaggggaaagtaaactggcctttgtgggaattacacccaaaccatcggccacattaagactgcatgtgcacacctgagctaacctgtcatcaatggaaacactatcccatttctactacctgaatatacagccaactcttaattatcaaagacagagttgaaaatcacacacgtacagaatttaaactagactaattctgattttctattgctctgtaacaaactgcttcaaaagttgtgctttaaagaaagaaaaagagagagagaaacacttactttgttcaagactttgtaacctggattgtactccactgggacaactcagctgtgctgcactcagagtcagctgcggaggcacggggctgaaagctggactcacttaaaggctcaatcacttagctgtctggcacttgggctgggaagactcaagtagctggtacagggacagctgtggctcctcaggcgtcctctgagctcgctccaccaggtctctccagcagggatgcttcagggcagccaaacttcttacatattatctcaaagctcccaaaacccatatcccaaggcaaaaagccaggcgcaaaagtcgggatgcattccatcagtcaatgcagcggcaaaataatgctcagtttcaggggatggggtgggaaacagactgtgtttcttgatggaagagtggcaagattctggaagagcctgtgggatagaaatactacagtggcctttttggtacaatctaccacaaagcttgtaacattttgcagcaatgggttcagcttcctctttcaaacatttagccaatatttcttaataatggcaaaaatgatgagttttgctagaagaagtgaaaaacaaataatgtaactaacgtaaatgtgagcggagaaaaggttttggatcctgagtttttattttcctccagctgaatgagaaggaagcattcagccaatgttgttcctggcagccatcttatgaccatgaggagcccaattaggctaaagccaaagtggaggagagcagaacaggagatagaaataacctggctctcttctaagagcactaaaaagcaccaatcacaagaatattccacaacaggcaatggtcaagtactcacgatcacattatagagacccttcctgcccactcctaggaagtaacagaagcctggaccgatggaagcaatctcaacacaaaacccagttaagtactcatattgtcattttattataaaaagaacatacttttctgaaaagttaggaaaatataattacttttttaaaactcaatgccaattttggtaagcagaaaagtgttccatagacactttctgtagttaccatcctgatatatcttattcattcaaccaccagtaaaatatgctgcagatttacaactgaaagcatttgaaattgtattattgcctcaatacactattaagagcaatttcaggttcttaagtaattatgttcttcatgtgttcacaatgtataaccaatgagaacaatcattgaaagatgatcaaattgttgaaacaactaaggaataacacacaggctaggaaactgagcaatgatacgtctttcttctgagtcgggctttgagaatactgtttccaaatgggaatgcctccaaaatgcaaggccctttatcgcttccttttctgctaacacacgccacctaaattaccaatgcaatgtaactgcctgctctgtttccacaactcccagtcccataccttctaaggggagctctttgccactaatccttgggccctgttaaaaataaagagcattcgcagcaaatgaaacatggcccagatgaatgccgccagctttcaatagccagacactcggcattacaggtgcaataatcaacctgccaacaactgcttcactggtccaggcacactcctgagctccattagagaggtatcccaaccagattttctgttcactcaagacccaagattctgaagggcagctttacttactttcctaagaatttctaatccgtaaaaaactaaagccactggccaagatacacctgaccccagagtgtgctaatgacaaggagactgttctatcccccccaggaggagatgactgtgcaaactgtgtgatgaaacggccatgaatggaaaaggaaatggtgtttttaaatgcttctattttgttttagactgttccagagatgtctaaaaagtcagaaaggagattggcagtcccttttaggtagaaattcaaagtcgctaggttatcgtacctgcactaggtaatcgtaagcaatttatttatgcaattaactttgaccctagcaaaggtttaaaggtagaactgaccagaggacgtggtaaagaaagtcattttgtcaggtccactcttacagcaaatgtcaggcccagggtcaggttctagcccatgctgaggtctgagaggagtgggtaggtggcagatagctgaaagaacacttggagggccgtaggtgggcgaaatgtagttttattcagtagctctttcatcagcagcttactcactctagctctctcttgcactgtccacccttatcttggccgtctgctccagctctgtggctcctctcagcagctggctccacagcccctgccgcccccacacctacagctgcactcctttacctacaaggccagctctcccttacaggtgtcagtagcattactctctctctctctgggtatgagagccaagcagcatgtatcagcatcagcagggcagttataccctttacagataatagtggcatacggccgggcacggtggctcacgcctgtaatcccagcactttgggaggctgaggcaggtggatcacctgaggtcaggagtttgagaccagcctgaccaacatggtgaaaccccatctctactaaaaatacaaaaaattagatgggcgtggtggcacacacctgtagttccagctagtcaggaggctgaggcaggagaatcgcttgaacctgggaggcagaggttatagtgagctgaaattgcaccattgcactccagcccgggcaatgagaaagtgaaactccatctcaaaaaaaaagacaatagtggcatagagccaagtatgagcttacacaaacaggttatgtaacaagtggaggtgtgcacctgcgtaccagtcccgctgagtcatgcaggcctggatgtctgcctcggcctaattcttgaccaaagtacgtccatgtaccttacagattaaaaaaataatttaatagaaatagagtaagaaaacttcctgtcttgttaatatgaaagcatagctagtgtttcactgaatttgagtgaaataacctcaatttttttttttttttttttttgagatggagttttgctcttgttgcccaggctggagtgcaatggcacgatcttggcttaccacaacctctacctcccgggttcaagcaattctcctgcctcagcctcccaagtagctgggattacaggcatgcatcaccatgcccagctaatttgtatttttagtagagatggggtttcgccatgttggccaggctggtctcgaactcctgatcttgtgatctacccaccttggcctcccagagtgctgggattacaggtgtaagccaccacacccgacctccaactttcttttgttataaatgtgtcccgtgcaatatttgtaacatactaaataatgttttcataatttatctgaagttaaaatttatctagatgtcctgtgttttacctggcaaccctagtttaatctatatttctaccatgatttttataacgtattatgctttataggaaaaagtaaaaataaatgtaagaatttaataattaatttcaattatcatagatgatcatagataattgagactttcaattattaataaatgattttaaaattatataacggtaaaaatatggagtatagtaggactccgaatgcttctttggacaagctaattaatgtctgggtctctctttctgtattagtaaattggtggtaatattggttctgcttccattttggagtctttgtgaagtcttttgtgaagaactggcttaggaacagtggtgtctggtgaacatttaacaactgactcaaaaaaaaaaatatgtgatttatggcatttgccagtttctgtggtgtaacttcacacaccataaccaatttcaacctgccaatatgatgtctctgaatgcagagttgaaagtggtggttggttgtaaacctgtatgtactttccaggatgcagataaaatagataataacttaggtaacctctagaacatagatagtagtagaatgtagtgaaataattacgtttgtgatgtattctgaatatttattacctttactttcaatttaatttgtttaattgtaaatttataccatttaacacttaataatggctatatttaacgaggatcttcctgaaaatttaacaatcagctcttgtgagccattacaggccagctctagcataccattgcccataacatttttaactactgtacgagtgtgcaaccttttttggttttggttgtgttttgttgtggtggtggtgatggtaagaacacttaacatgagatccaccctctaacaaatttttaagtgtataatacagtattgttaactatagggacaacattgcacagcggatctctagaacttgttcatcttgcttaactgaaactttacgccctttgactggcaactccccatttccccttcccccagcccctgacaacaactattctactccctgattttttgaatttgactattttagatacttcatttaagtggaatcatgcagtatacatccttctgtgactgcttatttatcttagcataatgtcctcaagtttcattcaagttatctgatactgcaggatttcctttttaaaaaatatatgtatattatttttagagagagggtcttgctatgttgcccaggctggagtgtagcagctattcacagtcacaatcagagaacactgcagcctcaaactcccggactcaagcaatctcctgcctcagctgggattacaggtgtgtaccaccgcacctggttaggactgaataatatttttgtatgtacataccatattttctttatccattcatctgtcactgaacacaagttgcttccacattttgactattgtcagtagtgtcacaaactatgttagaatgctaatatctcttcaagatcctgtttcaatacttttagataagtacctagaagtaggattgctagatgatatgtgtattagtcagttttcatgctgctgatgaagacatacctgaaactgggcaatttacaaaagaaagaggtttaactggattcacagttctatgtggctggggaggcctcacagtcatggcagaaggcaaggaagagcaagtcacatcttacatggatggcagcaggcataaaaagagagattgggcagggaaactccccattataaacccatcatatctcgttagacttactcactgtcacaagaatagcatgggaaagacctgcccccatgattcaattacctcccacagggtctctctcactacacgtgggaattcaagatgagatttggatggggacacagccaaaccatattgatatggtatttttattttttttattttttgaggaacctccatactgttttccatagcagctgtaccattttgctgtaccaacagtgtacaagggctcccttttcttcacatcctggccaacccttgttattgttcatctttttgaacaggtgtgagtgatatttcattgtgacattgatttgcatttccctgatgactagtaatgtcaagcatgttttcatgtacctgttggccatttgcatggcttcttgggataaatgtctatttaagtatttacactgtcttaaatcaggttattagttttgttgctactgagttgtaggagttctttttatattgtagaaattaaccccttatctgatggtttgccaacattttcttctattctgtaaattgccttttcactctgttgattgtttcctttgctgtgcagaagcttgtcagtttcatgcagctccatttgtctaattttgtcagtgttgaactttgcttctactgtcagacccattaaatcattgccaggatcaatgtcatgatgctattcccctgttttcttctaggaatcttatagttgcaggacttatgtttaagtctatgagtcattttcagtttactttgcgtatggagtaaaataagggtccaattttatccttttgcatgtgaacatccacttttcccaacaccattttttgaagagatgattcttttcccattgtctgttcttggcacccttatcaccttttgaaggaaaaattgattgtatatgtgtgggttgatttctcagctttctattctgttccattggtaccataagcttgtctttatgccagtaccatactgttttaattactgtagctttgtaatatattctgaaatcaggaagtttgatgcctccagttttgctacttttcaagaaagcaacctacagtttcaataaaattcctatcaaaatctcaatgacatttttcacagaaatagaaaaaataattctaaaattcatatggaaccatgaaatacctcaaacagccacatctaatgtatattattaacattcattcagttagcccacaatcactgaagttaccacgtaagaggcattatataaaagtttttggaaacaaatataatgagaaaaccagtgttgttaataaccacccaaagctctccaaggtggatacattctagtacctgaaggagactgttttctggatggagggatgtgatggctgtcatccatgcaagagtagacatgagatggagccagatggccatacctagagggagaggtgggctttagagggatgccagtagtaggttcttggagtagggaaaagagcatcagtgtgttgcaggggatgtggaggaaggagggaggtctccaaggtgaagcatattaggaggaattgaggaaaggtgatgtgtagaagagggattggtaaaggggtgggcagtgtaacaccctgcccagctcagcccagggacagcagcatttagaacaagtgtagattatgaacctgggaccccgtttctgctggactctgtaagcctcagatgctggatcaactcagatgagggaaaggtagccattaaattgacagatggtgcatttcttgttttagaaaaataaaaaaataggccactgtttgcaccttgaagatgctgaggcaattgttcagtgataatgttaccaagttacttctggctgctcaagatacagtaacttaattaccctgaggttttagtgtcctattgctgctgtaaaaaattactacagatttcatggcttaaaacagaaatgtgttattttccagttctggaggtccaagatgggatggcagggctatgtggctgtgcccctatgggggctttaaggaaggatctgtttccttgtcttttccaagctgcctgttttccttggctccatcttcaaatccagccatgtagcatggctaaaactccttctctcttctactcccccacccctgtctcctttttccctctctcctttataaggacccttctgattacactgggtccacccagataatccaggataatttccccaccttatgttctttaaccccatctgcaaagtccctcttgccatgtaagataacatacaggttctggagattggaatgtggacatctttgaaggactattattctgtcttccacacctggcttttgcaatagcatcatcatcagagtctatagaaaaaacaacaacaacaaaacactctccttttttttttttttttttttttgagacggagtttcactgctgtcgcccaggctggagagcagtggcgatctcggctcacagcaacccctgcctcccaggttcaagtgattctcctgcctcagccttctgagtagctgggactacaggcacccaccaccacacccagctaatttttatacttttagtagaaacagggtttcaccatgttggccaggtttgtcttgaactcctgaccgcaggtgatccacccacctcggcctcccaaagagctgggattaaaatagcttcttgctgtatatacattcctagaacaaggccctcaaataatctatcttatattaagttcttctctgtaactggaattacagttataacagagtccctcgtatttttgagtctcatgcttagaagtaggtttatttgcaacctggcctgccaattgcaaaggtgggtaaacgttttcagcacggatggacgtcaaggtataaatgtcttgaaaagaccccctgaagactgggattctctaagggaaagtcaagaaactgtcagtgctgcacctcagctcccacccctcagcattcctgcaccccacacgctgaactgagtcacgattttgagctctcagcctggctgtgcctcatggccctgccatctaaagtctagacccttccttgacagacagtcataactttcagagacagaaatgtgtaacaaaggaaggcatgcactttgctcactcaacacaaatgtgtggaagggattgatatgggcttaactgtgtctcctgcaaattcatgtgttgaagtcccgggccacagtagttcagaatgtgaccctattaaattacctctaaggaggtaattaagttaaaacaaagtaattagagggagccctaatcccacaggactggtgtttttataagaaaaaaaaaaacacttgaacatatatagggacataggaaagcccatgtgaggacacagtgagaagacagctatctgcaagccagaaagagaggcctcagagtgaaatcaacattgacagcgccttgatcttggacttccagcctccagaactgtgagaaaatacatgtctgttgtttaagcacccagcctgtggtactttgttatggcagccccacaggaatcaaagggggatgccactgaatccagccaaactgtgggaaattttcaaattgaatgtgtcaccaagcatcaaatctgtcttaatggggcaccagccatgagaactatatttaacagcactggtgaccacactcatcctgaggccatgatgcttccaaatgtcacactcactgttgctgactcagctgtgtctctgctgggaaaacaggccagtatgggacactaaggttctccacccccagccagtgttgccctcaggtgagggctgaagaggtggcatccctgttccaccgcttccccgtctcagctctgctttgagcaaatccattctttaggtctcaatcctcttccagggtcaaactttcctgggaatcccatgagcctgtgaaggttctttccagtcccatttggggaagcagaaattcagcaatatggtaagtgtgataaaggtgatttttcagaagtgataatgaagtgctttcactttgtggactgggttgaactgtttcttccaagtattcatgtccacccagaagctcagaatgtgccctcatttgggaatagatctctgcagatgtaatcaaggtgagagatgaagtcaaactggatttcactgggccctaaatccagtgagcatgtgctgggctcttagccacttatttgaaggcccaagcccattcttccactctgcctgagccaaccccgggcctgctggcacctgctcagttctaccagagagtcccttgtgtgagcaataaaccttctctcaaacacttttgtgcatggagagtcatcaacctccatacctgaactaaatttggggtaagggtccttgctgcttttgcaaggggactatacaacactaacagaagaaagaggcacctctgggaagaacatcagcattgaatgactcgtatctatggaaaccactaggcccttaaaactcttcctccagcagcttggccactaaaattcagattcgtgtccatcaatagacccatggcctccttggaggttgtcagaagaatctccaggggtcattcagacaagctgacatcagaaagtgtcagagctgtggcttcaacaaccttgttcagtgatggtcatggagcttccatgttagttcacttcagccttgccacaatttgtcgcaggttttgacggttaatttaactagcaagcaggtgatggcagaaatgtaacattcaaagaagagaacctctggtgaatctacattgtgattgagcttgcctcagcatttctattttcgttccaacttttgcttgccatgagacccagacttggtgtgcccctcctcaggccagatgctaaagtcagtttgaagacatcatggctattcattattgattaggcttttggcacctcgagggtgaactaaagaagacacagctgtggttttaaaggtatgatctgtaagctgagagctgccaaaaacaacaatagacttttcaggtcaatgtgtcctcgatgtgtcaagttgtctgccccgggctgtaagaagaggtagataattaagaaaagtagtgcccatggtggcttcatagctccatgcatggaagaaaggaaaagttgttgccaagttggggctttgcatgggagcaacaataataaaactgtaaggatacgagaatgtctttctccaggactgcatctgtcacaattctttagttaagtttttctgaaaccctgcaggaagcaaaatggaattaattgacacatgtaaatgagaagcctagaagtcatcaagctttaggcatggtggaccaaagtcctcacaggcttgtttctctctggctcttgcctttgtctgcagctgtcctggtcctaatctcagagttcagatgtaataggatctctaggaagtgccgtctcagccttaaatccattaagcaagaagaactccacgaagccttggtggaaatcacagtctatctcattaattgttatgggattcacacgctcatccctgaatgagttgttataaatggaagaatggacagttctgacaacacaaatatttttaaaaattattatgtaccaggcactataccaggggctttgctttacatatcttaaactgattttttaaaataatttctgagagatatatttaatcttcctgatcttaaagccaaggaaaagagactcagagaggtttcataacttgtctaaggtcacacagtatgtggtgggacttggagagtaaagctagactttagacttacaccctagagttagagtggagctgggggtcaccttgtcaaaagcagaatcaagtttacagcctctttgacagatgttcacccagctgttcacaaccttccagaaatgcacaccaaattatcagcccaatctaataacacaataaatagcaagaaagttccctgttatattgaacttgaatctataccccctatttgttacttcctctagggcttttggacactgagtccgattaattcagcctaagttttctttcagtttataggacaatcacatcacacccttggtgcaccgtaagcttgaatcaactaaaactctaggtcttttttttgtctggggagggttttgtttgtttttgattttgcaaataaaaattatttttatcaggcactctcttcttgcatctatgcctttgatctttttaattgcatttggatgtcatctcatttcagccatgcctttttgcatcttgatccagcattgagggggctgttagtgcaaaagcctatcattatagggttttattcaggtcctgtgttcaataggagagtgcccattcaggtctatggaaacccaggcaacttttcctattaaaacaattatccctggagaatattgctcaccttgctgcctacagcatggaggagctgggagctccttactttgcaaatattccctagatttttactcatcacgatgggcacattatgtaggtattagcatctttttttcatgtaactaactcttatttatttatttaaaaaagtttatttccataggttattggggaagaggtagtgttggttacatgagtaagttctttagtggtgacttgtgagattttggtgcacccattacccaagcagtatgcattgcacacaatttgtagtcttttatctctcacacccttccgacccttacccaccgagtccccagagttcattgtgtcattcttatgcctttgcatcctcatagtttagcttccacttatgagtgagaacataggatgcttggtttttcattcctgagttacttcacttagaataatagtctccaatcatccaggttgctgcgaatgccattaattcattcctttttatggccgagtagtattccatcatatataccacagtttctttatccactagttgattgatggacatttcggttggttccacgtttttgcaattgtgaattgtgctgctataaacatgcatgtgcaagtatcttttttgaataatggcttcttttcctctgggtagatacccagtagtgggattgctggatcaaatggtaaagttttcacagtgctccatcctttgacacagtcttctaaacttacatgctctgtcttagcctgtttgggttgctataacaaaaatgacatagactgggtggcttaaacaacatttatttctcacagttctagaggctgggaagtccaagatcaaggccatggcagttttggagtccgacgacaacctgcttcctggttcatagatggccatcttctcactctaccttcacatggcagaaagggaggagagagctctctgtggtctcttttatgagggctctactctcatgcaagagacctccaccttcatgacttagtcatcccccagtggtcccaccttctaataccatcacctcaggagttagaatttcaacatatgaatttcagagggacacaaacattaagtctatagcactttcccactaactaataagcgaccttgggtagatcactttcttggctgggcctcagtttcccccattgacagaatgagagcattgaactaaatgcacttccaaggtttcttctagtgaatttattctctatatctacagttttgcttcacacaccacaaaaagcccaatgaggcttttctttcttgttacaatggcttggttttggatttagatactattttaaaaacactctcaacttcttgccaggataaacaacagctagttcaatgtctcacctattatgttcatagcccattcatttatttggttgttgatttttttattctctctcatcccctttcaaaggtttgcataacaaagtagcttcttgcctgtccatacaaatgtcaccaagtaatattggtgaggagcgaagtataccattcaaaatttgaatatatgcttccactctaaagcaactcctaccagaaactccaagtgatatgctttctatcaccgactgggaataagttattttatgtttaaaagacaaggacttgatggtgctttattaagatagaatttcctatcttccatgaccacatcttatctagttgactcctggggcatgcatcatcctggtggctcagttgacatcattatttccactctaagccacaactacccatgctgtttttaaaaggtgcacatttatccataacaatgaccctggtctgtgcatttctttcaaaagaatgaattgaagcatagcgggtacatgttcaacttacaaatgtaaatgaatgagaagttataaaattaatgaaatcagatgctatttccaagccttctattagagaaaaccatttgtcagcttagtacatcctataccttgattactaatgtccatctccggaaatgcttgtgaagcctagaaacttgttcagaaaatatatggtttgtatagtgctgacacaggtcattaaaatattcagaaacaattactagactaatagaagattttatttccagtggaaaaatgttacagttgacaatagaaagagataagtcttggaataattaatgcctttgctctcctctggtcttcagcattggtctatgatgtacatagatggcttataaatgaggacctacatctacttggaagcagctatttaaatgtagactttctttatttgataaaattacatcctatttttcagttatctctttgccagtcatttgctacttagtcaaataataatacaaccaagacaataagtcttccaaataagagtggaattcagccaactccggttgatgaagaagaacaaggaggtacttttacagaattgttgggatggctggtgaaacagaccaaaagctaaggttctgggcacagtggctaaaatccagccatgagctgcctggccagggagccaagcctctgctgttgtcttctgggtgccagaggaaacagcatggtagcctcagtccacatcaacccacttttgcccagggagggtactataatttgatttgcttgaccctttcaaatctcatgttgaactctgatctctaatgttgaaggcatcacctaataaggactgtgggtagtagggcagattcctcaggaatacattaatgtcctccttggggtgaggagagtgagtgagttcttgctctattagttccctcgcctgcctctctcgcttcctatctcgccatatgatctctgcacacactggctccccttcgccttccaccatgagtggaagcaacctaaaacttcaccagaagcagatgctggcactatgcttcttgtacagcctgaagaactgtgagccaaatgaacctcttctttatgaattactcagcctcaggtatttctttatagcaatacaaatggattaagacagagggtcttgcgagacagctgtgccaccacctgtcctgagagaatggattctgcccagagccacattcctcaagtcactcaactgaaaggcctcagggcagaagctgatggttggagcccaggtcacatgcctgcatcgctgacttagtgaccactcaggatccaaatgttctggtctctgccttgggaagactggacttagactaaagcaaatatgtcctaacaatgccccacctccagaaaatgtgataaatgtccactaggacatcttggggattcaaattacatttagccattgtcattcatcagagaaccaggagaagctgtgaggatggtgtccagcagtcagaactctggagccagttgtatcttccctccttcctctgtccattccacgtgtcctccttaggcctgcactcgcagccaggcacaatgtattcactgcacgtgtcaaagtccaagatggagtaacaggagccagatttcccctctcaccttgaacatgcagagaactggagaaaatggatgcagtaaaagggtttgcacaaagggctgcacaggactatggtccctgagtggaaggaaacaagatgagccaagccttgtggtctcaacagcacactacatgggggacagggagggaacctcaagcagtaccttgctgagttgaagagagagagaacccaaagtttggggagaccagggaggcttgaatttgtgggtcagatacaggagagaagaaagctacacagaattaagctagtttgagtttgtgtccccccaaaatctatatattgaaatcccaaggtgatggtgttaggaggtagagcctttggggggtgattaggtcacagaagcagagcccttgcgagtggcatcagtgcctatatatgtataccaatggaagcccctcactcccactgtcctgtgaggttatagtgagaagtcagccatctgtaacccagaagggcaccctcaccagaactcaaccatgctgccatcctggccttggacttccagcctccagagctgtgagaagtaatttctattgtttataagcctgccagtctatagcaggctgaccagacttagacagctgcaaagggcccctctcccattgattttgtaaagccccagctctttgttctcccttcctagacttctcctagaccaagattttgctttcccatagccttcagacacgttcagaacaacttattaggttaccgattttccctgttagcacagtatggtccaaaaaacattccctttttactggacaggggtgttttccaagcaccccaggacatatattttaaaaatatcatcttaaattatatctgcaaatttattcattaattcagtgaagaatggtcttctaacaagttcttcagcacaaagtattatgctgagtaacagggaggtggagataaagtccttacccttaaggaaaccaacttactaaggaacagagcactgatgaatactctatgaggtgaattttggatagtcacattttcagaggctaaactttgcttcatattctggggacatcttctttatctagcattttctataataactgcaggcatcttgattatctgcaccactaacctgctaattctttaatcctgtaaaactgaattgctttaaatacataaagacaaaaccacatgctggctaatggtttcctctcagctgcagttgtattccagccaccaaaaacccattcactctacttctggtaataatgccacaatttttctcttgcagaccactatcttgcctatcttctgaccatgtgcattgggtggagttggcccttgccctggtcccaggactcagacttgaccaatcagagtatggtatctccctggccaccatgatgggttcagagaggattatgtcatccaatcagcagaatcagtgaaatgcaagaagacttttctgacttttcctttgcagtgaggaagatgtgagttcagagctggcaaagacaccacctggggtcctgagaatgaaatcaaagaggcagaagtcagagccaggagatagaaaaacaccagtccccaatgactatgttagaatgcctcggcctatcctcattttgggatttttagtaaacaacccaagaattttccttcttctgctaaagtttgagttgactttcctaacatttgttagtggaggccaagccccagctgaaacaaatctactcttacattttataataagtgaaccaacggtctcccttcttccacctgcatttgagttgagtgttcttgcccttgctgttaaaggctttcaatcccaaacaccagctgagcaacttctctgctttgctttgtgctgatgctttccaaaatggtttcctgtccattactgaggatgatggttcatctttaaagaccctttattcttgacgaggtctcaggtcccctggtcctgtagatggtatgatgggaaatattgtgttaagtgaccttaaataagttatttggagtattttattctcacatgtgccaatgcacactacaaatttccaagatttatttggtaactgaacctatttttttatgtggcaactattcacctgctaggaaacttgtgttctaaagaattcacactgggaattctagttaaagtcctgtatttccagccattccagagaggatgacagaagcataccagtgccttcacaaaaatcaggttgtctgacgtgggataactggtagggacctgatgacagtcctctgaagaaaagatctttgaagtttcatggaagattctggaaggaagcagggggtaaggagggctagcccagctgaggctctgcaccaggagtctctggagaggctgggaagtgcacaatagcactaggtaccagcaaagcgtgaattaggggtaaacaaggaggccagaagaacaggaaagggaggtgggaaaatgctttttttctttgagacagagtcgcactctgtcacccaggctggagtgcagtggcacaatcttggctcgctacaacctctgctttccaggctcaagcaattctcatgcctcagtttcccaagtagctgggattacaggcttgcaccaccacacccagctaatttttttgtatttttagtagagatggtgttccaccatgttagccaggctggtcttgaactcttgccctcaagttgatctgcctgcctccaccttccaaagtgctaggattacaggcgtaagccactgtgcccatccaggaaatgctttacaattgtgcttagaataaactttggggatgatagataaatgaagatttacttgctctataaaaattattgctaatgggacaagcatctctcaatttaaatttaaatgtaaatgatttttttaaacttttatcaacagtggtctttcaccttccaatagaaactcacatcttcaagtaatcgctgtgggaagaaattctcccagcaccaaacctttgtatggttttcaaagtgatcatccttaaattggacaagagcacttatattgtttactaaaagctaggagaaaccaaaaggataactgaaaagtcaactactgtataaataaacttgcaaatagttaaacaaattgctgcagctttttcaatatattgtaagacttgttttgcctgttagagttttaacttatttttgttgtacttgtagcattaaacacactacttgagtagatgagacttttaaacataaaaatcaataaaacacatttactctgggactgtgatgaagacgtggcattgagctgcttatcatgcctgttgctgagtgcacaatggggcatatttcaggctgccacaatcccttgtgtcttcccctatctcatttcataactcatccagaattgagagctcatgttatcatgtacaggctgtatatccccttgatgtattaaaggtatatattcattactcctgccttggtccttttgcaatgactaagaacagggcacatgcaaaataaaaggtaggagaggagagaaatgaagaaatgtggcacattggaaagaaaagtggggaaacggagaatagagtcagccagaccctctgggctgcagaggaccttctaccagccagacaccctttgtgctaaaggctgaataacagctcctcaaagatgctacaccctagtccccacaacctttgactacctgaccttatatggcaaaggggctttgcagatgtcgttaaattagagatcttgagatgggggtgtaatcctggattagccaatgggccaaatgtgaccacaagtgtccttctgagagggagtggagagggccagagtcagacagagatgcggtgatgtctgcagagctgggcgtgctgggattgttcactgaatggtgttatgaacaaaggaatggagccggcctctaggactggaaaaggaaaggaaatgaattctccccagggcctgcaggaggagtgcagtcctgccaacacatttcttcccccttatgacttaattgcggcttctgatgtccagaattgtaggataatcaatgtgtgttgtctgcagactcaatgcgtttggtagtttgtgacagcagcaataggaaacacacacagacatcaccccctctgggccccctggactccagttcccatgcatgcctaggttaatgaagaatttacttagaggatattcacacacactagttaatagtgggaaatatgtttatatctctatttcaaattttatttaacccactctgtttaagttaaccaagtttaaagggtaagttttctgaaaaggatggactgtctttaaaatgagacaggcttttgactcagttagttctcttcatacccaaaaatagtgaatttcaatgatgaaggccaacattgtgcagttttttttttaacacatccaacggggggaaaatccttatagcgattggtaaaatttgtatgaggttcttttcttattggaaaaagacccttttgggatgttcacactaatcagcatatcttaggatatgattttgtttttccatttctattgggtctaaaaacggagcagcaggctgagaaaaaattgggatcttgggaatgctaactgttcatttcactgacaagttgtaaccaattgttttatcaatatatatttatggatcattttccatagagaggattaagtaagtacaaagaagtaaaagaagggtaccaattctcaaagagtttacaatatgatgtagtcagaccttccctgataccgtgataattggggcaaatgaaagcaaaagaaaagttacaaggtcattaacacctagaaaaattggtttaggattatttgataacaaaaaatactgaggagtaacaccatatcagaatgaattaattcttcataaacttgtgtgaaaatgagtatcacattgagcagtgactgagaaagttgtgagttaaataggaaagatatctaactgttcacaggtatgtttacttgttcaaattttctccaaactgtgcaccattctttaaagatatttattgctaatcagaaatgagcagccctagtttctgtagaaggtaattgtaatgatatcccacatctaagaaaaaatagcctttcttaagggcatggacccaaaagacacaatgacatacagtgcttcatattcatgaggccactcaagacagaatccttcattacagagaatgttaaccaatctggggacttgcacagtggaagcaaacatttccgttcttcttgaagaattcacaagaggaaaggaggtggaactagcagcagtaaggagaggcatatcagctccatgtggatggatctgggatgggaagtgaagattctggaacaacactggtccttcctccatctccctgacaacttctttcctggagcttcccgatattcttcttccttcattcactcagtaaatgttgagcttccccaaacctctcttcctcctgctctatcccctacccttaggtaaatcggtgatctcaaccttcagctgtggactgatacccgcagtcgtatttccagttgatatggtttggatgcgtcctcacccaactctcaccttaaattataataatccccacatgtcaagggcaggatcaggtggagataattgaatcatgggtgcagttttccctatactgttctcgtggtagtgaataagcctcacgagatctgatggttttataaataggagttcccctgcccaaactctctcgcctgctgccgtataagatgtgactctgctccttattcgccttccgctatgattgtgaggcctccccagccatgtggaacagtgagtcaattaagcctctttcctttataaattacccagtcttgggtaggtctttattagcagcatgagaacagactaatacaccactcaagacctgcattttaaggtcccaactcaactgtgagtctgcccttgtagcttccccaggaatctgttacatcgctatcacaccattgtattgaaatcacttattgattcattttgcagactttccaaaagagaacagcaactcaaggactgtcctgggtatcttgaagtcctacagtcctggcataatgctttgcacacaatgagtgctccatgaatgcagtgacataaacaggtgctgtgtaattatcaggagggaaatattactgagctaatggactggttctacaagaataacaaagtgggtctctgcttagaaattatctcgcacttagaaaagaattggatgggtcaaaggaaacaaccagcaaagaattttattattgaattgaaagtgaagtttgtaggatttggggaataggatatatcctccagcgatagtccaggtgacagttcttggacccctaaaactggagaaaatttaagtgaggtaacagcctgagacaataatgatttcatgctttggttaatctgttttagctttttcttcatttgatcatctatcataaatcacatggaggtaataccaataaaactggcatctgtgaactgggtgtttttataaggctttataaagtaatctcatgcaaagtcttctcaaaccccaaataccaccttgtctttaatttgcaaaatacatacctttcctttgaagatagaaaatctctcctattacaaaccattgaacacttttttttttttactgtttcctgatttacaaggtattgtcattcataaaatcaaggtgctgtcattcataaaatcctcttacataagtatttacccaagaatatctcaaagtatctgaagtataaagagaccaaaaacgcaaaatacattgtgagtactgatacaggtttgctggtttcactgtttctcatttagtaaagaaaaactcacaaacctttcacccttaaagggcattttctaaactctaataagcaccaggatgtcaaagccacttcttttatctgcttggtaacctcgcacataagaacagaagagttcaaacattaaaatgccattaagatcactttggttgtaggattcccacaggctcagcaaatctgggtctaattactgcagccttaaatgtgaaaagaggatattctgaagttgcttacaggaagatcttacatgatttaaaaaaaaaaaatgaaaatcaacagtgagacagtagacaacgttaacttaattaaaaaacagcttctggtgaaaaaagcaaaatgtccttaggactgttgatactaaaaacattgacatatctgaactagcccagaaattaaaccatcgaaactcctaagtgatcctctttttctctaccattacaggagagtttggcgcttctcaaaaaagaaagaaaaaaggaaaaaaaggaaggaatgaggaagtgagggagggaaaaagaaaaagaggagagggaagtaaaggaaggaaagaaggaaatgttaacaacaatttaaaaactcagggccgggcgcggtgctcacgcctgtaatgccagcactttgggaggccgaggcgggtggatcacgaggtcaggagatcgagaccatcctggctaacacagtgaaaccccgtctccactaaaagtacaaaaaaaatcagctgggtgtggtggcgggcgcctgtagtcccagctacgggggaggctgaggcaggagaatggcgtgaacccgggaggcggagcttgcagtgagcggagatcgcgccactgcactccagcctgggcgacagagtgagactctgtctcaaaaaaaaaaaacaacactcataaagtttggaaaaggagaggagactatttcttgtaaagagctgccacctgtaaggtggccaccccgagggctgggcaacacaggccttggttgaagcccagagacggacactttgaaggagaaagggttggggtgggagctttatgctgaacagactggctaaacatacatattcaacaggttacaggaagaactacaaatattcatgagggtggtcctgacacatgtatattgaataaacatgcgtgtaacatatgacccatgttcagtttggggtggagacttaacatttaaatgtattacaattaggccctatacgtcaaaaggtcttttcaggacagtaaggcaggcaagtgtgcacccactgtaaactgcccagatccagtccacagttggtggtcgtcttaccagagaaagttactgaaatcagtgttttgtccaattaaagctatagttatggctggtggagcagcagggcttagtcagtgtttggaggtggctgagctgcaattgcttccatattgcttatttcagggccagtgcttgtttagctgctagagaaaaagagtaacctcctggcagttaaaatgtagttgattctttaagtttacggatgtgtgacttaacccttgcctggaatggccttgggccctgtttataatttggcaccctgttgccacaaagcgtctgttctgcctgtcttacgatctctattttaacagtaatgccggccaattgttgtgtctgaaccaccaaagggaagggatgtaacaaggcctctgatctcccatcccatcatggccaggaactcagtttttttgttttgtgtgattttttttaattttactttaaattctgggatacatatgcagaacgtgcaggtttgttacataggtatacatgtgccattgtggtttgctgtacccatcaacccatcatctaggttttaagcccgcatgcattgggtatatgtcctaatgctctacgttgccttgccccctacccccctgacaggccccgatgtgtgaagttccctccctgtgtccatatgttctcattgttcaactcccacttatgagtgagaacatgcagtgtttggttttctattcctgtgttagtctgctgagaatgatggtttccagcttcatccatgccctgcaaaggacatgaattcattcttttttattgctgcatagtattccacggtgtatatgtgccacattttctttatccagtctatcattgatgggcatttgggttggttccaagtctttgctattgtaaatagtgctgtgataaacatacatgtgcacgtgtctttatagtagaacgatttgtaatcctttgggtatatacccagtaatgggatggctgggtcaaatagtatttctggtcctagatccttgaggaatcaccacactgtgttccacaatggttgaactaatttacactcccaccaacagtgtaaaagcaaggaactcacttttaaggattttctggggtcctcttggccataagtgggcccagtcagtgggtggggtggggggtggagcattgttgcttgggtctttatttttagtttatagaaggaaggacaaaaggataacacgaaaatgagtttcagacagaaggggtggcaggaagggacccataaaggaaatatgggacccataaaggaaataagtgaccctttttgagatgaggtgaccacaattttgttcttctgaaaccagcagctcttcttcttcggggtccctctatccccagaaagacctctctgttctttacttcatctttctaatcttcacttttacattcatctatccccttaatttattctttattctctttcttcttccatcactgtttgtgatacaaattgtaaggttgggagacagggtgtggaggtcagtactgtgggttttcctatgttaatgttgccttgagagacagtaacagtttgagtgaggtgacatcctgagagaagcagttctatctcaccatgcatgaagcagtgtgtgttttgaattgaaattagtttggacgcagaaagaccattgaaaagacatttgaatattatctgaaatcctcctagatccccattcatggggtatgtctatgtgtctccatttggttaggtgctaggaaagctgatgggttcaggagaatatccttgtacaacctggaggtcactgggcccctccttttccctctctcaagaagtaaatttgctaaagaagtttttatcttctctcagagccacctctagatatcccctctctgccctgagtggggctcagagctattgcaaatagccatgtaagagtctatggtgtgacctgcccatggggccaacaccctcctctcccactttctctcccagaacgtagaaggacaatgccctgtagaaggcctggccctccatggtccacccaaatccccaaaactcacactccagactactatgtacatagagatggatgacctcagtccattagctcaggtgttcaataactggaactagtttcaattcagtttctcttcagagtgacccttgattcctcatggggcgtggggcaagggagaggcttcagtctttaggctgcgggacatcactgttctcctctagtccatcctggggacagatggactcagagacaggagttggggcaggggaggtgtggatttccccaagggtctagttccgtcctcaggggtgagaatggcccactggcttatgccctccctgggtgatctataaagtgaacaaaacctacaaagactaacctgaggcttctctaaacacagcagtccaaccctggcttcaccttgagtgatggtctaggatagcattggccacagatgaagaatgatgccgctaaatggaaagagaagggccgggcgcggtggctcaggcctgtaatcccagcactttgggaggccgaggcgggcggatcacgaggtcaggagatagagaccatcctggctaacacggtgaaaccctgtctctactaaaaatacaaaagcttagtcaggcgtggtggcgggtgtctgtagtcccagctactcaggaggccgaggcaggagaatggcatgaacccgggaggtggaggttgcagtgagccgagattgcgccactgcactccagcctgggtgacagaaagagactccatctaaaaaaaaaaaaaaaaaagaggtaggtggagaaggttacctgagctccatgcctgagagatctctcgggctgtgtgagccaggcttctccagctggctcagggagcaacaggactgaatcattaagtgctgtgttcacagcctcctgcctgctgactccagcattgttacttgagaggaagggctggcaatcgagaaacaggactggagatgtgctggccactcccgtggcaccctgcgtaaagctctgagcccccacaccagcaccccaaagctcagatgctaaacaggtgacttcttttttattttactgaggaagtaaaattataacctttgtgacaaaagaggctgcttcacagaatggataagggcaaggacttggattgagaaaggctgtgctccaatcctgtctccaacccttactgcagggataccagtttagctccttcattactttgcctctgggagcctcagtttccccagccacaaattgggtatgatagtagtattttcatcctaggtatatggaataattaatgtaaaacacatagcattcaatacatagtaaacaataaataaattatagatctccttaataagtaaaaagatttgaggttactaaaaagatggacatcacaatttttattttcttttaaaattaactttattgtgatataaaataatttataaaatgttcccattttaaggatacaatatagtaccttccaacaaaagtattcactcatgtaatcactactccaattaggacgtaaaatctcctcacttactcaaggatctctcctgttcctatgaggtggtgcccgtgtgataaggtttttctcgggacttgaaacctgggccataccgcgggaagctgggagcctcagccagggcaggaaaggaaagacagggtgaagactgcaagaggactgttgttgaaaacctgtgcgatgcacgagaggcacgtcaagggacttgctcccagaaataactgggtatatttggaggggtggctgaggtcctcctaccacaaaatctggagccatagagccacttagcaaaggggctgccttgagaccagagagcagagcctgagttccttgacccagcatcgcatggtctttcaccactggacactggacactgtgacacctgctccctgtccgacgccaactttaccatgctgcttacaatccttggagcactgtcaattgactaggacctccaggaaagtagaaacatgcccatttaattttctgctgtgcccagggcttagaatgtatgtggcatatagcagacagcaataaatatttgttgactgaataaatgctcgacagcctcacatccatgtccttttccctctggttctctttgtcatatattctctctcccacaccccatccttacccgattctgacttcttcaaagcccatgtgaaattgcttgctatgaaccccttctccccaggcagggcagaactaaccacctcccttccccagagcctgcagcattttcattcctgtatttagtactgacctcttgatccagagatctcatgagccttgctttaaaatggcacatatcaatcctgaggcaaagaagctaaatctttatttaatccacctccaagatgtgccctcctccccttttttaagccataactgaagtgccctatatcactatgccaaaagccagaaaattattaacaatgtgtgccatgagaataatgaaaatgacaagcctctgtttccaccctaattagttaataattaaaactgccttcgagttatcgaaagagtaacaactgtcttgcagttgcagcttcatctagaaggaacatgttggtgagtgtttcactgctggttttcaaaattaaaatctcatcactcaaagagcatctagcaacatcccaacattataatttcaaaagctcactctcaaaaatcttattctattagatgcagtgttaggctgaataaaaggctcgtttttgaaatggataatgggactgcaaaatactcaagatgtcatgagatccacttctgttttcttcaggtaggaactgttttagccactgtgagcaaaggaattgactctgttattctttttttggtttgttgtgtttttgagacggagtctcactctctcgcccaggctgccaggctggagcacagcggtgcgatctcggctcactgcaacctctgcctcctgggttcaagcgattctcctgcctcagccccccggttagctgggattacaggtgcccaacaccacacctggataatgtttgtatttttagtagagatggggtttcaccatgttggccaggctagtctcaaactcctgacctcatgtgatccacccgcctcggcctcccagagtgctgggattactgacgtgagctgccgcgcccaggcggaatccatgctattcttaaagaccttcagaggagaacacgccgtcatgccctgcaggtacttttgcagttaggcagtgtttctactaacaaagtcaagcccaaacatccccttttgtttaggcaacataactggttacacttcaggaaactccaaatgctaacaaactagagattcactctcatatatttaagacacccatcgcagctcagcaaattccacgacagcatggctcagaataggataaactattctgaatccatgccccaacatccaaaacataaaagtactagaacagtcctaatgtaacaccattacacacatccacacaccagggtctcagtgagaatgcgaaaatgtcagtcggtcatagtagaatcattggttaccagagactgaaggggaaataacacggcgcctggtggctgatgcacaaatccccagttgtaagattaacatcacactctaagaataaaatcccctaagactagaagtacccaggagggcacctccttttttctctgaccttcttgtttgactgtcccagccaccatgatagtacctgtataagacatttctaagtggctctggagaagcaatctccctaggcaagcaaaatgtactctgctaaaaatatttaattttttttaatttaacctaaactctcataactccatgtaatgatttctttgtggcctgaaattaaagaatcaataatctattcagctgccctaactggtagttacagaacttgtcttcaattcatacaggcagtctgctcaggcctattttaaaatccacatttgtgattcactgcacagtttgcaaaagattgctttaacaattgttatggccttggttgagcccttgatcaggtttccctgcaaaaaatcccaagctgctcactcagtttgcatgctgccaggttccaatgctccagcctcctctaaccagaacagatggaatgatcagcccacttatagtccttcaatggctctgctcagatttagggggaggttaaagggccttataaggccctccattcctggccctttgcctctcccttctgccttctctccagctgaatcaaacactgtcaccctgactgtcatggtactggttatctctgatctttttcatatgcttagtttctgcctaggattctctttcttgaactggaagccttgcattagccatcttctctaaggacctatcttccagcatggtgcttcccaatattgttcatgtagtgacatccagagaaatgatcatatttgaatggcaccaagtaattaatagattgaggggaaccgagaggccagctgagatttctctggccagaggatcagaccccaccccaccagccactccataccccacctggtggcttcagaggtagagatcaatgtctagggcaccctccaacctggtgctggcacgctcacagagcaacctcgttcctctgactcctaggaggagcaggtgttcctcacatgtgcttcttcccctcccctatcattgaatttatcacacagaatgaaaccgtgtaattaaccaatttaggtgagataaacagtattgttccatagattctgtgcaggcaggggctgcagccttcatgggcaccacggtgaggccggctcatgcacagctggctctttgtaagtggtcagcttcttccccagcataaacaaacacagtggctaatgaggaacctggcactgtccctttcctggtgtgtaactgcacatatatgtgacaggagggacaacttagcaaagcaaaccttatggctgattgcctttattactggctacaaaccaattatttcttttgcctcgtatagtggagctggaagaattctaaagttcaacctaaaatgcacaaatggcatttccttttcatcgtaaatatgacatgtagcccctccacgaagggattgattttgttccttcttttttatattcaacagactaaagttctcagaatttgaagtcttctataaattgccagagctgattgtaatgaagatttcttggggaatacaaggcccccaagccattccaaagctctccttggaatgtgggatcagaatctcatgcagatttctaaatcaaaatcaccaccatcatcattccaggaaagtatcattataatgtagtgccatggtatattctatctcatttatattaccaaaattatcttttttgtgccctaagtagcacagaatggacattctttttttttctgagaggttcaatggaagaatgaacgccaaggatctttatgtagttccaggcaacctaaggcccatctcaactagaaagtcaagaatgatttgtctaagacaacatgtcttcagaagagacaggtgcttattttttttttaacttaccttaagctgaatactatttccagagctaaaattgcaggcttcctttgctgcaggccatggcagcaaatccaaacagaagctttcctggcaaccccaaagcaaacccatttgaccccaagcactcgtcacttctgtgggctgtcatcacgactcttctctccataaggagtacatttagaaaaggacaaaaataggcaaggaaagctgtcgaccattttaattcttcagttttctacatagaattttttttgtggtctattaaaaaatacacagccactcacttgaaatcccttcattgatgtgaggcattaagtctaatccatcttgccatttttaagaattgtcttctcttcctttaaaatcctgctcttattgtaaggttaacacctgtacctctcaatactgtttcatttttctcaaacacctgacttcagttaaacaaggcatatttatgatatcatcataatttgagagcagaggcagtattggatccaagagattgataagtgcaacagcatttttaagctctaaagaaaaatataaacattagctacctttatctttcttgttccttcagcatgtaatgcacagcaaggattcaataaatgtctgctgcatgaatttaaatatggacaaatagaaaagacacaagggaaatatttcacaagaatgataaaacctaaatactgagtccccataatgtcagcattgccaacctagagcattggtctgtgcccaggagaactcctacagctgaatgtggaccttgtgggtgagatgtggctgtcatcccatggggtcatctgatgccaacttaagagttcttagtgctcatacccccaacccccataaaaggattgcacaaggcattagtgaacgaggaagttttactgaaggttctatcggagcatgagtataatcatatcgtacaccattagtgagagccctgtccctcaatccctgctctcatcagaaggcagccccctaccctgccatctggcatcctcacactcgctcaattcaattctgtccccagggaggtgaaaggcaatcagactcaagatgtctatcaaactgagggcttcccaaatttggaacagagaaagaggtgtggagataaaagaggaatagaaaggactcatctgttcacaaagatatctaacaataagttagatcttaattattttttgtgttccctgaaagagaaaggggttattgtaagttatgattccctacacaagtggcaggcacagcaggaagtaaggatgggctacgcaggagatcagcgggaaacaatcagtgggtcacatgttagttctctcagccacttttacaacatctcattaactggtctgaagtgagaagacagtaatgttgagatgccttactccacaattttattctcgtaccttgttttctttgaattagatttgggcaaaatgttagtaaacctggccatcaaaccaaaaagccagtcccaaacctacatcatacattacacagaagggaccccactcagtgcaggctgaatgaagtttttcccatctgcaccaggtaaacattcccattgacaaagctctgggctaagagaacagtccccagttggcagcccaaaaggaatgggaaaagctgcttccagcaagcccaggcacctcttagaattgaccacaaaactacccctcagcctttcagaacaaataacaaatatttctgctcccgcgcttcccagcctgaccacactgccccagctgtgttagtaggaagagaatgtgggtctctaaatgataatacatccatgaaaatggaaatagtctgcctcccaaatgcaggtttaactgtttttcaaaatgtattgagcaggtcaacagaattaaaatcacctgaaaacccgtttaaaaaataaattctccagccccaccccaaacctactgaaccagaattatgcgctttcataagccctttggaggatgctgacgtacactcccgtgtgagaaccatcggtttaagtgaacagttctgaaaaggggatgccacttgatggaactcgttgaatgtggtgatcagtgcagccttaattgacccctccacctacaccccctagagtggagactgcttttgtgaacgggaagcgataatggcatcaagcaaagattaggaaacagagatgaaggaatggaagacaagggggaaaaggaggagagaaaagaagaaaaagtagcttagcctgttggggaaaatacgaaactgggatgaagttagatcaagatgaaatgtgaatggggacctggggcagagaacctgtggctcattggatattcatgtgttctctcacatttcccagaccccaggagtctggatgttgacaggctgtgatctgaaatttcccttttgggtagacatgtgctgccatctccagactctaccaatggagacacctctgaatggtataaagctgtccctgtgtcctccattctaattccgtctagataatcattcattctaagcattttattaataacacagcttcaatcattacatgtgtaactgcaccagaccaatctggttctccttttatgtaacaaggttgtgggttgtttttcagttaccatgggcccctagtttaaaggtcatataacctgagcatgcccacacgaaccaagcttgcagccacaagtggaacctacgtgcttagatggaggagcagggaacctttttcagatgatagggaacatggtaagaccagttaattccatgagcatatgtcccctgtcacacttctttagctgtaaagtgaatgccttggtcagaaccaatactgtgtggaataccatgacagtggataaggcattccatgagtccacggatggtagccttggcagaagcattgcatgcaggataagcaaacccatatccagagtaagtgtctattccattgaggacaaacctctgccctttccatggtggaagaggtccgatatcatcaacctgccaccaggtagctggctgatcaccccaagaaatggtgccaaatcaagggctcagtgttggtctctgctgctggcaaattgggctcccagcagtggctgtagccaggtcagccttggtgagtagaagtccatgttgctgagcccatgcgtaacctccatccctgccaccatggccattttgttcatgggcccatgggcaatgacaggtggctggggaaagaggctgagtgctgtccacagaaccagtcatcctatccaattgattattcaaatccttctagccatggcctggggcttgccagtgcatttcctttgtggaggaaataactgctctgtgcagcaggcagtgaagccatatccctgtgagcattgacctctgcctgctgtagatgaggctgaagaaacccttcctgctaacatgagtccaacctcttagttaagctaagcttggtaagaaataaaatactgcccagtgcatttcctatcaaaacattcaagtttctgtggacaactcagggaggatgttattcctagacatttaccctgtttctccaatttagctcaggatggcaacatttgttgacatagctcttctatattttctaagcttttgtgtgtgtttacagtttgaatactgtcccccaaagacatacttaagttccaaaccccagtacttgtcaatgtgactttactgggaaatagagtccttgcagatgtaattaagttaaagatctcagaatgagattatcctgtatttaaggtgggccctaagcccagcaattgatatgcagatacaagagaagagagaaagattagacatacaggcctgccaaagtagtcaggacttgagataccaagatcctcaagtgaagaaaagtgaagacaacaaaattcgatagtttaagtcacttcctcaaagcattctcttaagatatgcagtccaaaaactgtgtggaaattgagaccaaaaaaaagcgcgcagaaggctaagaaactaagcagagctacagtcatctttacactgttggggaaacaaaaattgggattggatgccaaccaaagtggagagctcctggaaaatattccagtttgcagttgggacccctgaaggactacactctaggaataaaggtaaactggaaacagactagacctttgatagactgaaaattagactgtaatcagtgtcatcttcagttggataaaggttatctgctcctaactccatatcaagagttaaagaaaatccttgttggaaggtaaaatcatccagagcctctacaatttcttagaatatgagtgaatgtgtgtcaatttacagcattcaatgaaaagttagcaggtatatcaagagacaggacatataagagacaggaaaaagaagaaaagacaataaaaacacaccccaggtgatctaagttaaaaagagtttagagactggactctcgctgttattgacagactttaagacaaaatagagaattttactagagaactgaaatctattaaaataccatcaaatggaaattctaaaactgaaaagtacaataactaaaattaaagagatgtgtttcaaaggatattagacaccactaaaaagaggattaatgatttggaaggtatgtcattaaagaatatccataccgaagcacagaaagaaaaggaaacaagtaaacaagagcatgagacatgagaactgtagggcatggtaaaaatgtctaacatatgtgtaattgaattgtgtgtgtattgtatgagtctcagaaatggtgcagacggagtagaacagaagtaattgaagaaataatggctgagatttttttaattgattaaaaaatcagactacaggttttaaaagtgttacaaactcaagtaatataaatacaaagaaaattacacgtaagcacatttcagctgaaaatcaaagactgagaaaatcttaaaagcatccagagtgtggaaaaggcctattatcttctggaaagcaacaagaagatggacagttgactttttaatagactcgactgaagccaagcaaccatgtagtgacatatttaaacataatgaaggaaaataactgccaacatagaactcaacactcagggaaagtatctttgaaaagttaggctaagataaagatttttcaccaacaaacctgtattaacctaacaggagtttttcaggcagaagaaatatgatcttagccaaaagcatggatatgtgggagaaataaaaatatatatattttttaaaatgtgaataaatcccaatgaataataattgtagaaaacaataatcacatcttaaaaacatttaagatgtgtgaaattaaaatttatcagaataatacacaagacattatgtggtaaatgttaaaagttaatgttttctaatgtgtttgcattgtccaagaagtagactgatgtaataacttagtactagtaagttattttagaccttaaactaaggatgcaccttgtaatctctaagtatttttaaaaagtaggaagtagaaaataaaaagaaaattaatagaggagatcatggaatagttagaaaaaaacttgaaaattctaaaataaagaacaaaaaaaaaccagctaatgcaaatataagatggtaactataagcccaaatgtatcagtaattatattaaatgtgaaaaaacaaatgctttaatgaaaaaaacattctaagacttagaagaaaacaaagcctaattatttagaaactcccaacagttggcagaaaagaatgggaaaaacataccatattataaatgctgactgaaagaaagctggtgtagctttattaatatcaaagcagtctttaagacgagaagcattactagagagaaagagaaatattttataaagaaaaattaaaaggtcaatccaccaggaagatataacaagtggtatatgcacctgataacacagcttcaaaatatataaatcaaaaattgacagaactaaagggaaaaatagacaaatgtgcaattatagtgagagattttaacatttctcagtgactggtagcacacacagaggaaaaaaagaataaaaaagattgggacaacataattaacatgaagcaattgccatgtaaagaattgtacacttggcaactgcagagcccgcaatgttttatatgcatgagaaacatttaacaaaaatgtccatatgctatttcacaaagagcatctcaacacaattcaaaacatcagacttatacaacatattgtctctggctccagtgaaatttagctagaaataaataacaaaaaataattacaaaattctgtaatttaagaaattaagcagcaaatgtataaataatccatgccatcactctatattgtgtatttacctgattgatggagttacatgcttttttgaaggtaagaaaaatcaaaatcttttacttacaaattacaagtacttaaaaataatatgaaatcctacaataacttttactaagctatacttcaggtatcacttttttcctttgtcagcatttaaggataaaagggtggtacctactatggacaacacaaatttattcttccatttcctcaaattaaggttaaaggaccaacactgtaaaattgccattttgatcatttatatcagtaaatgaacttcagcatcttttcaaatgacactgtgtttttaaacatttgacctccatttacttgagatatctgccactgcattacagattacaatggaattattctgaaaatatatctttaaatttttttaacaaaacatcctattttcaaggacactgtgaaagaaatatcaataaactggaggctagaatggatgaccccaacttgaaggctctgattatcctcaaatcctaatttggcctacttcagttttcttttcctttttttttatactttacgttctagggtacatgtgcacaatgtgcaggctcgttacataggtatacgtgtgccatgttggcctgctgcacccatcaacccatcatttacattaggtatttttcccagtgctatccctccgcctgcccccaacccacaacaggccccagtgtgtgatgttccccaccctgtgtccaagtgttctcattgttcaattcctacctatgagtgagaacatgcagtgtttggtgttctgtccttgtggtagtttgctgagaatgatggtttccagcttcattcatggccctgcaaaggacatgaactgattcttttttatagctgcatagtattccgtggtgtatatgtgccacattttcttaatccagtctatcattgatggacatttgggttggttccaagtctttgctattgtgaatagtgccacaataaacatacgtgtgcatgtgtctttatagtggcatgatttataatcctttgggtatatacccagtaatgggatcgctgggtcaaatggtatttctaagtctagatccttaaggaatcaccacactgtcttccacaatggttgaactagtttacactcccaccaacagtgtaaaacattcctatttctccacatcctctccagcatctgttgtttcctgactttttattgattgccattctaactggtgtgagatggtatctcattgtggttttgatttgcatttctctgatgatcagtgatgatgagcattttttcatgtgtctgttgggtgcataaatgtcatcttttgagaaatgtccatatcctttgcccactttttgatggggttgtttgattttttcttgtaaatttgtttaagttctttgtaaattctggatattagccctttgtcagatgagtagattgcaaaaattttctcccattctgtaggttgcctgttcactctgatgatagtttctttggctgtgcagaagctctttagtttaattagaccccatttgtcaattttggcttttgtttccattgcttttggtgttttagtcatgaagtacttgcccatgcctatgtcctgaatggtattgcctaggtgttcttctagggtttttatgttttaggtctaacatttaagtctttaatccatcttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtgttatttctgaggcctctattctgttccattggtctatatctctgttttggtacaagtaccatgctgttttgattactgtagccttgtagtatagtttgaagtcaggtagtgtgatgcctccagctttgttcttttttgcttaggattgacttggcaatgtgggctcttttctgattccatatgaactttaaagtagttttttccaattctgtgaaaaaagtcattggtagcttgatggggatggcattgaatctataaattactttgggcagtatggccattttcatggtattgattcttcctatccatgagcatggaatgttcttccaaagcatgtagttctcatgccatggttttcagccccatcaggtcatttaaggtcttctctacactgtttattctagttagccatttgtctaatcttttttcaaggtttttagcagccttgcaatgggtttgaatatcctcctttagctcggagaagtttgttattaccgaccttctgaagcctacttctgtcagctcatcaaagtcattctctgtccagctttgttctattgctggcgaggagctacaatcctttggaggagaagaggcactctggtttttagaattttcagcttttttgctctggtttctggttccattttcttaattaatgatcaagatattaaatactacatctcatgctaaacctacatgacagcataaggttaaatttctttttaaaaattttgggaagacttgatgagacaagagtgcattcttcatatttgaatgatgttgaagagattagatttgttctaatcctaatttcataggaaaaaactagaatcagaggaagcaaatattgggaagatttcaggttaaaatgagtttcctttcattttaatgtaatatttaatttttagatattgtaaaaggaaatgttagacagtatgcactccaaatttcgccgcaatggcattacacttgttttatgtcttcatttgcctgtgcaacctgtatgttcacacacctgtagttggtatgcatttgtaaacttcatagtagcaggctctgtgactgaaccacagtgtttccaaacttttgacagtctgaattgggaacaaactgctatttgttagaatgccagaaatatatgccctatgcctctaaaggtaaagggtgagtttgcccttgggaaagactctatttcacttttgtgagtaattacattctgaaagttttaaaacaagaagctttttgttgtccttgaactttgggaagtattcccaatgtaaatgcttaaaactgagatgttaaattttcatcacattaatagaaaaggctattttcatcatgggcatctttgagagatttttttataatggagatgggtggaacggcagagaggggtaactggagcccctgggacttgctggagaagaggaaatgacaaagtggatgctaaataggaaagatgggcccagcaaaatgttcgcacacacagcctaaggagggagacagccacatgggcctgatggggtgtcatgagccactgccttcaaattaaagttgtcctttcctgaatgctaattcccttacattactgtcagatcttcattaaggtattttaaacaccactgtgtcgatggtgctatgccttggggattaagagaggagtcaagtgtgagttcagacatgaggagttatgagaccatgagagctccaccagcacggagaagtgcaccaagatggtgcatggactatggcaaatatatctgaaagtaggcatgtggagcaggagtgaggagggaaggcaacaggtgagcactcccgggattcctcgggaagggactagactcttgcagtcatgcgagatggagccttggattctgggcattcgcttactgcaagcaggaatggcccctgggagcctgaagaactcgggatcagttggggtcctcttggactgaatattgtgggaattttcttaggcagaactttctatcaaatagtggacagactgtctcagcaagcatcaggttcccatcatgaggaccaagcagaagctggtgatgacagatgctggggaaggatttctgcttcggggggagttttcccaagtaagcctgttagagctgttagagctacaagctgagcattaacagaattctaagcttttgaactgaagcatagaaaagtgtttctggaatacaaaaataggtcaaccacatgctttgaggagaatttccatgacaaagccattcagttctctccctgatgttacctgggaacatccagggagtctcctcagtggcacttggtttaaagactgagtgatagggagtatatctagacaaagcccaggaccccaggcagctgctattctctgaggagtagagtcaagcattcatgcatctgagaaacgctgccatgagggataagccaatatacaggaaatgtcacagcttttggaaataatgggtcgtgaacatggaggaaagaggagattggtaaagcctgggagagcaaccttatttctcctaatataaaaccctacctattttaagacattcagatttcagagatggtaatttcttttacatgcatcatctttttgtttttgagacagggtctcactctgtcacccatgctggagtgcagtgtcactcgacaactcactgcagcctcaacttcttgggctcaggtgatgaaaaatacatctttaaatcactgttttccatggcctaacctatattttgataaaaataaataaaagcaaattaaaaccaaggactaattgagtttatattaactaaagaaaatttttctaccaacaaccatactattgacatgcacagccctgacttccaaaaatttctcatcaggagagacacttttggtttttgctttttgcctcatgctgcttacgatggctgtttgtgatttttcaactattagcaggatccacagagaccctcacttcaaccgggcatgacaatggggcactgttatattttaggaaataaattgtcaacctgcattgaattactcatggaaaggttgagttagctacacaaaagtgtaaaattgagagccacgttccaaaagggaattcttggtcctggactacagcagactaataatgactgctcattcccttgaacataaagatcctggggggtttccccgggcggtgtgcctgcagccaaaaatattttgagggtaaaaatttgcccatgtccttttcagcttccataatgaattacaccatctgacctccaaactggaaagttctaagttaattcccttctctgcatccctcacccaccacctgctgttccagtaattgattggccctggcaaaattggaaactaaattaattttgtcttcctgtgccttctcattctcttttttcaaacctcctttggcatgattttcaccttagttttctaggccctctgacatcccagagtcattggcattttcctcctcacttctcatcagtgtcaacccacctattccaacactagactcatctcctgccagatgcttccagcaaaggtgtaaatttgtgtgtgtgtgtcagagtttcat
